US012473334B2

(12) United States Patent
Kadoch et al.

(10) Patent No.: US 12,473,334 B2
(45) Date of Patent: Nov. 18, 2025

(54) SWI/SNF FAMILY CHROMATIN REMODELING COMPLEXES AND USES THEREOF

(71) Applicant: Dana-Farber Cancer Institute, Inc., Boston, MA (US)

(72) Inventors: Cigall Kadoch, Tiburon, CA (US); Nazar Mashtalir, Allston, MA (US); Brittany C. Michel, Brookline, MA (US); Andrew D'Avino, Boston, MA (US)

(73) Assignee: Dana-Farber Cancer Institute, Inc., Boston, MA (US)

( * ) Notice: Subject to any disclaimer, the term of this patent is extended or adjusted under 35 U.S.C. 154(b) by 599 days.

(21) Appl. No.: 17/283,804

(22) PCT Filed: Oct. 15, 2019

(86) PCT No.: PCT/US2019/056365
§ 371 (c)(1),
(2) Date: Apr. 8, 2021

(87) PCT Pub. No.: WO2020/081588
PCT Pub. Date: Apr. 23, 2020

(65) Prior Publication Data

US 2023/0035235 A1 Feb. 2, 2023

Related U.S. Application Data

(60) Provisional application No. 62/746,956, filed on Oct. 17, 2018.

(51) Int. Cl.
*C07K 14/47* (2006.01)
*A61K 38/00* (2006.01)
*G01N 33/68* (2006.01)

(52) U.S. Cl.
CPC ..... *C07K 14/4702* (2013.01); *G01N 33/6875* (2013.01); *A61K 38/00* (2013.01); *C07K 2319/41* (2013.01); *C07K 2319/42* (2013.01); *C07K 2319/43* (2013.01); *G01N 2500/04* (2013.01)

(58) Field of Classification Search
None
See application file for complete search history.

(56) References Cited

U.S. PATENT DOCUMENTS

| | | | |
|---|---|---|---|
| 2,788,341 | A | 4/1957 | Schwyzer |
| 3,717,642 | A | 2/1973 | Von Strandtmann |
| 4,109,496 | A | 8/1978 | Allemann et al. |
| 4,650,796 | A | 3/1987 | George et al. |
| 4,868,103 | A | 9/1989 | Stavrianopoulos et al. |
| 5,223,409 | A | 6/1993 | Ladner et al. |
| 5,225,422 | A | 7/1993 | Nagata et al. |
| 5,283,317 | A | 2/1994 | Saifer et al. |
| 5,631,169 | A | 5/1997 | Lakowicz et al. |
| 5,677,158 | A | 10/1997 | Zhou et al. |
| 5,801,030 | A | 9/1998 | McVey et al. |
| 5,858,358 | A | 1/1999 | June et al. |
| 5,883,223 | A | 3/1999 | Gray |
| 6,309,634 | B1 | 10/2001 | Bankiewicz et al. |
| 6,352,694 | B1 | 3/2002 | June et al. |
| 6,683,058 | B1 | 1/2004 | Tuszynski |
| 6,692,964 | B1 | 2/2004 | June et al. |
| 6,797,514 | B2 | 9/2004 | Berenson et al. |
| 6,867,041 | B2 | 3/2005 | Berenson et al. |
| 6,887,466 | B2 | 5/2005 | June et al. |
| 6,905,680 | B2 | 6/2005 | June et al. |
| 6,905,681 | B1 | 6/2005 | June et al. |
| 6,905,874 | B2 | 6/2005 | Berenson et al. |
| 7,067,318 | B2 | 6/2006 | June et al. |
| 7,144,575 | B2 | 12/2006 | June et al. |
| 7,172,869 | B2 | 2/2007 | June et al. |
| 7,175,843 | B2 | 2/2007 | June et al. |
| 7,232,566 | B2 | 6/2007 | June et al. |
| 8,697,359 | B1 | 4/2014 | Zhang |
| 8,703,761 | B2 | 4/2014 | Forster et al. |
| 8,771,945 | B1 | 7/2014 | Zhang |
| 8,795,965 | B2 | 8/2014 | Zhang |
| 8,946,268 | B2 | 2/2015 | Lau et al. |
| 9,353,051 | B2 | 5/2016 | Byrd et al. |
| 9,410,943 | B2 | 8/2016 | Kadoch et al. |
| 9,636,323 | B2 | 5/2017 | Lin et al. |
| 9,708,348 | B2 | 7/2017 | Castro et al. |
| 10,105,420 | B2 | 10/2018 | Kadoch et al. |

(Continued)

FOREIGN PATENT DOCUMENTS

| | | | |
|---|---|---|---|
| CN | 103038231 | A | 4/2013 |
| CN | 104530013 | A | 4/2015 |

(Continued)

OTHER PUBLICATIONS

Chandler et al. (Mol Cell Biol. Jan. 2013; 33(2): 265-280). (Year: 2013).*

Kadoch et al., "Mammalian SWI/SNF chromatin remodeling complexes and cancer: Mechanistic insights gained from human genomics", Science Advances 1(5):e1500447 (2015).

Chandler et al., "ARID1a-DNA Interactions Are Required for Promoter Occupancy by SWI/SNF," Mol Cell Biol 33(2):265-280 (2013).

International Search Report and Written Opinion for International Application No. PCT/US19/56365 dated Jan. 30, 2020.

Adamo et al., "The oncogene ERG: a key factor in prostate cancer," Oncogene 35(4):403-14 (2016).

(Continued)

*Primary Examiner* — Sergio Coffa
(74) *Attorney, Agent, or Firm* — Foley Hoag LLP

(57) ABSTRACT

The present invention is based, in part, on the novel discovery of the architecture and assembly pathway of three different classes of mammalian SWI/SNF complexes, compositions comprising the isolated modified SWI/SNF complexes, and methods of screening for modulators of the function and/or stability of same.

15 Claims, 88 Drawing Sheets

Specification includes a Sequence Listing.

(56) References Cited

U.S. PATENT DOCUMENTS

| | | | |
|---|---|---|---|
| 10,131,637 | B2 | 11/2018 | Abdel-Meguid et al. |
| 10,239,888 | B2 | 3/2019 | Bradner et al. |
| 10,464,925 | B2 | 11/2019 | Bradner et al. |
| 10,646,575 | B2 | 5/2020 | Phillips et al. |
| 10,660,968 | B2 | 5/2020 | Phillips et al. |
| 10,669,253 | B2 | 6/2020 | Bradner et al. |
| 10,849,982 | B2 | 12/2020 | Phillips et al. |
| 10,905,768 | B1 | 2/2021 | Phillips et al. |
| 10,976,320 | B2 | 4/2021 | Dykhuizen et al. |
| 11,485,732 | B2 | 11/2022 | Vaswani et al. |
| 11,497,752 | B2 | 11/2022 | Anthony et al. |
| 11,639,345 | B2 | 5/2023 | Bloch et al. |
| 2002/0022018 | A1 | 2/2002 | Curiel et al. |
| 2002/0037281 | A1 | 3/2002 | Davidson et al. |
| 2002/0106632 | A1 | 8/2002 | Manfredi |
| 2003/0022375 | A1 | 1/2003 | Itoh et al. |
| 2003/0027335 | A1 | 2/2003 | Ruley et al. |
| 2004/0216178 | A1 | 10/2004 | Jones et al. |
| 2005/0079512 | A1 | 4/2005 | Emerson et al. |
| 2005/0130919 | A1 | 6/2005 | Xu et al. |
| 2006/0058255 | A1 | 3/2006 | Chen et al. |
| 2006/0121005 | A1 | 6/2006 | Berenson et al. |
| 2007/0105181 | A1 | 5/2007 | Pope et al. |
| 2009/0163545 | A1 | 6/2009 | Goldfarb |
| 2010/0048565 | A1 | 2/2010 | Frenkel et al. |
| 2010/0284990 | A1 | 11/2010 | Kaemmerer et al. |
| 2011/0230486 | A1 | 9/2011 | Lau et al. |
| 2012/0034867 | A1 | 2/2012 | Griffin et al. |
| 2012/0035244 | A1 | 2/2012 | Chinnaiyan et al. |
| 2012/0308484 | A1 | 12/2012 | Szalay et al. |
| 2013/0034867 | A1 | 2/2013 | Bomgarden et al. |
| 2014/0068797 | A1 | 3/2014 | Doudna et al. |
| 2014/0287931 | A1 | 9/2014 | Bernards et al. |
| 2015/0018315 | A1 | 1/2015 | Kley et al. |
| 2015/0057169 | A1 | 2/2015 | Siu et al. |
| 2015/0376139 | A1 | 12/2015 | Abdel-Meguid et al. |
| 2016/0032402 | A1 | 2/2016 | Jagani et al. |
| 2016/0130663 | A1 | 5/2016 | Kohno et al. |
| 2016/0176916 | A1 | 6/2016 | Bradner et al. |
| 2016/0200721 | A1 | 7/2016 | Yukimasa et al. |
| 2016/0347708 | A1 | 12/2016 | Ebright et al. |
| 2017/0174688 | A1 | 6/2017 | Dai et al. |
| 2018/0086720 | A1 | 3/2018 | Albrecht et al. |
| 2018/0105500 | A1 | 4/2018 | Derbyshire et al. |
| 2018/0140722 | A1 | 5/2018 | Willis et al. |
| 2018/0258491 | A1 | 9/2018 | Jagani et al. |
| 2018/0328913 | A1 | 11/2018 | Kadoch et al. |
| 2020/0069669 | A1 | 3/2020 | Grassian et al. |
| 2020/0206344 | A1 | 7/2020 | Kadoch et al. |
| 2021/0009568 | A1 | 1/2021 | Zhou et al. |
| 2021/0038611 | A1 | 2/2021 | Anthony et al. |
| 2021/0171958 | A1 | 6/2021 | Chan et al. |
| 2021/0230154 | A1 | 7/2021 | Vaswani et al. |
| 2021/0230190 | A1 | 7/2021 | Ruppel et al. |
| 2021/0251988 | A1 | 8/2021 | Zhou et al. |
| 2021/0260171 | A1 | 8/2021 | Zhou et al. |
| 2022/0016083 | A1 | 1/2022 | Centore et al. |
| 2022/0079940 | A1 | 3/2022 | Centore et al. |
| 2022/0098190 | A1 | 3/2022 | Ruppel et al. |
| 2022/0119378 | A1 | 4/2022 | Anthony et al. |
| 2023/0035235 | A1 | 2/2023 | Kadoch et al. |
| 2023/0079819 | A1 | 3/2023 | Vaswani et al. |
| 2023/0121497 | A1 | 4/2023 | Vaswani et al. |
| 2023/0138480 | A1 | 5/2023 | Anthony et al. |
| 2024/0101550 | A1 | 3/2024 | Vaswani et al. |

FOREIGN PATENT DOCUMENTS

| | | | |
|---|---|---|---|
| CN | 105473141 | A | 4/2016 |
| CN | 107531668 | A | 1/2018 |
| EA | 202192101 | A1 | 12/2021 |
| JP | 2008-505963 | A | 2/2008 |
| JP | 2011-507910 | A | 3/2011 |
| JP | 2011-528016 | A | 11/2011 |
| WO | WO-94/10300 | A1 | 5/1994 |
| WO | WO-95/30761 | A2 | 11/1995 |
| WO | WO-2000/024392 | A1 | 5/2000 |
| WO | WO-00/59888 | A1 | 10/2000 |
| WO | WO-00/59905 | A1 | 10/2000 |
| WO | WO-2005/039643 | A2 | 5/2005 |
| WO | WO-2005/112620 | A2 | 12/2005 |
| WO | WO-2006/005941 | A1 | 1/2006 |
| WO | WO-2006/051063 | A1 | 5/2006 |
| WO | WO-2008/022396 | A1 | 2/2008 |
| WO | WO-2009/086303 | A2 | 7/2009 |
| WO | WO-2010/007046 | A2 | 1/2010 |
| WO | WO-2011/115998 | A2 | 9/2011 |
| WO | WO-2012/085650 | A1 | 6/2012 |
| WO | WO-2013/116663 | A1 | 8/2013 |
| WO | WO-2014/150395 | A1 | 9/2014 |
| WO | WO-2015/103317 | A1 | 7/2015 |
| WO | WO-2015/120320 | A1 | 8/2015 |
| WO | WO-2016/054491 | A1 | 4/2016 |
| WO | WO-2016/138114 | A1 | 9/2016 |
| WO | WO-2016/160718 | A1 | 10/2016 |
| WO | WO-2016/207212 | A1 | 12/2016 |
| WO | WO-2017/024318 | A1 | 2/2017 |
| WO | WO-2017/118734 | A1 | 7/2017 |
| WO | WO-2017/158381 | A1 | 9/2017 |
| WO | WO-2018/148443 | A1 | 8/2018 |
| WO | WO-2018/160636 | A1 | 9/2018 |
| WO | WO-2019/152437 | A1 | 8/2019 |
| WO | WO-2019/226915 | A1 | 11/2019 |
| WO | WO-2020/035779 | A1 | 2/2020 |
| WO | WO-2020/081588 | A1 | 4/2020 |
| WO | WO-2020/106915 | A1 | 5/2020 |
| WO | WO-2020/127685 | A1 | 6/2020 |
| WO | WO-2020/081556 | A3 | 7/2020 |
| WO | WO-2020/160100 | A1 | 8/2020 |
| WO | WO-2020/160180 | A1 | 8/2020 |
| WO | WO-2021/081032 | A1 | 4/2021 |
| WO | WO-2021/155262 | A1 | 8/2021 |
| WO | WO-2021/155264 | A1 | 8/2021 |
| WO | WO-2021/155316 | A1 | 8/2021 |
| WO | WO-2021/155320 | A1 | 8/2021 |
| WO | WO-2021/155321 | A2 | 8/2021 |
| WO | WO-2021/183218 | A1 | 9/2021 |
| WO | WO-2021/236080 | A1 | 11/2021 |
| WO | WO-2022/198043 | A1 | 9/2022 |
| WO | WO-2023/009834 | A2 | 2/2023 |
| WO | WO-2023/196560 | A1 | 10/2023 |
| WO | WO-2023/196565 | A1 | 10/2023 |
| WO | WO-2023/196567 | A2 | 10/2023 |

OTHER PUBLICATIONS

Advani et al., "A Phase 1 study of imatinib mesylate in combination with cytarabine and daunorubicin for ckit positive relapsed acute myeloid leukemia," Leuk Res. 34(12):1622-6 (Dec. 2010).

Alazawi, "Foghorn Therapeutics," Blackseed Bio, last updated Mar. 4, 2022, retrieved Jul. 24, 2023, from <https://blackseedbio.com/reports/fhtx#pipeline> (26 pages).

Anders et al., "HTSeq—a Python framework to work with high-throughput sequencing data," Bioinformatics 31(2):166-9 (Jan. 1, 20155).

Asangani et al., "Therapeutic targeting of BET bromodomain proteins in castration-resistant prostate cancer," available in PMC Dec. 12, 2014. Published in final edited form as: Nature. 510(7504):278-82 (2014) (44 pages).

Attard et al., "Duplication of the fusion of TMPRSS2 to ERG sequences identifies fatal human prostate cancer," available in PMC Feb. 24, 2009. Published in final edited form as: Oncogene. 27(3):253-63 (2008) (19 pages).

Basuyaux et al., "The Ets transcription factors interact with each other and with the c-Fos/c-Jun complex via distinct protein domains in a DNA-dependent and -independent manner," J Biol Chem. 272(42):26188-95 (1997).

Bendall et al., "Prevention of amino acid conversion in SILAC experiments with embryonic stem cells," Mol Cell Proteomics. 7(9):1587-97 (2008).

(56) References Cited

OTHER PUBLICATIONS

Berger et al., "Androgen-induced differentiation and tumorigenicity of human prostate epithelial cells," Cancer Res. 64(24):8867-75 (2004).
Börno et al., "Genome-wide DNA methylation events in TMPRSS2-ERG fusion-negative prostate cancers implicate an EZH2-dependent mechanism with miR-26a hypermethylation," Cancer Discov. 2(11):1024-35 (2012).
Camuzeaux et al., "Imaging Erg and Jun transcription factor interaction in living cells using fluorescence resonance energy transfer analyses," Biochem Biophys Res Commun. 332(4):1107-14 (2005).
Cancer Genome Atlas Research Network, "The Molecular Taxonomy of Primary Prostate Cancer," Cell. 163(4):1011-25 (2015) (16 pages).
Carell et al., "A novel procedure for the synthesis of libraries containing small organic molecules," Angew Chem Int Ed Engl. 33(20):2059-2061 (1994).
Carell et al., "A Solution-Phase Screening Procedure for the Isolation of Active Compounds from a Library of Molecules," Angewandte Chemie International Edition in English. 33(20):2061-2064 (1994).
Centore et al., "Abstract 1224: Discovery of novel BAF inhibitors for the treatment of transcription factordriven cancers," Poster Presentations—Proffered abstracts, Cancer Research 81(13_ Supplement):1224 (Jul. 1, 2021) (2 pages).
Chen et al., "ETS factors reprogram the androgen receptor cistrome and prime prostate tumorigenesis in response to PTEN loss," available in PMC Feb. 1, 2014. Published in final edited form as: Nat Med. 19(8):1023-9 (2013) (21 pages).
Chng et al., "A transcriptional repressor co-regulatory network governing androgen response in prostate cancers," EMBO J. 31(12):2810-23 (2012).
Cho et al., "An unnatural biopolymer," Science. 261(5126):1303-1305 (1993).
Cull et al., "Screening for receptor ligands using large libraries of peptides linked to the C terminus of the lac repressor," Proc Natl Acad Sci. 89(5):1865-1869. (1992).
Cwirla et al., "Peptides on phage: A vast library of peptides for identifying ligands," Proc Nati Acad Sci. 87:6378-6382 (1990).
Delattre et al., "Gene fusion with an ETS DNA-binding domain caused by chromosome translocation in human tumours," Nature. 359(6391):162-5 (1992).
Demichelis et al., "TMPRSS2:ERG gene fusion associated with lethal prostate cancer in a watchful waiting cohort," Oncogene 26:4596-4599 (2007).
Devlin et al., "Random Peptide Libraries: a Source of Specific Protein Binding Molecules," Science. 249(4967):404-406 (1990).
DeWitt et al., "'Diversomers'": an approach to nonpeptide, nonoligomeric chemical diversity, Proc Natl Acad Sci. 90(15):6909-6913 (1993).
Dobin et al., "Star: ultrafast universal RNA-seq aligner," Bioinformatics. 29(1):15-21 (2013).
Dominguez et al. "Beyond editing: Repurposing CRISPR-Cas9 for Precision Genome Regulation and Interrogation," available in PMC Jun. 27, 2016, published in final edited form as: Nat Rev Mol Cell Biol. 17(1):5-15 (Jan. 2016) (24 pages).
Donaldson et al., "Solution structure of the ETS domain from murine Ets-1 : a winged helix-turn-helix DNA binding motif," EMBO J. 15(1):125-34 (1996).
Erb et al., "Recursive deconvolution of combinatorial chemical libraries," Proc Natl Acad Sci. 91(24):11422-11426 (1994).
Extended European Search Report for European Application No. 19748410.8, dated Sep. 24, 2021.
Extended European Search Report for European Application No. 19887386.1, dated Dec. 5, 2022.
Extended European Search Report for European Application No. 20749261.2, dated Oct. 18, 2022.
Extended European Search Report for European Application No. 21748261.1, dated Jan. 29, 2024.
Fathi et al., "Differentiation syndrome with lower-intensity treatments for acute myeloid leukemia," Am J Hematol. 96(6):735-46 (Jun. 1, 2021) (13 Pages).
Felici et al., "Selection of antibody ligands from a large library of oligopeptides expressed on a multivalent exposition vector," J Mol Biol. 222(2):301-10 (1991).
Feng et al., "GFold: a generalized fold change for ranking differentially expressed genes from RNA-seq data," Bioinformatics. 28(21):2782-8 (2012).
Fodor et al., "Multiplexed biochemical assays with biological chips," Nature. 364:555-556 (1993).
Gaj et al. "ZFN, TALEN and CRISPR/Cas-based Methods for Genome Engineering," available in PMC Jul. 1, 2014, published in final edited form as: Trends Biotechnol. 31 (7):397-405 (Jul. 2013) (20 pages).
Gallop et al., "Applications of Combinatorial Technologies to Drug Discovery. 1. Background and Peptide Combinatorial Libraries," J Med Chem 37(9):1233-51 (1994).
Gene Ontology Consortium, "Gene Ontology Consortium: going forward," Nucleic Acids Res. 43(Database issue):D1049-56 (2015).
Godwin et al., "Gemtuzumab ozogamicin in acute myeloid leukemia," Leukemia 31(9):1855-68 (Sep. 2017).
Helgeson et al., "Characterization of TMPRSS2:ETV5 and SLC45A3:ETV5 gene fusions in prostate cancer," Cancer Res. 68(1):73-80 (2008).
Ho et al., "An embryonic stem cell chromatin remodeling complex, esBAF, is essential for embryonic stem cell self-renewal and pluripotency," Proc Natl Acad Sci U S A. 106(13):5181-6 (2009).
Houghten et al., "The use of synthetic peptide combinatorial libraries for the identification of bioactive peptides," Biotechniques. 13(3):412-21 (1992).
Huang, U.S. Appl. No. 18/282,279 titled "Therapeutic Regimens of an Inhibitor of the Enzymatic Activity of BRG1 and BRM", filed Sep. 15, 2023.
Ichikawa et al., "An RNA-binding protein gene, TLS/FUS, is fused to ERG in human myeloid leukemia with t(16;21) chromosomal translocation," Cancer Res. 54(11):2865-8 (1994).
International Preliminary Report on Patentability for International Application No. PCT/US2016/062911 dated May 22, 2018.
International Preliminary Report on Patentability for International Application No. PCT/US2019/015722 dated Aug. 4, 2020.
International Preliminary Report on Patentability for International Application No. PCT/US2020/033829 dated Nov. 17, 2022.
International Preliminary Report on Patentability for International Application No. PCT/US2022/019506 dated Sep. 12, 2023.
International Preliminary Report on Patentability for International Application No. PCT/US2022/02094 dated Sep. 12, 2023.
International Search Report and Written Opinion for International Application No. PCT/US19/15722 dated May 31, 2019.
International Search Report and Written Opinion for International Application No. PCT/US2016/062911 dated Mar. 3, 2017.
International Search Report and Written Opinion for International Application No. PCT/US2020/015605 dated Jun. 16, 2020.
International Search Report and Written Opinion for International Application No. PCT/US2020/015723 dated Jul. 2, 2020.
International Search Report and Written Opinion for International Application No. PCT/US2020/033829 dated Aug. 17, 2020.
International Search Report and Written Opinion for International Application No. PCT/US2022/019506 dated Jun. 7, 2022.
International Search Report and Written Opinion for International Application No. PCT/US2023/017839 dated Sep. 6, 2023.
International Search Report and Written Opinion for International Application No. PCT/US2023/077088 dated Mar. 4, 2024.
International Search Report and Written Opinion for International Application No. PCT/US21/15876, dated Apr. 7, 2021.
International Search Report and Written Opinion for International Application No. PCT/US21/15878, dated Jun. 4, 2021.
International Search Report and Written Opinion for International Application No. PCT/US23/17821, dated Jun. 30, 2023.
International Search Report and Written Opinion for International Application No. PCT/US23/17829, dated Aug. 23, 2023.
International Search Report and Written Opinion for International Patent Application No. PCT/US2019/062525 dated Feb. 18, 2020.

(56) References Cited

OTHER PUBLICATIONS

International Search Report and Written Opinion for PCT/US2022/020943, dated Jun. 14, 2022.
Kadoch et al., "Mammalian SWI/SNF chromatin remodeling complexes and cancer: Mechanistic insights gained from human genomics," Sci Adv. 1(5):e1500447 (2015) (17 pages).
Kadoch et al., "Proteomic and bioinformatic analysis of mammalian SWI/SNF complexes identifies extensive roles in human malignancy," Nat Genet. 45(6):592-601 (2013) (11 pages).
Kadoch et al., "Reversible Disruption of mSWI/SNF (BAF) Complexes by the SS18-SSX Oncogenic Fusion in Synovial Sarcoma," Cell 153.1 (2013): 71-85.
Karim et al., "The ETS-domain: a new DNA-binding motif that recognizes a purine-rich core DNA sequence," Genes Dev. 4(9):1451-3 (1990).
Klezovitch et al., "A causal role for ERG in neoplastic transformation of prostate epithelium," Proc Natl Acad Sci U S A. 105(6):2105-10 (2008).
Kumar-Sinha et al., "Recurrent gene fusions in prostate cancer," available in PMC Jul. 16, 2009. Published in final edited form as: Nat Rev Cancer. 8(7):497-511 (2008) (29 pages).
Kunderfranco et al., "ETS transcription factors control transcription of EZH2 and epigenetic silencing of the tumor suppressor gene Nkx3.1 in prostate cancer," PLoS One. 5(5):e10547 (2010) (17 pages).
Lam et al., "A new type of synthetic peptide library for identifying ligand-binding activity," Nature 354(6348):82-84 (1991).
Lam, "Application of combinatorial library methods in cancer research and drug discovery," Anticancer Drug Des. 12(3):145-67 (1997).
Langmead et al., "Fast gapped-read alignment with Bowtie 2," available in PMC Apr. 1, 2013. Published in final edited form as: Nat Methods. 9(4):357-9 (2012) (8 pages).
Link et al., "Targeting the BAF57 SWI/SNF subunit in prostate cancer: a novel platform to control androgenreceptor activity," Cancer Res. 68(12):4551-8 (2008).
Love et al., "Moderated estimation of fold change and dispersion for RNA-seq data with DESeq2," Genome Biol. 15(12):550 (2014) (21 pages).
Lupien et al., "FoxA1 translates epigenetic signatures into enhancer-driven lineage-specific transcription," Cell. 132(6):958-70 (2008).
Machanick et al., "MEME-ChIP: motif analysis of large DNA datasets," Bioinformatics. 27(12):1696-7 (2011).
Mackereth et al., "Diversity in structure and function of the Ets family PNT domains," J Mol Biol. 342(4):1249-64 (2004).
Madura et al., "N-recognin/Ubc2 interactions in the N-end rule pathway," J Biol Chem. 268(16):12046-54 (1993).
McBride et al., "Disruption of mammalian SWI/SNF and polycomb complexes in human sarcomas: mechanisms and therapeutic opportunities," J Pathol. 244(5): 638-649 (Apr. 2018).
Melé et al., "The human transcriptome across tissues and individuals," available in PMC Aug. 24, 2015. Published in final edited form as: Science. 348(6235):660-5 (2015) (12 pages).
Mill et al., "RUNX1-targeted therapy for AML expressing somatic or germline mutation in RUNX1," Blood 134(1):59-73 (Jul. 4, 2019).
Mounir et al., "ERG signaling in prostate cancer is driven through PRMT5-dependent methylation of the Androgen Receptor," Elife. 5:e13964 (2016) (19 pages).
Nagaich et al., "Rapid periodic binding and displacement of the glucocorticoid receptor during chromatin remodeling," Mol Cell. 14(2):163-74 (2004).
Nam et al., "Expression of the TMPRSS2:ERG fusion gene predicts cancer recurrence after surgery for localised prostate cancer," Br J Cancer. 97(12):1690-5 (2007).
Office Action for Chinese Patent Application No. 201980023925.9, dated Apr. 20, 2022.
Ong et al., "A practical recipe for stable isotope labeling by amino acids in cell culture (SILAC)," Nat Protoc. 1(6):2650-60 (2006).
Papillon et al., "Discovery of Orally Active Inhibitors of Brahma Homolog (BRM)/SMARCA2 ATPase Activity for the Treatment of Brahma Related Gene 1 (BRG1)/SMARCA4-Mutant Cancers," J Med Chem. 61(22):10155-72 (Nov. 2018).
Partial Supplementary European Search Report for European Patent Application No. 19887386.1, dated Jul. 20, 2022.
Partial Supplementary European Search Report for European Patent Application No. 20936213.6, dated Feb. 8, 2024.
Paulo et al., "FLI1 is a novel ETS transcription factor involved in gene fusions in prostate cancer," Genes Chromosomes Cancer. 51(3):240-9 (2012).
Petrovics et al., "Frequent overexpression of ETS-related gene-1 (ERG1) in prostate cancer transcriptome," Oncogene. 24(23):3847-52 (2005).
Pomerantz et al., "The androgen receptor cistrome is extensively reprogrammed in human prostate tumorigenesis," available in PMC May 1, 2016. Published in final edited form as: Nat Genet. 47(11):1346-51 (2015) (17 pages).
Prensner et al., "The long noncoding RNA SChLAP1 promotes aggressive prostate cancer and antagonizes the SWI/SNF complex," available in PMC May 1, 2014. Published in final edited form as: Nat Genet. 45(11):1392-8 (2013) (26 pages).
PubChem CID 108452511, "N-[2-Oxo-2-(1,2,4-thiadiazol-5-ylamino)ethyl]benzamide," <https://pubchem.ncbi.nlm.nih.gov/compound/108452511>, created Jan. 15, 2016 (7 pages).
PubChem CID 117640569, "N-[2-[[4-(4-Methoxyphenyl)-1,3-thiazol-2-yl]amino]-2-oxoethyl]-1,3-thiazole-5-carboxamide," https://pubchem.ncbi.nlm.nih.gov/compound/117640569, created Feb. 23, 2016 (9 pages).
PubChem CID 136572628, "4-Chloro-N-[2-(cyclopentylamino)-2-oxoethyl]-5-nitro-1H-pyrazole-3-carboxamide," created Jan. 24, 2019,<https://pubchem.ncbi.nlm.nih.gov/compound/136572628>, (7 pages).
PubChem CID 155037309, "N-[(2S)-1-[[4-[4-ch1oro-6-[(2R,6S)-2,6-dimethylmorpholin-4-yl]pyridin-2-yl]-1 ,3-thiazol-2-yl]a mino ]-3-methoxy-1-oxopropa n-2-yl]-1-methylsulfonylpyrrole-3-carboxa mide," https://pubchem.ncbi.nlm.nih.gov/compound/155037309, created Dec. 19, 2020 (9 pages).
PubChem CID 2955118, "STK174456," <https://pubchem.ncbi.nlm.nih.gov/compound/2955118>, created Jul. 29, 2005 (13 pages).
PubChem CID 49726797, "N-Methyl-N-(2-oxo-2-((4-(pyridin-3-yl)thiazol-2-yl)amino)ethyl)-1H-indole-3-carboxamide," created Nov. 27, 2010,<https://pubchem.ncbi.nlm.nih.gov/compound/49726797>, (8 pages).
PubChem CID 49726798, "N-(2-((4-(Furan-2-yl)thiazol-2-yl)amino)-2-oxoethyl)-N-methyl-1H-indole-3-carboxamide," created Nov. 27, 2010,<https://pubchem.ncbi.nih.gov/compound/49726798> (8 pages).
PubChem CID 56442706, "1-(4-Methoxyphenyl)-N-[2-oxo-2-[4-(1,2,4-triazol-1-yl)anilino]ethyl]pyrazole-3-carboxamide," https://pubchem.ncbi.nlm.nih.gov/compound/56442706, created Jan. 25, 2012 (8 pages).
PubChem CID 7325930, "ZINC04704010," <https://pubchem.ncbi.nlm.nih.gov/compound/7325930>, created Jul. 29, 2006 (11 pages).
PubChem CID 91945707, "N-[2-[(4,5-Dimethyl-1,3-thiazol-2-yl)amino]-2-oxoethyl]-1-methylpyrazole-3-carboxamide," created Oct. 22, 2015,<https://pubchem.ncbi.nlm.nih.gov/compound/91945707>, (8 pages).
PubChem CID 91946137, "N-[2-[(1-Ethylpyrazol-3-yl}amino]-2-oxoethyl]-1-methylpyrazole-3-carboxamide," https://pubchem.ncbi.nlm.nih.gov/compound/91946137, created Oct. 22, 2015 (8 pages).
PubChem CID 970466, "AC1LJ8XT," <https://pubchem.ncbi.nlm.nih.gov/compound/970466>, created Jul. 9, 2005 (11 pages).
PubChem SID 172131678, "BRD-K98538190-001-01-5," https://pubchem.ncbi.nlm.nih.gov/substance/172131678, created Dec. 9, 2014 (8 pages).
Quinlan et al., "BEDTools: a flexible suite of utilities for comparing genomic features," Bioinformatics. 26(6):841-2 (2010).
Rajput et al., "Frequency of the TMPRSS2:ERG gene fusion is increased in moderate to poorly differentiated prostate cancers," J Clin Pathol. 60(11):1238-43 (2007).
Ramos et al., "Current Approaches in the Treatment of Relapsed and Refractory Acute Myeloid Leukemia," J Clin Med. 4(4):665-95 (Apr. 2015).

(56) References Cited

OTHER PUBLICATIONS

Rappsilber et al., "Protocol for micro-purification, enrichment, pre-fractionation and storage of peptides for proteomics using Stage Tips," Nat Protoc. 2(8):1896-906 (2007).
Scott et al., "Searching for peptide ligands with an epitope library," Science. 249(4967):386-390 (1990).
Shen et al., "The SWI/SNF ATPase Brm is a gatekeeper of proliferative control in prostate cancer," Cancer Res. 68(24):10154-62 (Dec. 2008).
Shi et al., "Role of SWI/SNF in acute leukemia maintenance and enhancer-mediated Myc regulation," Genes Dev. 27(24):2648-62 (Dec. 2013).
Siegel et al., "Cancer statistics, 2015," CA Cancer J Clin. 65(1):5-29 (2015).
STN Registry Database, RN 1004932-80-2, entered Feb. 21, 2008 (1 page).
STN Registry Database, RN 1010893-05-6, entered Mar. 30, 2008 (2 pages).
STN Registry Database, RN 1049271-26-2, entered Sep. 14, 2008 (2 pages).
STN Registry Database, RN 1081662-32-9, entered Dec. 8, 2008 (2 pages).
STN Registry Database, RN 1175782-23-6, entered Aug. 26, 2009 (1 page).
STN Registry Database, RN 1209112-42-4, entered Mar. 12, 2010 (2 pages).
STN Registry Database, RN 1246047-75-5, entered Oct. 12, 2010 (2 pages).
STN Registry Database, RN 1308280-67-2, entered Jun. 9, 2011 (2 pages).
STN Registry Database, RN 1315743-98-6, entered Aug. 11, 2011 (1 page).
STN Registry Database, RN 1351682-19-3, entered Dec. 22, 2011 (2 pages).
STN Registry Database, RN 1401558-47-1, entered Oct. 22, 2012 (2 pages).
STN Registry Database, RN 1455783-72-8, entered Oct. 6, 2013 (2 pages).
STN Registry Database, RN 1576383-94-2, entered Mar. 31, 2014 (2 pages).
STN Registry Database, RN 878254-76-3, entered Mar. 28, 2006 (1 page).
Vaswani et al., U.S. Appl. No. 18/281,022 titled "Crystalline Forms, Compositions Containing Same, and Methods of Their Use", filed Sep. 8, 2023.
Vaswani et al., U.S. Appl. No. 18/373,518 titled "Compounds and Uses Thereof", filed Sep. 27, 2023.

* cited by examiner

FIG. 4G

SWI/SNF subunits across evolution

| *S. cererivisiae* | *D. melanogaster* | *H. sapiens* |
|---|---|---|
| SWI3 | mor | SMARCC1/SMARCC2 |
| SNF12 | Bap60 | SMARCD1/SMARCD2/SMARCD3 |
| SNF5 | Snr1 | SMARCB1 |
| - | Bap111 | SMARCE1 |
| SWI1 | OSA | ARID1A/ARID1B |
| - | d4 | DPF1/DPF2/DPF3 |
| SNF2 | Brahma | SMARCA2/SMARCA4 |
| ARP7/ARP9 | Bap55 | ACTL6A |
| - | ACT2 | ACTB |
| - | BCL7-like | BCL7A/BCL7B/BCL7C |
| - | CG10555 | SS18/SS18L1 |
| SNF6 | - | - |
| SWP82 | - | - |
| RTT102 | - | - |
| TAF14 | - | - |
| SNF11 | - | - |
| SNF12 | - | - |

CX-MS crosslinks within BAF core module

CX-MS crosslinks between BAF core module and ARID1/DPF2

Interactions of ARID subunits with other BAF subunits

CX-MS crosslinks between ARID1A and initial BAF core subunits

Schematic of mSWI/SNF complex assembly branching initiated by ARID subunits

C-SMARCC1/C2
D-SMARCD1/D2/D3
B-SMARCB1
E-SMARCE1
ARID1-ARID1A/B
DPF-DPF1/2/3
PH10-PHF10
BR7-BRD7
G1-GLTSCR1/1L
BR9-BRD9

CX-MS crosslinks between DPF2 and other BAF subunits

FIG. 8I

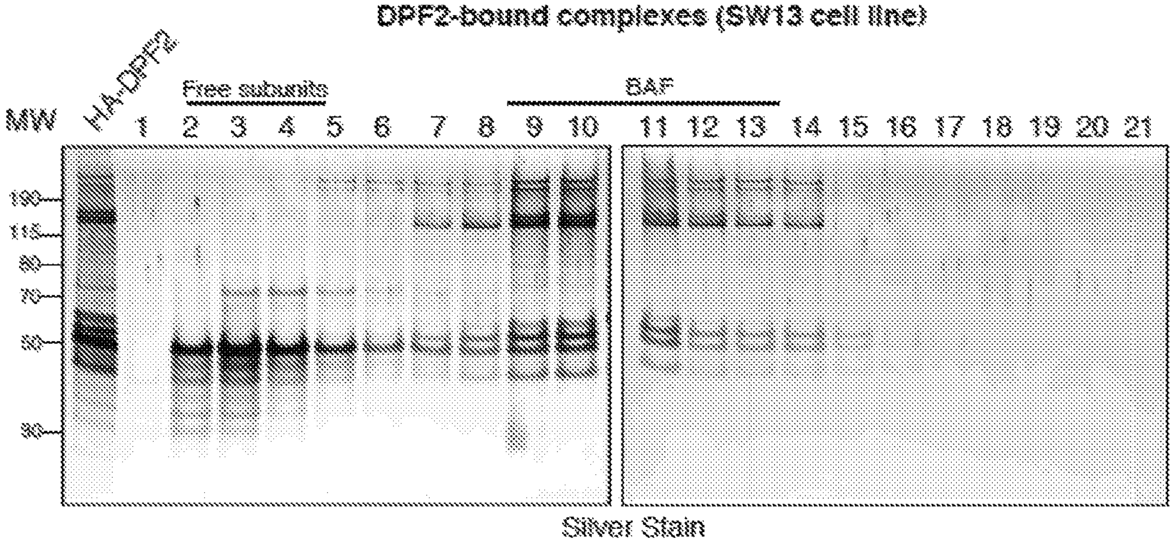

FIG. 8J

MS analysis of DPF2 complexes from SW13 cell line (fractions 9-14)

| | Gene Symbol | Unique peptides | Total peptides |
|---|---|---|---|
| | ARID1A | 63 | 125 |
| | ARID1B | 45 | 93 |
| | SMARCC1 | 43 | 105 |
| | SMARCC2 | 33 | 61 |
| | SMARCE1 | 24 | 61 |
| | SMARCD1 | 22 | 29 |
| | DPF2 | 20 | 61 |
| | SMARCD2 | 17 | 29 |
| | SMARCB1 | 14 | 28 |
| | SMARCD3 | 14 | 19 |
| | ARID2 | 6 | 7 |
| | BRD7 | 2 | 3 |
| ATPase components | SMARCA4 | 0 | 0 |
| ATPase components | SMARCA2 | 0 | 0 |
| ATPase components | ACTL6A | 0 | 0 |
| ATPase components | BCL7A | 0 | 0 |
| ATPase components | BCL7B | 0 | 0 |
| ATPase components | BCL7C | 0 | 0 |
| ATPase components | SS18 | 0 | 0 |
| ATPase components | SS18L1 | 0 | 0 |
| ATPase components | ACTB | 3 | 3 |

Network analysis of BAF complex subunits based on gradient MS

| Gene | Mutation | Recurrence | Domain/region |
|---|---|---|---|
| SMARCA4 | R1192H/C | 16 | Helicase Cterm |
| ARID1A | G2087V/R/E | 10 | CBRB |
| ARID2 | S297F | 9 | CBR |
| SMARCA4 | T910M | 8 | Helicase ATP |
| PBRM1 | R876C/H/L/S | 8 | Region 6 |
| SMARCA4 | R885C/L | 7 | Helicase ATP |
| ARID2 | R314C | 7 | CBR |
| SMARCA4 | G1232S/V | 7 | Helicase Cterm |
| ARID2 | R285Q/W | 6 | CBR |
| SMARCA4 | R1243W/Q | 6 | Helicase Cterm |
| SMARCB1 | R374W/Q | 6 | Coiled Coil |
| SMARCB1 | R377H/C | 6 | Coiled Coil |
| SMARCA4 | A1186V/G/T | 6 | Helicase Cterm |
| SMARCA2 | R384W/Q | 6 | Region 2 |

SWI/SNF FAMILY CHROMATIN REMODELING COMPLEXES AND USES THEREOF

CROSS-REFERENCE TO RELATED APPLICATION

This application is the U.S. national phase of International Patent Application No. PCT/US2019/056365, filed on Oct. 15, 2019, which claims the benefit of priority to U.S. Provisional Application Ser. No. 62/746,956, filed on Oct. 17, 2018, the entire contents of each of said applications are incorporated herein in their entirety by this reference.

STATEMENT OF RIGHTS

This invention was made with government support under grant numbers 1DP2CA195762-01, RO1 GM110064, and P50 GM076547 awarded by The National Institutes of Health. The U.S. government has certain rights in the invention.

LARGE FILES

The instant application includes the complete contents of the accompanying 12 lengthy tables, all of which are ASCII text files, as follows: Table 7A, submitted herewith as "Table 7A DPF2 Inter Crosslinks.txt", created Oct. 16, 2018 and 519,369 bytes in size; Table 7B, submitted herewith as "Table 7B DPF2 Intra Crosslinks.txt", created Oct. 16, 2018 and 754,625 bytes in size; Table 7C, submitted herewith as "Table 7C SS18 Inter Crosslinks.txt", created Oct. 16, 2018 and 69,459 bytes in size; Table 7D, submitted herewith as "Table 7D SS18 Intra Crosslinks", created Oct. 16, 2018 and 180,194 bytes in size; Table 9A, submitted herewith as "Table 9A S2 BAP60-HA Inter Crosslinks.txt", created Oct. 16, 2018 and 63,413 bytes in size; Table 9B, submitted herewith as "Table 9B S2 BAP60-HA Intra Crosslinks.txt", created Oct. 16, 2018 and 129,801 bytes in size; Table 9C, submitted herewith as "Table 9C S2 HA-D4 Inter Crosslinks.txt", created Oct. 16, 2018 and 33,871 bytes in size; Table 9D, submitted herewith as "Table 9D S2 HA-D4 Intra Crosslinks.txt", created Oct. 16, 2018 and 120,094 bytes in size; Table 10A, submitted herewith as "Table 10A HEK-293T BRD7 Inter Crosslinks.txt", created Oct. 16, 2018 and 69,226 bytes in size; Table 10B, submitted herewith as "Table 10B HEK-293T BRD7 Intra Crosslinks.txt" created Oct. 16, 2018 and 226,791 bytes in size; Table 10C, submitted herewith as "Table 10C HEK-293T PHF10 Inter Crosslinks.txt" created Oct. 16, 2018 and 61,991 bytes in size; Table 10D, submitted herewith as "Table 10D HEK-293T PHF10 Intra Crosslinks.txt" created Oct. 16, 2018 and 201,558 bytes in size. All of these 12 tables are hereby incorporated by reference in their entireties.

BACKGROUND OF THE INVENTION

ATP-dependent chromatin remodeling complexes are multimeric molecular assemblies which use the energy of ATP hydrolysis to regulate chromatin architecture (Wu et al. (2009) *Cell* 136:200-206; Kadoch and Crabtree (2015) *Sci Adv* 1: e1500447; Masliah-Planchon et al. (2015) *Annu Rev Pathol* 10:145-171). These complexes are grouped into four major families, including SWI/SNF (switching (SWI) and sucrose fermentation (Sucrose Non Fermenting-SNF)), INO80 (Conaway and Conaway (2009) *Trends Biochem Sci* 34:71-77), ISWI (imitation SWI) (Bartholomew et al. (2014) *Curr Opin Struct Biol* 24:150-155), and CHD/M-2 (Chromodomain helicase DNA-binding) groups (Murawska et al. (2011) *Transcription* 2:244-253), all of which contain Snf2-like ATPase subunits, but differ substantially via the incorporation of distinct subunits and in their differential targeting and activity on nucleosomes (Dann et al. (2017) *Nature* 548:607-611; Clapier et al. (2017) *Nat Rev Mol Cell Biol* 18:407-422).

SWI/SNF complexes were originally discovered in yeast in screens for mating-type switching and sucrose fermentation (Winston et al. (1992) *Trends Genet* 8:387-391). These complexes were later characterized in Drosophila (Celenza et al. (2018) *Mol Cell Biol* 4:49-53; Dingwall et al. (1995) *Mol Biol Cell* 6:777-791) and more recently, in mammals (Ho et al. (2009) *Proc Natl Acad Sci USA* 106:5181-5186; Kadoch et al. (2013) *Nature genetics* 45:592-601). Over the course of evolution, these complexes have gained, lost, and shuffled subunits owing likely to the advent of multicellularity and genome duplication (Dehal et al. (2005) *PLOS* Biol 3: e314). In metazoans, SWI/SNF proteins belong to the trithorax group of transcriptional activators which oppose function of repressive polycomb group protein complexes through direct action on polycomb bodies and chromatin remodeling at both enhancer and promoter regions (Poynter et al. (2016) *Wiley Interdiscip Rev Dev Biol* 5:659-688). Mammalian SWI/SNF complexes are ~1-1.5-MDa entities combinatorically assembled from the products of 29 genes, producing two known assemblies termed BAF (BRM/SWI2-Related Gene 1 (BRG1)-associated factors) and PBAF (PBRM1-associated BAF) (Hodges et al. (2016) *Cold Spring Harb Perspect Med* 6: doi: 10.1101). Combinatorial diversity is generated by the presence of multiple paralogs for several subunit positions which assemble into complexes in a mutually exclusive manner (Helming et al. (2014) *Nat Med* 20:251-254; Hoffman et al. (2014) *Proc Natl Acad Sci USA* 111:3128-3133). All complexes bear an ATPase subunit, either SMARCA4 (BRG1) or SMARCA2 (BRM) (homolog of the Drosophila protein, Brahma), which catalyzes the hydrolysis of ATP. The role for most other accessory subunits in complex assembly and stability as well as targeting and function remains unknown.

Over the past several years, mammalian SWI/SNF (mSWI/SNF) complexes have become a major focus of attention owing to the striking frequency of mutations in the genes encoding their subunits across a range of human diseases, from cancer to neurologic disease. Indeed, recent exome sequencing efforts in human cancer have revealed that over 20% of human cancers bear mutations in the genes encoding mSWI/SNF subunits (Kadoch et al. (2013) *Nature genetics* 45:592-601; Lawrence et al. (2014) *Nature* 505: 495-501). Moreover, heterozygous point mutations in mSWI/SNF genes have been implicated as causative events in intellectual disability and autism-spectrum disorders (Lopez and Wood (2015) *Front Behav Neurosci* 9:100; Vissers et al. (2016) *Nat Rev Genet* 17:9-18; Bogershausen et al. (2018) *Front Mol Neurosci* 11:252).

A major hindrance in the understanding of the functions, tissue-specific roles, and the impact of mutations on mSWI/SNF complex mechanisms lies in the lack of information regarding subunit organization and 3D structure. Several important factors underpin the challenges in obtaining high-resolution structures of these large chromatin remodelers, particularly, mammalian SWI/SNF complexes. First, individually expressed subunits are often unstable or incorrectly folded without their binding partners. Second, minimal complexes pieced together via in vitro co-expression may not represent endogenous, physiologically relevant complexes in cells. Third, large quantities of purified endogenous complexes with minimal heterogeneity are required for downstream analyses and selection of appropriate purification strategies cannot be informed without understanding modular architecture and assembly order. For these reasons and others, only low resolution maps have been achieved using cryo-EM approaches (Leschziner et al. (2007) *Proc Natl Acad Sci USA* 104: 4913-4918; Dechassa et al. (2008) *Mol Cell Biol* 28: 6010-6021) and X-ray crystallographic analyses have been successfully performed on only a few isolated domains (Kim et al. (2004) *J Biol Chem* 279:16670-16676; Yan et al. (2017) *J Mol Biol* 429:1650-1660), including the recently-reported yeast Snf2 ATPase domain (Liu et al. (2017) *Nature* 544:440-445; Xia et al. (2016) *Nat Struct Mol Biol* 23:722-729).

Accordingly, there remains a great need in the art to elucidate the architecture and assembly pathway for different classes of mSWI/SNF complexes in order to better understand their structure, function and the consequences of human disease-associated mutations.

SUMMARY OF THE INVENTION

The present invention is based, at least in part, on the elucidation of the architecture and assembly pathway of three different classes of mammalian SWI/SNF complexes, BAF, PBAF, and ncBAF, and the understanding of the requirement of each subunit for complex formation and stability.

The present invention is also based, at least in part, on the studies that, in order to establish a comprehensive structural framework for mSWI/SNF complexes, a multifaceted series of approaches were used, notably those involving complex and subcomplex purification, mass-spectrometry (MS), cross-linking mass-spectrometry (CX-MS), systematic genetic manipulation of subunits and subunit paralog families, evolutionary analyses, and human disease genetics. These studies reveal that mSWI/SNF complexes exist in three non-redundant final form assemblies: BAF, PBAF, and a recently-defined non canonical BAF (ncBAF) for which the assembly requirements and modular organization are established and presented herein. It is defined in these studies the full spectrum of endogenous combinatorial possibilities and the impact of individual subunit deletions and mutations, including recurrent, previously uncharacterized missense and nonsense mutations, on complex architecture. These studies provide important insights into mSWI/SNF complex organization and structure, function and the biochemical consequences of a wide range of human disease-associated mutations.

In one aspect, an isolated modified protein complex selected from the group consisting of protein complexes listed in Table 2 and/or Table 3, wherein the isolated modified protein complex comprises at least one subunit that is modified, is provided.

Numerous embodiments are further provided that can be applied to any aspect of the present invention and/or combined with any other embodiment described herein. For example, in one embodiment, the isolated modified protein complex selected from the group consisting of protein complexes listed in Table 3, comprises a fragment of the subunit. In another embodiment, the fragment of the subunit binds to at least one binding partner of the subunit to form the isolated modified protein complex. In still another embodiment, the fragment of the subunit comprises at least one interacting domain of the subunit listed in Table 4. In yet another embodiment, the fragment of the subunit comprises all interacting domains of the subunit listed in Table 4. In another embodiment, the fragment of the subunit is the ARID1A C-terminus having a sequence of SEQ ID NO: 39. In another embodiment, the fragment of the subunit is a mini version of ARID2 (mARID2) having a sequence of SEQ ID NO: 40. In still another embodiment, the isolated modified protein complex comprises at least one subunit linked to at least another subunit. In yet another embodiment, at least one subunit is linked to at least another subunit through covalent cross-links. In another embodiment, at least one subunit is linked to at least another subunit through a peptide linker. In another embodiment, at least one subunit comprises a heterologous amino acid sequence. In still another embodiment, the heterologous amino acid sequence comprises an affinity tag or a label. In yet another embodiment, the affinity tag is selected from the group consisting of Glutathione-S-Transferase (GST), calmodulin binding protein (CBP), protein C tag, Myc tag, HaloTag, HA tag, Flag tag, His tag, biotin tag, and V5 tag. In another embodiment, the label is a fluorescent protein. In another embodiment, the isolated modified protein complex comprises at least one subunit is selected from the group consisting of HA-SMARCD1, HA-SS18, HA-DPF2, Flag-HA-SS18, HA-SMARCC1, HA-SMARCE1, HA-ARID1A C-terminus, HA-SMARCA4, D2-HA, BAP60-HA, HA-SMARCB1, HA-SMARCD2, HA-SMARCA4, HA-BCL7A, HA-BRD7, HA-PHF10, GFP-PBRM1, and V5-PBRM1. In still another embodiment, the isolated modified protein complex is in a pharmaceutical composition, further comprising a carrier.

In another aspect, a process of preparing any one of the isolated modified protein complexes described above is provided. In one embodiment, the process comprises (a) expressing a modified subunit of the modified protein complex, in a host cell or organism; and (b) isolating the modified protein complex comprising the modified subunit. In another embodiment, the process comprises expressing and isolating the modified protein complex, wherein the modified subunit is a fragment thereof. In another embodiment, the process comprises expressing and isolating the modified protein complex, wherein the fragment of the subunit binds to at least one binding partner of the subunit to form the isolated modified protein complex. In still another embodiment, the process comprises expressing and isolating the modified protein complex, wherein the modified subunit comprises a heterologous amino acid sequence. In yet another embodiment, the process comprises expressing and isolating the modified protein complex, wherein the heterologous amino acid sequence comprises an affinity tag or a label. In another embodiment, the process comprises expressing and isolating the modified protein complex, wherein the affinity tag comprises two different tags which allow two separate affinity purification steps. In another embodiment, the process comprises expressing and isolating the modified protein complex, wherein the two tags are separated by a cleavage site for a protease. In still another embodiment, the process comprises expressing and isolating the modified protein complex, wherein the affinity tag is selected from the group consisting of Glutathione-S-Transferase (GST), calmodulin binding protein (CBP), protein C tag, Myc tag, HaloTag, HA tag, Flag tag, His tag, biotin tag, and V5 tag. In yet another embodiment, the process comprises expressing and isolating the modified protein complex, wherein the label is a fluorescent protein. In another embodiment, the process comprises expressing and isolating the modified protein complex, wherein the modified subunit is selected from the group consisting of HA-SMARCD1, HA-SS18, HA-DPF2, Flag-HA-SS18, HA-SMARCC1, HA-SMARCE1, HA-ARID1A C-terminus, HA-SMARCA4, D2-HA, BAP60-HA, HA-SMARCB1, HA-SMARCD2, HA-SMARCA4, HA-BCL7A, HA-BRD7, HA-PHF10, GFP-PBRM1, and V5-PBRM1. In another embodiment, the process comprises expressing and isolating the modified protein complex, wherein the isolating step comprises density sedimentation analysis.

In another aspect, a method for screening for an agent that modulates the formation or stability of any one of the isolated modified protein complexes described above is provided. In one embodiment, the method comprises (a) contacting the modified protein complex, or a host cell or organism expressing the modified protein complex to a test agent, and (b) determining the amount of the modified protein complex in the presence of the test agent, wherein a difference in the amount of the protein complex determined in step (b) relative to the amount of the protein complex determined in the absence of the test agent indicates that the test agent modulates the formation or stability of the protein complex. In another embodiment, the method further comprises incubating subunits of the isolated modified protein complex in the presence of a compound under conditions conducive to form the modified protein complex prior to step (a). In another embodiment, the method further comprises determining the presence and/or amount of the individual subunits in the isolated modified protein complex. In still another embodiment, the method comprises the step of contacting the modified protein complex, or a host cell or organism expressing the modified protein complex to a test agent, wherein the step of contacting occurs in vivo, ex vivo, or in vitro. In yet another embodiment, the method comprises at least one subunit of the isolated modified protein complex that is a mutant form that is identified in a human disease. In another embodiment, the method comprises an agent that inhibits formation or stability of the isolated modified protein complex. In another embodiment, the method comprises an agent inhibits the formation or stability of the isolated modified protein complex by inhibiting the interaction between at least one interacting domain pair listed in Table 4. In still another embodiment, the agent is a small molecule inhibitor, a small molecule degrader, CRISPR guide RNA (gRNA), RNA interfering agent, oligonucleotide, peptide or peptidomimetic inhibitor, aptamer, antibody, or intrabody. In yet another embodiment, the RNA interfering agent is a small interfering RNA (siRNA), CRISPR RNA (crRNA), CRISPR guide RNA (gRNA), a small hairpin RNA (shRNA), a microRNA (miRNA), or a piwi-interacting RNA (piRNA). In another embodiment, the agent comprises an antibody and/or intrabody, or an antigen binding fragment thereof, which specifically binds to at least one subunit of the isolated modified protein complex. In another embodiment, the antibody and/or intrabody, or antigen binding fragment thereof, is chimeric, humanized, composite, or human. In another embodiment, the antibody and/or intrabody, or antigen binding fragment thereof, comprises an effector domain, comprises an Fc domain, and/or is selected from the group consisting of Fv, Fav, F(ab')2, Fab', dsFv, scFv, sc(Fv)2, and diabodies fragments. In still another embodiment, the agent enhances the formation or stability of the isolated modified protein complex. In yet another embodiment, the agent enhances the formation or stability of the protein complex by stabilizing the interaction between at least one interacting domain pair listed in Table 4. In another embodiment, the agent is a small molecule compound. In another embodiment, the agent is used for inhibiting or stabilizing the isolated modified protein complex. In still another embodiment, the agent is used for modulating the ratio of the isolated modified protein complex to at least one of the fully assembled protein complexes listed in Table 2 and/or Table 3. In yet another embodiment, the agent is used for modulating the amount of at least one of the fully assembled protein complexes listed in Table 2. In another embodiment, the agent is administered in a pharmaceutically acceptable formulation.

In another aspect, a method for screening for an agent that binds to any one of the isolated modified protein complexes described above is provided. In one embodiment, the method comprises (a) contacting the modified protein complex, or a host cell or organism expressing the modified protein complex to a test agent; and (b) determining whether the test agent is bound to the modified protein complex. In another embodiment, the step of contacting the modified protein complex, or a host cell or organism expressing the modified protein complex to a test agent occurs in vivo, ex vivo, or in vitro. In another embodiment, the agent is administered in a pharmaceutically acceptable formulation.

In one embodiment, any one of the process or methods described above comprises the host cell that is a mammalian cell. In another embodiment, any one of the process or methods described above comprises the host cell that is a human cell. In another embodiment, any one of the process or methods described above comprises the host cell that is a *D. melanogaster* S2 cell. In another embodiment, any one of the process or methods described above comprises the host cell that is a yeast cell.

In another aspect, a device or kit comprising, in one or more containers, at least one isolated modified complex described above is provided. In one embodiment, the device or kit optionally comprises a substrate of the isolated modified complex, an antibody that binds to the isolated modified complex, buffers and/or working instructions. In another embodiment, the device or kit is for processing a substrate of the isolated modified complex. In another embodiment, the substrate is a DNA. In still another embodiment, the kit is for testing a compound. In still another embodiment, the kit is for detecting the isolated modified protein complex. In yet another embodiment, the kit is for diagnosis or prognosis of a disease or a disease risk.

In another aspect, it is provided herein an array in which at least one of the isolated modified protein complex described above is attached to a solid carrier. In one embodiment, the array is a microarray.

In another aspect, it is provided herein a process for modifying a substrate of any one of the isolated modified complexes described above, comprising the step of bringing into contact the isolated modified complex with the substrate, such that the substrate is modified.

As described above, numerous embodiments are further provided that can be applied to any aspect of the present invention and/or combined with any other embodiment described herein. Furthermore, it is provided herein that any one of the process or methods described above comprises compositions, agents or cells that may be useful for treating human diseases, such as cancer, lung cancer, gastric cancer, non-small cell lung cancer (NSCLC), malignant rhabdoid tumors, renal carcinoma, pancreatic cancer, hepatocellular carcinoma, sarcoma, synovial cell sarcoma, neutrophil-specific granule deficiency (SGD), multiple endocrine neoplasia type I, an inherited cancer syndrome involving multiple parathyroid, enteropancreatic, and pituitary tumors, and developmental and neurologic diseases including intellectual disability syndrome and autism-spectrum disorders, such as Coffin-Siris syndrome.

BRIEF DESCRIPTION OF THE DRAWINGS

FIG. 1A shows the density sedimentation analysis and immunoblot performed on HEK-293T nuclear extracts. * indicates non-specific band. FIG. 1B shows silver stain performed on density sedimentation of HA-SMARCD1 mSWI/SNF complexes purified from HEK-293T cells. FIG. 1C shows silver stain performed on density sedimentation of HA-DPF2 BAF complexes purified from HEK-293T cells. FIG. 1D shows silver staining of the indicated HA-SMARCD1 gradient fractions from FIG. 1B. Identified proteins are labeled. FIG. 1E shows mass-spectrometry analysis performed on selected fractions (fractions 3-18) collected from the HA-SMARCD1 density gradient in FIG. 1B. Peptide proportion (0 to 1) represents the fraction of maximum number of peptides captured for each subunit over the full gradient. Total spectral counts for each subunit are indicated on the left. Colors distinguish mSWI/SNF complexes and modules.

FIG. 2A shows the schematic of mSWI/SNF complex purification and analyses. FIG. 2B shows the silver stain analysis of HA bead-bound proteins. HA Dynabeads were incubated with either EB300 (control) or with nuclear extracts from indicated cells, washed, eluted, loaded onto SDS-PAGE and analyzed using silver staining. FIG. 2C shows the silver stain analysis of BAF complexes purified using DPF2-HA or HA-SMARCD1 as baits. FIG. 2D shows the heat map clustering of mass-spectrometry-determined peptide abundance on selected fractions collected from HA-DPF2-purified BAF complexes from FIG. 1C. FIG. 2E shows the silver staining of fraction 14 from the HA-DPF2 gradient from FIG. 1C. Identified proteins are labeled. FIG. 2F shows the heat map clustering of mass-spectrometry-determined peptide abundance across fractions collected from HA-SMARCD1 density gradient in FIG. 1B. Color scale reflects z-scores.

FIG. 3A shows the matrix heatmap of the total crosslinks identified in combined HA-SS18 and HA-DPF2 BAF complex CX-MS. Individual subunits are divided into domains and ordered according to modules in FIG. 3B. See also FIGS. 4B, 4J, 4K. FIG. 3B-3D shows the Louvain modularity analysis performed on (FIG. 3B) mammalian cBAF complex CX-MS datasets, (FIG. 3C) *D. melanogaster* D4 and BAP60 CX-MS datasets, and (FIG. 3D) *S. cerevisiae* CX-MS datasets (from Sen et al. (2017) *Cell Rep* 18:2135-2147). FIG. 3E shows the correlations between mammalian/Drosophila BAF/BAP subunit domain and region interactions from CX-MS datasets. See also FIGS. 4B, 4J. FIG. 3F shows the correlations between mammalian and yeast BAF/SWI/SNF subunit domain and region interactions from CX-MS datasets. See also FIGS. 4B, 4 K.

FIG. 4A shows the silver stains of affinity-purified complexes from mammalian HEK-293T cells expressing Flag-HA-SS18 or HA-DPF2. FIG. 4G shows the SWI/SNF subunit orthologs in *S. cerevisiae, D. melanogaster* and *H. sapiens*. FIG. 4N shows the correlation analysis between *D. melanogaster* BAP and *S. cerevisiae* SWI/SNF subunit domain and region interactions from CX-MS datasets.

FIG. 5A shows the circle-plot analysis of the mammalian BAF complex CX-MS dataset, with BAF core module highlighted in blue. FIG. 5B shows the silver stain performed on density sedimentation of HA-SMARCC1 complexes purified from HEK-293T cells (left), and the clustered heatmap of mass spec-called peptides and spectral counts on selected fractions (right). FIG. 5C shows the distribution of inter-paralog and self-crosslinks crosslinks in BAF CX-MS dataset. FIG. 5D shows the SMARCC self crosslinks and SMARCC1/SMARCC2 inter-paralog crosslinks from the BAF CX-MS dataset. Line width is proportional to the number of crosslinks. FIG. 5E shows the heatmap depicting SMARCC crosslinks with BAF subunits from BAF CX-MS dataset. FIG. 5F shows the silver stain performed on density sedimentation of HA-SMARCE1 complexes purified from ΔSMARCD HEK-293T cells (left), and the clustered heatmap of mass spec-called peptides and spectral counts on selected fractions (right). FIG. 5G shows the silver stain performed on density sedimentation of HA-SMARCD1 complexes purified from ΔSMARCE1 HEK-293T cells (left) and the clustered heatmap of mass spec-called peptides and spectral counts on selected fractions (right). The "*" symbol indicates that minimal SMARCE1 peptide abundance was detected despite no observed band (See Table 6, such as Table 6H). FIG. 5H shows the schematic representation of initial steps of BAF core assembly. Subunits abbreviations are indicated.

FIG. 6A shows the SDS-PAGE blot. Native HA-SMARCB1 BAF complexes purified from WT HEK-293T cells and subjected to glycerol gradient centrifugation; collected fractions were SDS-PAGE separated and silver stained. FIG. 6Q shows that samples from SMARCD1 gradient in FIG. 5G were PAGE-separated and silver stained (short development time).

FIG. 7A shows the circle-plot analysis of the mammalian CX-MS dataset with BAF core subunit crosslinks in blue and ARID module subunits in teal. FIG. 7B shows the clustered heatmap of CX-MS data, highlighting crosslinks between ARID subunits and other complex components. FIG. 7C shows the schematic representation of ARID1A/SMARCC1/SMARCD1 crosslinks from BAF CX-MS dataset. Line width is proportional to the number of crosslinks. FIG. 7H shows the schematic representation of mSWI/SNF assembly branch points initiated by ARID subunits. Subunits abbreviations are indicated.

FIG. 8A-FIG. 8K show the identification and analysis of the ARID1/DPF module of mSWI/SNF complexes. FIG. 8A shows the alignment and conservation analysis of the ARID1 orthologs and identification of the conserved CBR A and CRB B bridging regions. FIG. 8B shows the crosslinks from orthologous BAF core/ARID subcomplexes from *S. cerevisiae* and *D. melanogaster* CX-MS datasets. Line width is proportional to the number of crosslinks. Black links in *S. cerevisiae* schematic represents crosslinks between SWI3 and SWI1. FIG. 8C shows the SDS-PAGE blot. Native HA-DPF2 BAF complexes were purified from ΔSMARCB1 cells and were subjected to glycerol gradient centrifugation. Collected fractions were PAGE-separated and silver stained. FIG. 8D shows the SDS-PAGE blot. Native HA-DPF2 BAF complexes were purified from ΔSMARCEL cells and were subjected to glycerol gradient centrifugation. Collected fractions were PAGE-separated and silver stained. FIG. 8E shows the SDS-PAGE blot. Native HA-SMARCD1 complexes were purified from MIA-Pa-Ca 2 cells (ARID1A/B-dual deficient) and WT HEK-293T cells, PAGE-separated and silver stained. FIG. 8F shows the western blot analysis of the total cell lysates (TCL) from HEK-293T and MIA-Pa-Ca 2 cells with indicated antibodies. FIG. 8G shows that the HA-DPF2 BAF complexes were purified from MIA-Pa-Ca2 cells and subjected to glycerol gradient centrifugation. Eluted proteins were PAGE-separated and silver stained. FIG. 8H shows the circle-plot analysis of the mammalian CX-MS dataset. DPF2 subunits crosslinks to other BAF subunits are indicated. DPF2/BAF core is in teal, DPF2/ARID crosslinks subunits are in green and DPF2/ATPase is in yellow. Data from paralogous subunits were combined. FIG. 8I shows the SDS-PAGE blot. Native HA-DPF2 BAF complexes were purified from SW13 (SMARCA4/SMARCA2-dual deficient) cells and were subjected to glycerol gradient centrifugation. Collected fractions were separated by SDS-PAGE and silver stained. FIG. 8J shows the MS analysis of the total elution from HA-DPF2 purifications from ATPase-negative SW13 cells. FIG. 8K shows the SDS-PAGE blot. Nuclear extracts from WT or ARID subunit KO HEK-293T cell lines were subjected to immunoprecipitation with indicated antibodies. Eluted samples were PAGE separated and immunoblotted with indicated antibodies.

FIG. 9A shows the circle-plot analysis of the mammalian CX-MS dataset with ATPase module subunits crosslinks in red, and ATPase/ARID module crosslinks in yellow. FIG. 9B shows the clustered heatmap of the CX-MS analysis of mammalian BAF complex highlighting the occurrence of crosslinks between SMARCA and other complex components. FIG. 9C shows the silver stain performed on density sedimentation of HA-SMARCA4-bound complexes purified from HEK-293T cells. FIG. 9D shows the gradient mass spectrometry of selected fractions collected from the HA-SMARCA4 density gradient. Total spectral counts for each subunit are indicated on the left. FIG. 9E shows the silver stain performed on density sedimentation analysis of Flag-HA-SS18-bound BAF complexes purified from HEK-293T cells (left). Clustered heatmap of mass spec-called peptides and spectral counts on selected fractions are shown (right). FIG. 9F shows the clustered correlation heatmap of HA-SMARCD1, HA-SMARCB1 and HA-SMARCA4 density gradient MS results from WT HEK-293T cells. Experimentally determined complexes and subcomplexes are indicated. FIG. 9G shows the schematic of the assembly and incorporation of the BAF ATPase module. Subunit abbreviations are indicated.

FIG. 10A shows the circle-plot analysis of the mammalian CX-MS dataset. ATPase/core module subunits crosslinks are in blue, ATPase/ARID module crosslinks are in yellow, and core/ARID module subunits are in green. Data from paralogous subunits was combined. FIG. 10B shows the schematic representation of crosslinks from orthologous ATPase subcomplexes from *H. sapiens, D. melanogaster* and *S. cerevisiae* CX-MS datasets. Line width is proportional to the number of crosslinks. Black lines represent crosslinks between actin-like proteins. FIG. 10C shows the clustered heatmap of mass spec analysis performed on spectral counts from each fraction collected from HA-SMARCA4 density gradient from WT 293T cells. Colors represent Z-scores, according to legend. FIG. 10D shows the IRDye 680RD detection of fractions from HA-SS18 density gradient from purification in FIG. 9E. FIG. 10E shows the clustering heatmap of HA-SS18 density gradient IRDye 680RD quantification. Colors represent Z-scores according to legend. FIG. 10F shows the IRDye 680RD detection performed on Fractions 8, 10 and 13 from FIG. 9D. Identified proteins are labeled. FIG. 10G shows the SDS-PAGE blot. HA-BCL7A BAF complexes were purified from WT HEK-293T cells and were subjected to glycerol gradient centrifugation. Collected fractions were SDS-PAGE separated and silver stained (left). Clustered heatmap and spectral counts of the mass spec analysis performed on selected pulled fractions are shown (right). FIG. 10H shows the Louvain modularity analysis performed on mass-spec analyses from glycerol gradients collected from SMARCD1, SMARCB1 and SMARCA4 purifications. Colors are generated as a function of the relations between the nodes (subunits) of the generated network. FIG. 10I shows the SDS-PAGE blot. Nuclear extracts from WT or core BAF subunit KO cell lines were subjected to immunoprecipitation with indicated antibodies. Eluted samples were SDS-PAGE separated and immunoblotted with indicated antibodies.

FIG. 11A shows that HA-BRD7 was used as a bait for purification of PBAF complexes for CX-MS (Left), and the heat map reflecting distributions of total crosslinks from mammalian PBAF complex CX-MS (Right). Individual subunits are divided into domains and ordered according to FIG. 12C. FIG. 11B shows the correlation analysis of the total subunit crosslinks from CX-MS obtained from PHF10 and BRD7 datasets. FIG. 11C shows the SDS-PAGE. Native HA-BRD7 PBAF complexes were purified from WT HEK-293T cells and were subjected to glycerol gradient centrifugation, collected fractions were PAGE separated and silver stained. FIG. 11D shows the SDS-PAGE. Native HA-PHF10 PBAF complexes were purified from WT HEK-293T cells and were subjected to glycerol gradient centrifugation, collected fractions were PAGE separated and silver stained. FIG. 11E shows the immunoblot/co-IP analysis performed on PBAF subunit KO HEK-293T cells. Antibodies used for detection are indicated. FIG. 11F shows the distribution of self-crosslinks and inter-paralog crosslinks in PBAF complex CX-MS dataset. Redundant crosslinks were removed. FIG. 11G shows that HEK-293T cells were stably infected with GFP-PBRM1 or empty vector and used for co-IP/immunoblot analyses. Antibodies used for detection are indicated. FIG. 11H shows that HEK-293T cells were infected with WT V5-PBRM1, V5-PBRM1ΔBAH1 mutant variant or empty vector and used for WB-co-IP analysis. Antibodies used for detection are as indicated. FIG. 11I shows the WB-co-IP analysis performed on WT and ncBAF subunit KO cells. Antibodies used for detection are indicated. * indicates the non-specific band above BRD9 band in the input. FIG. 11J shows the total combinatorial possibilities across mSWI/SNF complex families (including tissue-specific subunits).

FIG. 12A shows the silver stain performed on density sedimentation of HA-mARID2 PBAF complexes purified from HEK-293T cells (left), and the clustered heatmap of mass spec-called peptides and spectral counts on selected fractions (right). FIG. 12B shows the silver stain performed on density sedimentation of HA-PBRM1 PBAF complexes purified from HEK-293T cells (left), and the clustered heatmap of mass spec-called peptides and spectral counts on selected fractions (right). FIG. 12C shows the Louvian network analysis of PBAF subunit (PHF10 and BRD7) CX-MS datasets. FIG. 12D shows that HA-GLTSCR1L-bound ncBAF complexes were purified from WT HEK-293T, PAGE-separated and silver stained. Individual identified proteins are indicated. FIG. 12E shows the silver stain performed on density sedimentation of HA-GLTSCR1L-bound ncBAF complexes purified from HEK-293T cells (left), and the clustered heatmap of mass spec-called peptides and spectral counts on selected fractions (right). * indicates the non-specific contaminants in fraction 16. FIG. 12F shows the silver stain performed on density sedimentation of HA-BRD9 ncBAF complexes purified from HEK-293T cells (left), and the clustered heatmap of mass spec-called peptides and spectral counts on selected fractions are shown (right). FIG. 12G shows the schematic of the full mSWI/SNF complex assembly pathway. Subunit abbreviations are indicated. Numbers indicate the steps in assembly (see text).

FIG. 13A shows the frequency of mSWI/SNF gene mutations across human cancers (TCGA). FIG. 13B shows the MS analysis of mSWI/SNF complex subunit relative abundance in complexes purified from indicated cell types (WT and subunit KO cells), normalized to WT SMARCC1 purifications. ΔSMARCD complexes were purified using SMARCE1; ΔSMARCEL, ΔSMARCB1, ΔARID1/2, ΔARID1 and ΔSMARCA complexes were purified using HA-SMARCD1. FIG. 13C shows the correlation analysis reflecting impact of truncating mutations on mSWI/SNF subunit linkages. Subunits most frequently truncated exhibit higher proportions of inter-crosslinked sites lost. FIG. 13D shows the top-ranked cancer-associated missense mutations (TCGA). Mutations predicted to disrupt catalytic activity are in red. FIG. 13E shows the non-truncating mutations in ARID1A across human cancers mapped over intra cross-links. The hotspot mutation in the highly crosslinked C-terminal CBRB region of the protein is indicated. FIG. 13F shows the truncating mutations in ARID1A across human cancers mapped over crosslinks to other BAF subunits. Position of the truncating mutation Y2254* used in this study is indicated by the arrow. FIG. 13G shows the (Top) cycloheximide chase experiment assessing half-life of ARID1A WT and G2087R mutant C-terminal region variants, and (Bottom) the quantification of WB normalized to GAPDH is shown above. FIG. 13H shows the MG-132 treatment (8 hours) of HEK-293T cells expressing ARID1A WT and G2087R C-terminal regions. FIG. 13I shows the silver stain performed on ARID1A WT, G2087R and Y2254* BAF complexes purified from HEK-293T cells. FIG. 13J shows the immunoblot of ARID1A WT, G2087R and Y2254 *-bound BAF complexes purified from HEK-293T cells.

FIG. 14A shows the mutations in mSWI/SNF genes in human intellectual disability/developmental syndromes and other diseases. FIG. 14B shows the mutations in ACTL6A in autism spectrum disorders mapped over crosslinks to the BAF ATPase module. FIG. 14C shows the (Top) crosslinks in SMARCD1 and SMARCD, and (Bottom) the mutations in human specific granule deficiency (SGD) and crosslinks to other BAF subunits. FIG. 14D shows the silver stain analysis performed on glycerol gradient of HA-ARID1A G2087R-purified BAF complexes from HEK-293T cells. FIG. 14E shows the mRNA expression levels of the ARID1A and ARID1B transcripts in ARID1A-proficient and -deficient cancers (left). Boxplot of ARID1B expression in ARID1A-proficient and -deficient cancers (right). FIG. 14F shows the mRNA expression levels of the ARID1A and ARID1B transcripts in ARID1A-proficient and -deficient CCLE cancer cell lines (left). Boxplot of ARID1B expression in ARID1A-proficient and -deficient CCLE cell lines (right). FIG. 14G shows the boxplot of expression of ARID1A and ARID1B across CCLE cell lines. All represented cell lines have WT ARID1A and ARID1B.

Figure 1A:
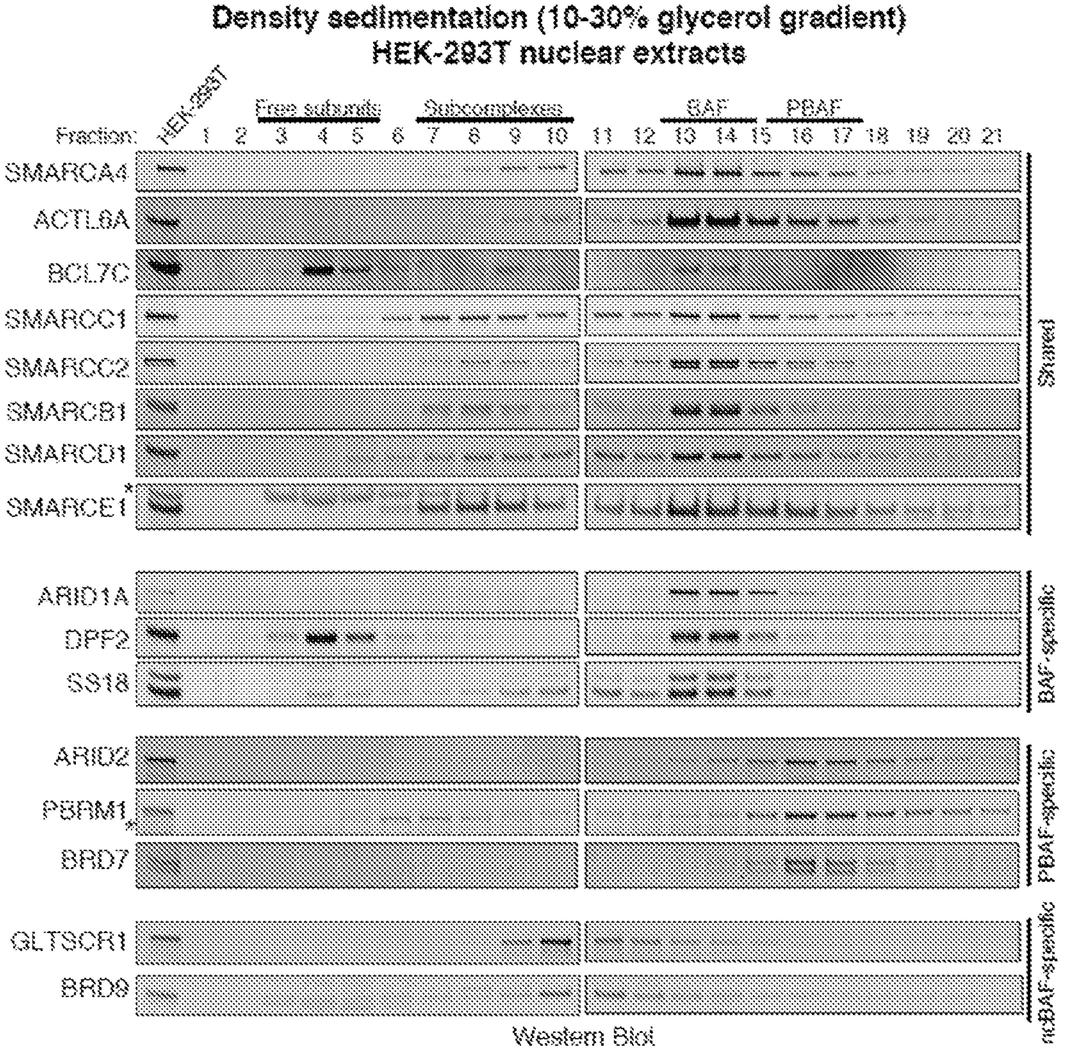
FIG. 1A-FIG. 1E show the distinct mSWI/SNF complexes and their intermediates revealed through density sedimentation and purification.
Figure 1B:
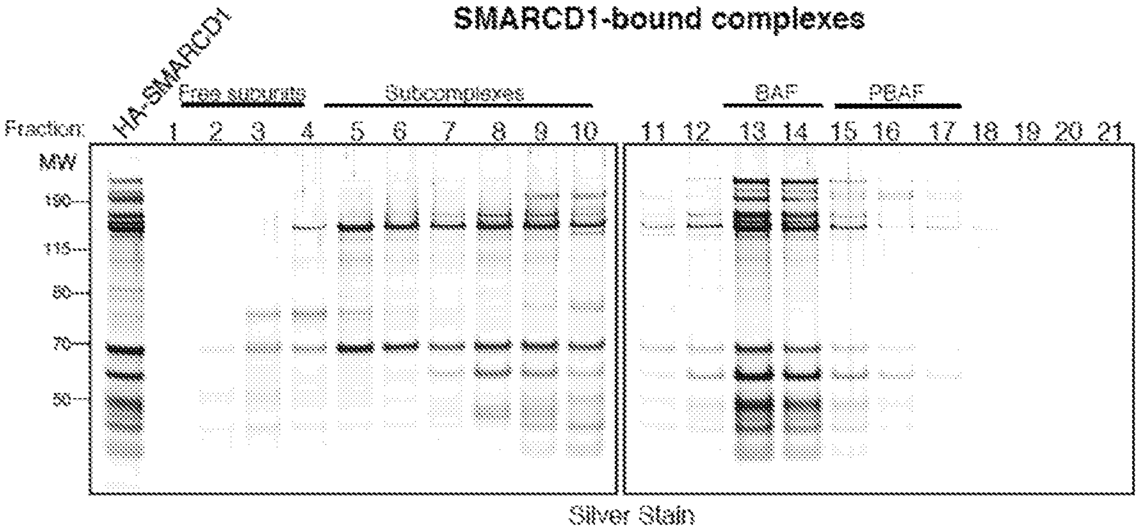
Figure 1C:
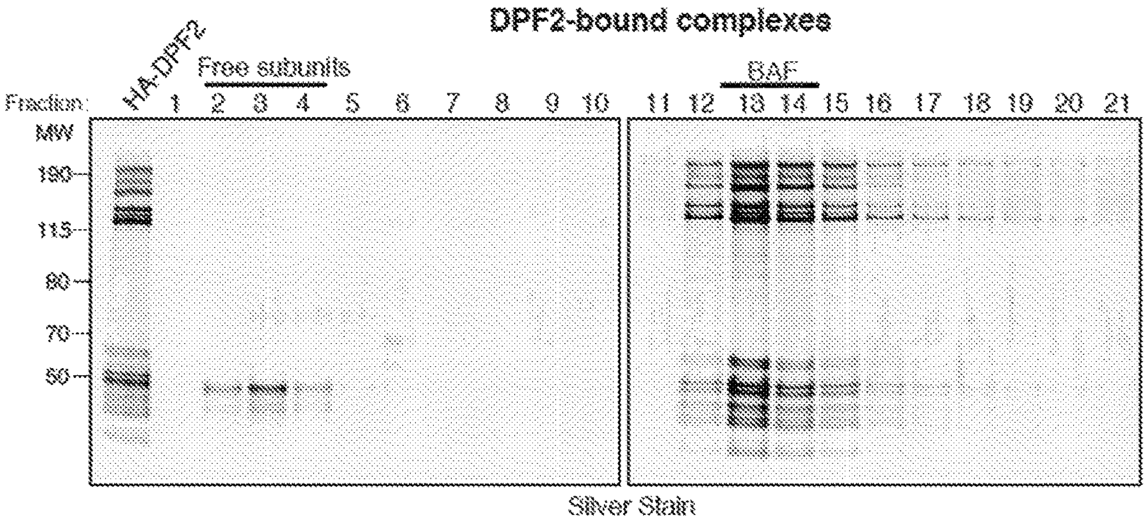
Figure 1D:
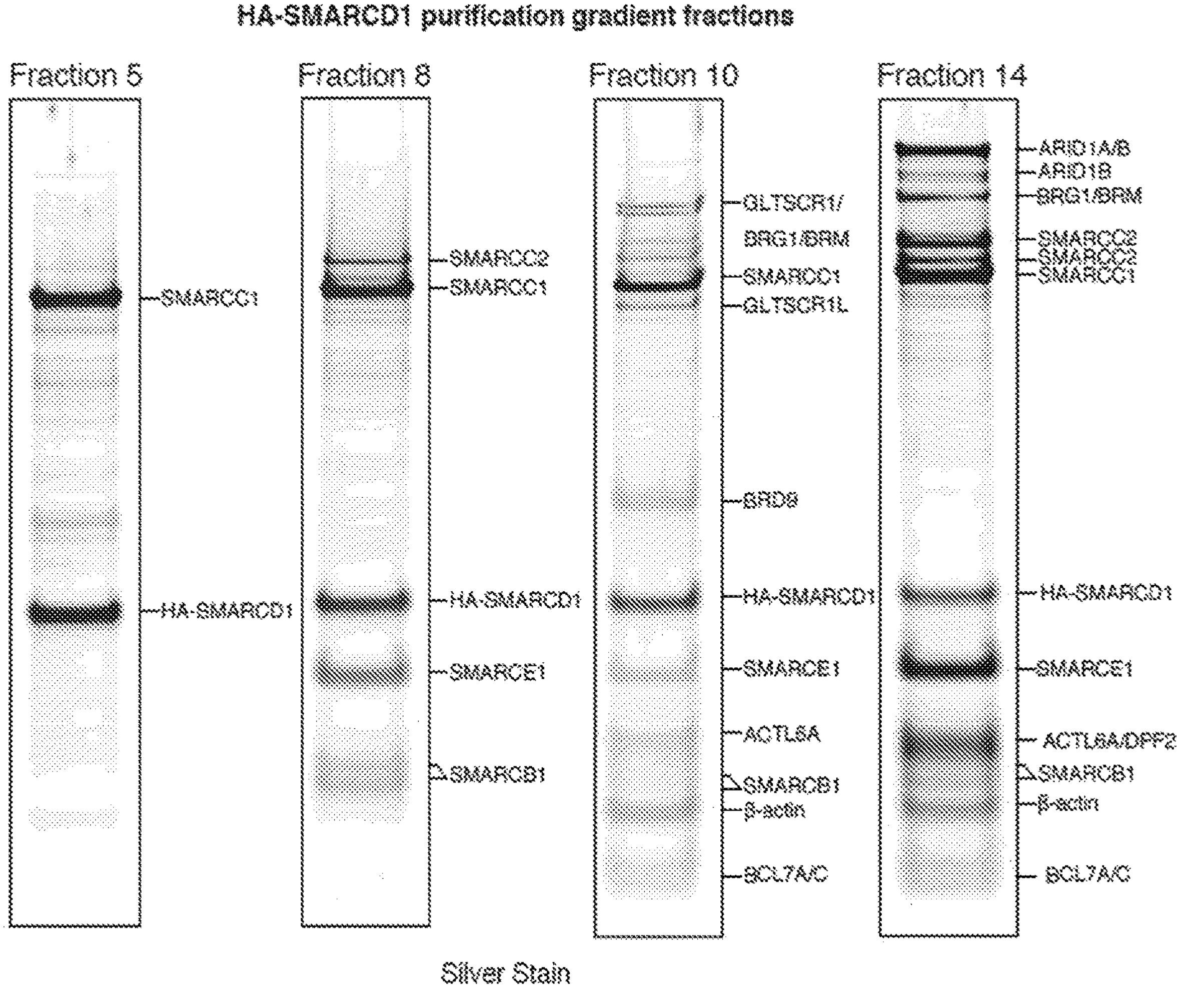

For any figure showing a bar histogram, curve, or other data associated with a legend, the bars, curve, or other data presented from left to right for each indication correspond directly and in order to the boxes from top to bottom of the legend.

DETAILED DESCRIPTION OF THE INVENTION

The present invention is based, at least in part, on the elucidation of the architecture and assembly pathway of three different classes of mammalian SWI/SNF complexes: canonical BAF, PBAF, and a newly defined complex, ncBAF, and the understanding of the requirement of each subunit for complex formation and stability. To establish a structural framework for mSWI/SNF complexes, a comprehensive, multifaceted approach involving complex and sub-complex purification, mass-spectrometry (MS), cross-linking mass-spectrometry (CX-MS), systematic genetic manipulation of subunits and subunit families, and human genetic studies was used. The analysis revealed that mammalian SWI/SNF complexes exist in three rather than two distinct, non-redundant final form complexes: canonical BAF, PBAF, and a newly-defined, atypical BAF complex termed non-canonical BAF (ncBAF). Importantly, the order of assembly and modular organization for each final form mSWI/SNF complex was established, and the full spectrum of endogenous combinatorial possibilities and the impact of individual subunit losses and mutations on complex architecture were defined. In addition, human disease-associated mutations within subunits and modules were mapped, which defines specific topological regions that are affected upon subunit perturbation. Accordingly, compositions based on the identified SWI/SNF complexes and methods of screening for modulators of formation and/or stability of the identified SWI/SNF complexes, are provided.

I. Definitions

The articles "a" and "an" are used herein to refer to one or to more than one (i.e. to at least one) of the grammatical object of the article. By way of example, "an element" means one element or more than one element.

The term "administering" is intended to include routes of administration which allow an agent to perform its intended function. Examples of routes of administration for treatment of a body which can be used include injection (subcutaneous, intravenous, parenterally, intraperitoneally, intrathecal, etc.), oral, inhalation, and transdermal routes. The injection can be bolus injections or can be continuous infusion. Depending on the route of administration, the agent can be coated with or disposed in a selected material to protect it from natural conditions which may detrimentally affect its ability to perform its intended function. The agent may be administered alone, or in conjunction with a pharmaceutically acceptable carrier. The agent also may be administered as a prodrug, which is converted to its active form in vivo.

Unless otherwise specified here within, the terms "antibody" and "antibodies" broadly encompass naturally-occurring forms of antibodies (e.g. IgG, IgA, IgM, IgE) and recombinant antibodies, such as single-chain antibodies, chimeric and humanized antibodies and multi-specific antibodies, as well as fragments and derivatives of all of the foregoing, which fragments and derivatives have at least an antigenic binding site. Antibody derivatives may comprise a protein or chemical moiety conjugated to an antibody.

In addition, intrabodies are well-known antigen-binding molecules having the characteristic of antibodies, but that are capable of being expressed within cells in order to bind and/or inhibit intracellular targets of interest (Chen et al. (1994) *Human Gene Ther.* 5:595-601). Methods are well-known in the art for adapting antibodies to target (e.g., inhibit) intracellular moieties, such as the use of single-chain antibodies (scFvs), modification of immunoglobulin VL domains for hyperstability, modification of antibodies to resist the reducing intracellular environment, generating fusion proteins that increase intracellular stability and/or modulate intracellular localization, and the like. Intracellular antibodies can also be introduced and expressed in one or more cells, tissues or organs of a multicellular organism, for example for prophylactic and/or therapeutic purposes (e.g., as a gene therapy) (see, at least PCT Publs. WO 08/020079, WO 94/02610, WO 95/22618, and WO 03/014960; U.S. Pat. No. 7,004,940; Cattaneo and Biocca (1997) *Intracellular Antibodies: Development and Applications* (Landes and Springer-Verlag publs.); Kontermann (2004) *Methods* 34:163-170; Cohen et al. (1998) *Oncogene* 17:2445-2456; Auf der Maur et al. (2001) *FEBS Lett.* 508:407-412; Shaki-Loewenstein et al. (2005) *J. Immunol. Meth.* 303:19-39).

The term "antibody" as used herein also includes an "antigen-binding portion" of an antibody (or simply "antibody portion"). The term "antigen-binding portion", as used herein, refers to one or more fragments of an antibody that retain the ability to specifically bind to an antigen (e.g., a protein complex encompassed by the present invention, or a subunit thereof). It has been shown that the antigen-binding function of an antibody can be performed by fragments of a full-length antibody. Examples of binding fragments encompassed within the term "antigen-binding portion" of an antibody include (i) a Fab fragment, a monovalent fragment consisting of the VL, VH, CL and CHI domains; (ii) a F(ab')2 fragment, a bivalent fragment comprising two Fab fragments linked by a disulfide bridge at the hinge region; (iii) a Fd fragment consisting of the VH and CHI domains; (iv) a Fv fragment consisting of the VL and VH domains of a single arm of an antibody, (v) a dAb fragment (Ward et al., (1989) *Nature* 341:544-546), which consists of a VH domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent polypeptides (known as single chain Fv (scFv); see e.g., Bird et al. (1988) *Science* 242:423-426; and Huston et al. (1988) *Proc. Natl. Acad. Sci. USA* 85:5879-5883; and Osbourn et al. 1998, *Nature Biotechnology* 16:778). Such single chain antibodies are also intended to be encompassed within the term "antigen-binding portion" of an antibody. Any VH and VL sequences of specific scFv can be linked to human immunoglobulin constant region cDNA or genomic sequences, in order to generate expression vectors encoding complete IgG polypeptides or other isotypes. VH and VL can also be used in the generation of Fab, Fv or other fragments of immunoglobulins using either protein chemistry or recombinant DNA technology. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites (see e.g., Holliger et al. (1993) *Proc. Natl. Acad. Sci. U.S.A.* 90:6444-6448; Poljak et al. (1994) *Structure* 2:1121-1123).

Still further, an antibody or antigen-binding portion thereof may be part of larger immunoadhesion polypeptides, formed by covalent or noncovalent association of the antibody or antibody portion with one or more other proteins or peptides. Examples of such immunoadhesion polypeptides include use of the streptavidin core region to make a tetrameric scFv polypeptide (Kipriyanov et al. (1995) *Human Antibodies and Hybridomas* 6:93-101) and use of a cysteine residue, protein subunit peptide and a C-terminal polyhistidine tag to make bivalent and biotinylated scFv polypeptides (Kipriyanov et al. (1994) *Mol. Immunol.* 31:1047-1058). Antibody portions, such as Fab and $F(ab')_2$ fragments, can be prepared from whole antibodies using conventional techniques, such as papain or pepsin digestion, respectively, of whole antibodies. Moreover, antibodies, antibody portions and immunoadhesion polypeptides can be obtained using standard recombinant DNA techniques, as described herein.

Antibodies may be polyclonal or monoclonal; xenogeneic, allogeneic, or syngeneic; or modified forms thereof (e.g. humanized, chimeric, etc.). Antibodies may also be fully human. Preferably, antibodies of the invention bind specifically or substantially specifically to a protein complex. The terms "monoclonal antibodies" and "monoclonal antibody composition", as used herein, refer to a population of antibody polypeptides that contain only one species of an antigen binding site capable of immunoreacting with a particular epitope of an antigen, whereas the term "polyclonal antibodies" and "polyclonal antibody composition" refer to a population of antibody polypeptides that contain multiple species of antigen binding sites capable of interacting with a particular antigen. A monoclonal antibody composition typically displays a single binding affinity for a particular antigen with which it immunoreacts.

Antibodies may also be "humanized," which is intended to include antibodies made by a non-human cell having variable and constant regions which have been altered to more closely resemble antibodies that would be made by a human cell. For example, by altering the non-human antibody amino acid sequence to incorporate amino acids found in human germline immunoglobulin sequences. The humanized antibodies of the invention may include amino acid residues not encoded by human germline immunoglobulin sequences (e.g., mutations introduced by random or site-specific mutagenesis in vitro or by somatic mutation in vivo), for example in the CDRs. The term "humanized antibody", as used herein, also includes antibodies in which CDR sequences derived from the germline of another mammalian species, have been grafted onto human framework sequences.

A "blocking" antibody or an antibody "antagonist" is one which inhibits or reduces at least one biological activity of the antigen(s) it binds. In certain embodiments, the blocking antibodies or antagonist antibodies or fragments thereof described herein substantially or completely inhibit a given biological activity of the antigen(s).

As used herein, the term "isotype" refers to the antibody class (e.g., IgM, IgG1, IgG2C, and the like) that is encoded by heavy chain constant region genes.

The term "coding region" refers to regions of a nucleotide sequence comprising codons which are translated into amino acid residues, whereas the term "noncoding region" refers to regions of a nucleotide sequence that are not translated into amino acids (e.g., 5' and 3' untranslated regions).

The term "complementary" refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. Preferably, the first region comprises a first portion and the second region comprises a second portion, whereby, when the first and second portions are arranged in an antiparallel fashion, at least about 50%, and preferably at least about 75%, at least about 90%, or at least about 95% of the nucleotide residues of the first portion are capable of base pairing with nucleotide residues in the second portion. More preferably, all nucleotide residues of the first portion are capable of base pairing with nucleotide residues in the second portion.

As used herein, the term "inhibiting" and grammatical equivalents thereof refer decrease, limiting, and/or blocking a particular action, function, or interaction. A reduced level of a given output or parameter need not, although it may, mean an absolute absence of the output or parameter. The invention does not require, and is not limited to, methods that wholly eliminate the output or parameter. The given output or parameter can be determined using methods well-known in the art, including, without limitation, immunohistochemical, molecular biological, cell biological, clinical, and biochemical assays, as discussed herein and in the examples. The opposite terms "promoting," "increasing," and grammatical equivalents thereof refer to the increase in the level of a given output or parameter that is the reverse of that described for inhibition or decrease.

As used herein, the term "interacting" or "interaction" means that two protein domains, fragments or complete proteins exhibit sufficient physical affinity to each other so as to bring the two "interacting protein domains, fragments or proteins physically close to each other. An extreme case of interaction is the formation of a chemical bond that results in continual and stable proximity of the two entities. Interactions that are based solely on physical affinities, although usually more dynamic than chemically bonded interactions, can be equally effective in co-localizing two proteins. Examples of physical affinities and chemical bonds include but are not limited to, forces caused by electrical charge differences, hydrophobicity, hydrogen bonds, Van der Waals force, ionic force, covalent linkages, and combinations thereof. The state of proximity between the interaction domains, fragments, proteins or entities may be transient or permanent, reversible or irreversible. In any event, it is in contrast to and distinguishable from contact caused by natural random movement of two entities. Typically, although not necessarily, an "interaction" is exhibited by the binding between the interaction domains, fragments, proteins, or entities. Examples of interactions include specific interactions between antigen and antibody, ligand and receptor, enzyme and substrate, and the like.

Generally, such an interaction results in an activity (which produces a biological effect) of one or both of said molecules. The activity may be a direct activity of one or both of the molecules, (e.g., signal transduction). Alternatively, one or both molecules in the interaction may be prevented from binding their ligand, and thus be held inactive with respect to ligand binding activity (e.g., binding its ligand and triggering or inhibiting an immune response). To inhibit such an interaction results in the disruption of the activity of one or more molecules involved in the interaction. To enhance such an interaction is to prolong or increase the likelihood of said physical contact, and prolong or increase the likelihood of said activity.

An "interaction" between two protein domains, fragments or complete proteins can be determined by a number of methods. For example, an interaction can be determined by functional assays. Such as the two-hybrid Systems. Protein-protein interactions can also be determined by various biophysical and biochemical approaches based on the affinity binding between the two interacting partners. Such biochemical methods generally known in the art include, but are not limited to, protein affinity chromatography, affinity blotting, immunoprecipitation, and the like. The binding constant for two interacting proteins, which reflects the strength or quality of the interaction, can also be determined using methods known in the art. See Phizicky and Fields, (1995) *Microbiol. Rev.,* 59:94-123.

As used herein, a "kit" is any manufacture (e.g. a package or container) comprising at least one reagent, e.g. a probe, for specifically detecting or modulating the expression of a marker encompassed by the present invention. The kit may be promoted, distributed, or sold as a unit for performing the methods encompassed by the present invention.

As used herein, the term "modulate" includes up-regulation and down-regulation, e.g., enhancing or inhibiting the formation and/or stability of an protein complex encompassed by the present invention.

An "isolated protein" refers to a protein that is substantially free of other proteins, cellular material, separation medium, and culture medium when isolated from cells or produced by recombinant DNA techniques, or chemical precursors or other chemicals when chemically synthesized. An "isolated" or "purified" protein or biologically active portion thereof is substantially free of cellular material or other contaminating proteins from the cell or tissue source from which the protein subunit of a protein complex encompassed by the present invention, or fusion protein or fragment thereof, is derived, or substantially free from chemical precursors or other chemicals when chemically synthesized. The language "substantially free of cellular material" includes preparations of a protein subunit of a protein complex encompassed by the present invention, in which the protein is separated from cellular components of the cells from which it is isolated or recombinantly produced. In one embodiment, the language "substantially free of cellular material" includes preparations of a protein subunit, having less than about 30% (by dry weight) of non-subunit protein (also referred to herein as a "contaminating protein"), more preferably less than about 20% of non-subunit protein, still more preferably less than about 10% of non-subunit protein, and most preferably less than about 5% non-subunit protein. When protein subunit of a protein complex encompassed by the present invention, or fusion protein or fragment thereof, e.g., a biologically active fragment thereof, is recombinantly produced, it is also preferably substantially free of culture medium, i.e., culture medium represents less than about 20%, more preferably less than about 10%, and most preferably less than about 5% of the volume of the protein preparation.

As used herein, the term "nucleic acid molecule" is intended to include DNA molecules and RNA molecules. A nucleic acid molecule may be single-stranded or double-stranded, but preferably is double-stranded DNA. As used herein, the term "isolated nucleic acid molecule" is intended to refer to a nucleic acid molecule in which the nucleotide sequences are free of other nucleotide sequences, which other sequences may naturally flank the nucleic acid in human genomic DNA.

A nucleic acid is "operably linked" when it is placed into a functional relationship with another nucleic acid sequence. For instance, a promoter or enhancer is operably linked to a coding sequence if it affects the transcription of the sequence. With respect to transcription regulatory sequences, operably linked means that the DNA sequences being linked are contiguous and, where necessary to join two protein coding regions, contiguous and in reading frame. For switch sequences, operably linked indicates that the sequences are capable of effecting switch recombination.

For nucleic acids, the term "substantial homology" indicates that two nucleic acids, or designated sequences thereof, when optimally aligned and compared, are identical, with appropriate nucleotide insertions or deletions, in at least about 80% of the nucleotides, usually at least about 81%, 82%, 83%, 84%, 85%, 86%, 87%, 88%, 89%, 90%, 91%, 92%, 93%, 94%, 95%, 96%, or more of the nucleotides, and more preferably at least about 97%, 98%, 99% or more of the nucleotides. Alternatively, substantial homology exists when the segments will hybridize under selective hybridization conditions, to the complement of the strand.

The percent identity between two sequences is a function of the number of identical positions shared by the sequences (i.e., % identity=# of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two nucleotide sequences can be determined using the GAP program in the GCG software package (available on the world wide web at the GCG company website), using a NWSgapdna. CMP matrix and a gap weight of 40, 50, 60, 70, or 80 and a length weight of 1, 2, 3, 4, 5, or 6. The percent identity between two nucleotide or amino acid sequences can also be determined using the algorithm of E. Meyers and W. Miller (CABIOS, 4:11 17 (1989)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (J. Mol. Biol. (48): 444 453 (1970)) algorithm which has been incorporated into the GAP program in the GCG software package (available on the world wide web at the GCG company website), using either a Blosum 62 matrix or a PAM250 matrix, and a gap weight of 16, 14, 12, 10, 8, 6, or 4 and a length weight of 1, 2, 3, 4, 5, or 6.

The nucleic acid and protein sequences encompassed by the present invention can further be used as a "query sequence" to perform a search against public databases to, for example, identify related sequences. Such searches can be performed using the NBLAST and XBLAST programs (version 2.0) of Altschul, et al. (1990) J. Mol. Biol. 215:403 10. BLAST nucleotide searches can be performed with the NBLAST program, score=100, wordlength=12 to obtain nucleotide sequences homologous to the nucleic acid molecules encompassed by the present invention. BLAST protein searches can be performed with the XBLAST program, score=50, wordlength=3 to obtain amino acid sequences homologous to the protein molecules encompassed by the present invention. To obtain gapped alignments for comparison purposes, Gapped BLAST can be utilized as described in Altschul et al., (1997) *Nucleic Acids Res.* 25 (17): 3389 3402. When utilizing BLAST and Gapped BLAST programs, the default parameters of the respective programs (e.g., XBLAST and NBLAST) can be used (available on the world wide web at the NCBI website).

The nucleic acids may be present in whole cells, in a cell lysate, or in a partially purified or substantially pure form. A nucleic acid is "isolated" or "rendered substantially pure" when purified away from other cellular components or other contaminants, e.g., other cellular nucleic acids or proteins, by standard techniques, including alkaline/SDS treatment, CsCl banding, column chromatography, agarose gel electrophoresis and others well-known in the art (see, F. Ausubel, et al., ed. Current Protocols in Molecular Biology, Greene Publishing and Wiley Interscience, New York (1987)).

A "transcribed polynucleotide" or "nucleotide transcript" is a polynucleotide (e.g. an mRNA, hnRNA, a cDNA, or an analog of such RNA or cDNA) which is complementary to or homologous with all or a portion of a mature mRNA made by transcription of a subunit nucleic acid and normal post-transcriptional processing (e.g. splicing), if any, of the RNA transcript, and reverse transcription of the RNA transcript.

An "RNA interfering agent" as used herein, is defined as any agent which interferes with or inhibits expression of a target protein subunit gene by RNA interference (RNAi). Such RNA interfering agents include, but are not limited to, nucleic acid molecules including RNA molecules which are homologous to a protein subunit gene encompassed by the present invention, or a fragment thereof, short interfering RNA (siRNA), and small molecules which interfere with or inhibit expression of a target protein subunit nucleic acid by RNA interference (RNAi).

"RNA interference (RNAi)" is an evolutionally conserved process whereby the expression or introduction of RNA of a sequence that is identical or highly similar to a target protein subunit nucleic acid results in the sequence specific degradation or specific post-transcriptional gene silencing (PTGS) of messenger RNA (mRNA) transcribed from that targeted gene (see Coburn, G. and Cullen, B. (2002) *J. of Virology* 76 (18): 9225), thereby inhibiting expression of the target protein subunit nucleic acid. In one embodiment, the RNA is double stranded RNA (dsRNA). This process has been described in plants, invertebrates, and mammalian cells. In nature, RNAi is initiated by the dsRNA-specific endonuclease Dicer, which promotes processive cleavage of long dsRNA into double-stranded fragments termed siRNAs. siRNAs are incorporated into a protein complex that recognizes and cleaves target mRNAs. RNAi can also be initiated by introducing nucleic acid molecules, e.g., synthetic siRNAs, shRNAs, or other RNA interfering agents, to inhibit or silence the expression of target protein subunit nucleic acids. As used herein, "inhibition of a protein subunit nucleic acid expression" or "inhibition of protein subunit gene expression" includes any decrease in expression or protein activity or level of the protein subunit nucleic acid or protein encoded by the protein subunit nucleic acid. The decrease may be of at least 30%, 40%, 50%, 60%, 70%, 80%, 90%, 95% or 99% or more as compared to the expression of a protein subunit nucleic acid or the activity or level of the protein encoded by a protein subunit nucleic acid which has not been targeted by an RNA interfering agent.

In addition to RNAi, genome editing can be used to modulate the copy number or genetic sequence of a protein subunit of interest, such as constitutive or induced knockout or mutation of a protein subunit of interest, such as a protein subunit of an isolated modified protein complexes encompassed by the present invention. For example, the CRISPR-Cas system can be used for precise editing of genomic nucleic acids (e.g., for creating non-functional or null mutations). In such embodiments, the CRISPR guide RNA and/or the Cas enzyme may be expressed. For example, a vector containing only the guide RNA can be administered to an animal or cells transgenic for the Cas9 enzyme. Similar strategies may be used (e.g., designer zinc finger, transcription activator-like effectors (TALEs) or homing meganucleases). Such systems are well-known in the art (see, for example, U.S. Pat. No. 8,697,359; Sander and Joung (2014) *Nat. Biotech.* 32:347-355; Hale et al. (2009) *Cell* 139:945-956; Karginov and Hannon (2010) *Mol. Cell* 37:7; U.S. Pat. Publ. 2014/0087426 and 2012/0178169; Boch et al. (2011) *Nat. Biotech.* 29:135-136; Boch et al. (2009) *Science* 326: 1509-1512; Moscou and Bogdanove (2009) *Science* 326: 1501; Weber et al. (2011) *PLOS One* 6: e19722; Li et al. (2011) *Nucl. Acids Res.* 39:6315-6325; Zhang et al. (2011) *Nat. Biotech.* 29:149-153; Miller et al. (2011) *Nat. Biotech.* 29:143-148; Lin et al. (2014) *Nucl. Acids Res.* 42: e47). Such genetic strategies can use constitutive expression systems or inducible expression systems according to well-known methods in the art.

"Piwi-interacting RNA (piRNA)" is the largest class of small non-coding RNA molecules. piRNAs form RNA-protein complexes through interactions with piwi proteins. These piRNA complexes have been linked to both epigenetic and post-transcriptional gene silencing of retrotransposons and other genetic elements in germ line cells, particularly those in spermatogenesis. They are distinct from microRNA (miRNA) in size (26-31 nt rather than 21-24 nt), lack of sequence conservation, and increased complexity. However, like other small RNAs, piRNAs are thought to be involved in gene silencing, specifically the silencing of transposons. The majority of piRNAs are antisense to transposon sequences, suggesting that transposons are the piRNA target. In mammals it appears that the activity of piRNAs in transposon silencing is most important during the development of the embryo, and in both *C. elegans* and humans, piRNAs are necessary for spermatogenesis. piRNA has a role in RNA silencing via the formation of an RNA-induced silencing complex (RISC).

"Aptamers" are oligonucleotide or peptide molecules that bind to a specific target molecule. "Nucleic acid aptamers" are nucleic acid species that have been engineered through repeated rounds of in vitro selection or equivalently, SELEX (systematic evolution of ligands by exponential enrichment) to bind to various molecular targets such as small molecules, proteins, nucleic acids, and even cells, tissues and organisms. "Peptide aptamers" are artificial proteins selected or engineered to bind specific target molecules.

These proteins consist of one or more peptide loops of variable sequence displayed by a protein scaffold. They are typically isolated from combinatorial libraries and often subsequently improved by directed mutation or rounds of variable region mutagenesis and selection. The "Affimer protein", an evolution of peptide aptamers, is a small, highly stable protein engineered to display peptide loops which provides a high affinity binding surface for a specific target protein. It is a protein of low molecular weight, 12-14 kDa, derived from the cysteine protease inhibitor family of cystatins. Aptamers are useful in biotechnological and therapeutic applications as they offer molecular recognition properties that rival that of the commonly used biomolecule, antibodies. In addition to their discriminate recognition, aptamers offer advantages over antibodies as they can be engineered completely in a test tube, are readily produced by chemical synthesis, possess desirable storage properties, and elicit little or no immunogenicity in therapeutic applications.

"Short interfering RNA" (siRNA), also referred to herein as "small interfering RNA" is defined as an agent which functions to inhibit expression of a protein subunit nucleic acid, e.g., by RNAi. A siRNA may be chemically synthesized, may be produced by in vitro transcription, or may be produced within a host cell. In one embodiment, siRNA is a double stranded RNA (dsRNA) molecule of about 15 to about 40 nucleotides in length, preferably about 15 to about 28 nucleotides, more preferably about 19 to about 25 nucleotides in length, and more preferably about 19, 20, 21, or 22 nucleotides in length, and may contain a 3' and/or 5' overhang on each strand having a length of about 0, 1, 2, 3, 4, or 5 nucleotides. The length of the overhang is independent between the two strands, i.e., the length of the overhang on one strand is not dependent on the length of the overhang on the second strand. Preferably the siRNA is capable of promoting RNA interference through degradation or specific post-transcriptional gene silencing (PTGS) of the target messenger RNA (mRNA).

In another embodiment, a siRNA is a small hairpin (also called stem loop) RNA (shRNA). In one embodiment, these shRNAs are composed of a short (e.g., 19-25 nucleotide) antisense strand, followed by a 5-9 nucleotide loop, and the analogous sense strand. Alternatively, the sense strand may precede the nucleotide loop structure and the antisense strand may follow. These shRNAs may be contained in plasmids, retroviruses, and lentiviruses and expressed from, for example, the pol III U6 promoter, or another promoter (see, e.g., Stewart, et al. (2003) *RNA* Apr; 9 (4): 493-501 incorporated by reference herein).

RNA interfering agents, e.g., siRNA molecules, may be administered to a host cell or organism, to inhibit expression of a protein subunit gene of a protein complex encompassed by the present invention and thereby inhibit the formation of the protein complex.

The term "small molecule" is a term of the art and includes molecules that are less than about 1000 molecular weight or less than about 500 molecular weight. In one embodiment, small molecules do not exclusively comprise peptide bonds. In another embodiment, small molecules are not oligomeric. Exemplary small molecule compounds which can be screened for activity include, but are not limited to, peptides, peptidomimetics, nucleic acids, carbohydrates, small organic molecules (e.g., polyketides) (Cane et al. (1998) *Science* 282:63), and natural product extract libraries. In another embodiment, the compounds are small, organic non-peptidic compounds. In a further embodiment, a small molecule is not biosynthetic.

The term "specific binding" refers to antibody binding to a predetermined antigen. Typically, the antibody binds with an affinity ($K_D$) of approximately less than $10^{-7}$ M, such as approximately less than $10^{-8}$ M, $10^{-9}$ M or $10^{-10}$ M or even lower when determined by surface plasmon resonance (SPR) technology in a BIACORE® assay instrument using an antigen of interest as the analyte and the antibody as the ligand, and binds to the predetermined antigen with an affinity that is at least 1.1-, 1.2-, 1.3-, 1.4-, 1.5-, 1.6-, 1.7-, 1.8-, 1.9-, 2.0-, 2.5-, 3.0-, 3.5-, 4.0-, 4.5-, 5.0-, 6.0-, 7.0-, 8.0-, 9.0-, or 10.0-fold or greater than its affinity for binding to a non-specific antigen (e.g., BSA, casein) other than the predetermined antigen or a closely-related antigen. The phrases "an antibody recognizing an antigen" and "an antibody specific for an antigen" are used interchangeably herein with the term "an antibody which binds specifically to an antigen." Selective binding is a relative term referring to the ability of an antibody to discriminate the binding of one antigen over another.

As used herein, the term "protein complex" means a composite unit that is a combination of two or more proteins formed by interaction between the proteins. Typically, but not necessarily, a "protein complex" is formed by the binding of two or more proteins together through specific non-covalent binding interactions. However, covalent bonds may also be present between the interacting partners. For instance, the two interacting partners can be covalently crosslinked so that the protein complex becomes more stable. The protein complex may or may not include and/or be associated with other molecules such as nucleic acid, such as RNA or DNA, or lipids or further cofactors or moieties selected from a metal ions, hormones, second messengers, phosphate, sugars. A "protein complex" of the invention may also be part of or a unit of a larger physiological protein assembly.

The term "isolated protein complex" means a protein complex present in a composition or environment that is different from that found in nature, in its native or original cellular or body environment. Preferably, an "isolated protein complex" is separated from at least 50%, more preferably at least 75%, most preferably at least 90% of other naturally co-existing cellular or tissue components. Thus, an "isolated protein complex" may also be a naturally existing protein complex in an artificial preparation or a non-native host cell. An "isolated protein complex" may also be a "purified protein complex", that is, a substantially purified form in a substantially homogenous preparation substantially free of other cellular components, other polypeptides, viral materials, or culture medium, or, when the protein components in the protein complex are chemically synthesized, free of chemical precursors or by-products associated with the chemical synthesis. A "purified protein complex" typically means a preparation containing preferably at least 75%, more preferably at least 85%, and most preferably at least 95% of a particular protein complex. A "purified protein complex" may be obtained from natural or recombinant host cells or other body samples by standard purification techniques, or by chemical synthesis.

The term "modified protein complex" refers to a protein complex present in a composition that is different from that found in nature, in its native or original cellular or body environment. The term "modification" as used herein refers to all modifications of a protein or protein complex of the invention including cleavage and addition or removal of a group. In some embodiments, the "modified protein complex" comprises at least one subunit that is modified, i.e., different from that found in nature, in its native or original cellular or body environment. The "modified subunit" may be, e.g., a derivative or fragment of the native subunit from which it derives from.

As used herein, the term "domain" means a functional portion, segment or region of a protein, or polypeptide. "Interaction domain" refers specifically to a portion, segment or region of a protein, polypeptide or protein fragment that is responsible for the physical affinity of that protein, protein fragment or isolated domain for another protein, protein fragment or isolated domain.

If not stated otherwise, the term "compound" as used herein are include but are not limited to peptides, nucleic acids, carbohydrates, natural product extract libraries, organic molecules, preferentially small organic molecules, inorganic molecules, including but not limited to chemicals, metals and organometallic molecules.

The terms "derivatives" or "analogs of subunit proteins" or "variants" as used herein include, but are not limited, to molecules comprising regions that are substantially homologous to the subunit proteins, in various embodiments, by at least 30%, 40%, 50%, 60%, 70%, 80%, 90%, 95% or 99% identity over an amino acid sequence of identical size or when compared to an aligned sequence in which the alignment is done by a computer homology program known in the art, or whose encoding nucleic acid is capable of hybridizing to a sequence encoding the component protein under stringent, moderately stringent, or nonstringent conditions. It means a protein which is the outcome of a modification of the naturally occurring protein, by amino acid substitutions, deletions and additions, respectively, which derivatives still exhibit the biological function of the naturally occurring protein although not necessarily to the same degree. The biological function of such proteins can e.g. be examined by suitable available in vitro assays as provided in the invention.

The term "functionally active" as used herein refers to a polypeptide, namely a fragment or derivative, having structural, regulatory, or biochemical functions of the protein according to the embodiment of which this polypeptide, namely fragment or derivative is related to.

"Function-conservative variants" are those in which a given amino acid residue in a protein or enzyme has been changed without altering the overall conformation and function of the polypeptide, including, but not limited to, replacement of an amino acid with one having similar properties (e.g., polarity, hydrogen bonding potential, acidic, basic, hydrophobic, aromatic, and the like). Amino acids other than those indicated as conserved may differ in a protein so that the percent protein or amino acid sequence similarity between any two proteins of similar function may vary and may be, for example, from 70% to 99% as determined according to an alignment scheme such as by the Cluster Method, wherein similarity is based on the MEGALIGN algorithm. A "function-conservative variant" also includes a polypeptide which has at least 60% amino acid identity as determined by BLAST or FASTA algorithms, preferably at least 75%, more preferably at least 85%, still preferably at least 90%, and even more preferably at least 95%, and which has the same or substantially similar properties or functions as the native or parent protein to which it is compared.

The terms "polypeptide fragment" or "fragment", when used in reference to a reference polypeptide, refers to a polypeptide in which amino acid residues are deleted as compared to the reference polypeptide itself, but where the remaining amino acid sequence is usually identical to the corresponding positions in the reference polypeptide. Such deletions may occur at the amino-terminus, internally, or at the carboxyl-terminus of the reference polypeptide, or alternatively both. Fragments typically are at least 5, 6, 8 or 10 amino acids long, at least 14 amino acids long, at least 20, 30, 40 or 50 amino acids long, at least 75 amino acids long, or at least 100, 150, 200, 300, 500 or more amino acids long. They can be, for example, at least and/or including 10, 15, 20, 25, 30, 35, 40, 45, 50, 55, 60, 65, 70, 75, 80, 85, 90, 95, 100, 120, 140, 160, 180, 200, 220, 240, 260, 280, 300, 320, 340, 360, 380, 400, 420, 440, 460, 480, 500, 520, 540, 560, 580, 600, 620, 640, 660, 680, 700, 720, 740, 760, 780, 800, 820, 840, 860, 880, 900, 920, 940, 960, 980, 1000, 1020, 1040, 1060, 1080, 1100, 1120, 1140, 1160, 1180, 1200, 1220, 1240, 1260, 1280, 1300, 1320, 1340 or more long so long as they are less than the length of the full-length polypeptide. Alternatively, they can be no longer than and/or excluding such a range so long as they are less than the length of the full-length polypeptide.

"Homologous" as used herein, refers to nucleotide sequence similarity between two regions of the same nucleic acid strand or between regions of two different nucleic acid strands. When a nucleotide residue position in both regions is occupied by the same nucleotide residue, then the regions are homologous at that position. A first region is homologous to a second region if at least one nucleotide residue position of each region is occupied by the same residue. Homology between two regions is expressed in terms of the proportion of nucleotide residue positions of the two regions that are occupied by the same nucleotide residue. By way of example, a region having the nucleotide sequence 5'-ATTGCC-3' and a region having the nucleotide sequence 5'-TATGGC-3' share 50% homology. Preferably, the first region comprises a first portion and the second region comprises a second portion, whereby, at least about 50%, and preferably at least about 75%, at least about 90%, or at least about 95% of the nucleotide residue positions of each of the portions are occupied by the same nucleotide residue. More preferably, all nucleotide residue positions of each of the portions are occupied by the same nucleotide residue.

The term “probe” refers to any molecule which is capable of selectively binding to a specifically intended target molecule, for example, a nucleotide transcript or protein encoded by or corresponding to a marker. Probes can be either synthesized by one skilled in the art, or derived from appropriate biological preparations. For purposes of detection of the target molecule, probes may be specifically designed to be labeled, as described herein. Examples of molecules that can be utilized as probes include, but are not limited to, RNA, DNA, proteins, antibodies, and organic molecules.

As used herein, the term “host cell” is intended to refer to a cell into which a nucleic acid encompassed by the present invention, such as a recombinant expression vector encompassed by the present invention, has been introduced. The terms “host cell” and “recombinant host cell” are used interchangeably herein. It should be understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

As used herein, the term “vector” refers to a nucleic acid capable of transporting another nucleic acid to which it has been linked. One type of vector is a “plasmid”, which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as “recombinant expression vectors” or simply “expression vectors”. In general, expression vectors of utility in recombinant DNA techniques are often in the form of plasmids. In the present specification, “plasmid” and “vector” may be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The term “substantially free of chemical precursors or other chemicals” includes preparations of antibody, polypeptide, peptide or fusion protein in which the protein is separated from chemical precursors or other chemicals which are involved in the synthesis of the protein. In one embodiment, the language “substantially free of chemical precursors or other chemicals” includes preparations of antibody, polypeptide, peptide or fusion protein having less than about 30% (by dry weight) of chemical precursors or non-antibody, polypeptide, peptide or fusion protein chemicals, more preferably less than about 20% chemical precursors or non-antibody, polypeptide, peptide or fusion protein chemicals, still more preferably less than about 10% chemical precursors or non-antibody, polypeptide, peptide or fusion protein chemicals, and most preferably less than about 5% chemical precursors or non-antibody, polypeptide, peptide or fusion protein chemicals.

The term “activity” when used in connection with proteins or protein complexes means any physiological or biochemical activities displayed by or associated with a particular protein or protein complex including but not limited to activities exhibited in biological processes and cellular functions, ability to interact with or bind another molecule or a moiety thereof, binding affinity or specificity to certain molecules, in vitro or in vivo stability (e.g., protein degradation rate, or in the case of protein complexes ability to maintain the form of protein complex), antigenicity and immunogenecity, enzymatic activities, etc. Such activities may be detected or assayed by any of a variety of suitable methods as will be apparent to skilled artisans.

As used herein, the term “interaction antagonist” means a compound that interferes with, blocks, disrupts or destabilizes a protein-protein interaction; blocks or interferes with the formation of a protein complex, or destabilizes, disrupts or dissociates an existing protein complex.

The term “interaction agonist” as used herein means a compound that triggers, initiates, propagates, nucleates, or otherwise enhances the formation of a protein protein interaction; triggers, initiates, propagates, nucleates, or otherwise enhances the formation of a protein complex; or stabilizes an existing protein complex.

The terms “polypeptides” and “proteins” are, where applicable, used interchangeably herein. They may be chemically modified, e.g. post-translationally modified. For example, they may be glycosylated or comprise modified amino acid residues. They may also be modified by the addition of a signal sequence to promote their secretion from a cell where the polypeptide does not naturally contain such a sequence. They may be tagged with a tag. They may be tagged with different labels which may assists in identification of the proteins in a protein complex. Polypeptides/proteins for use in the invention may be in a substantially isolated form. It will be understood that the polypeptide/protein may be mixed with carriers or diluents which will not interfere with the intended purpose of the polypeptide and still be regarded as substantially isolated. A polypeptide/protein for use in the invention may also be in a substantially purified form, in which case it will generally comprise the polypeptide in a preparation in which more than 50%, e.g. more than 80%, 90%, 95% or 99%, by weight of the polypeptide in the preparation is a polypeptide of the invention.

The terms “hybrid protein”, “hybrid polypeptide,” “hybrid peptide”, “fusion protein”, “fusion polypeptide”, and “fusion peptide” are used herein interchangeably to mean a non-naturally occurring protein having a specified polypeptide molecule covalently linked to one or more polypeptide molecules that do not naturally link to the specified polypeptide. Thus, a “hybrid protein” may be two naturally occurring proteins or fragments thereof linked together by a covalent linkage. A “hybrid protein” may also be a protein formed by covalently linking two artificial polypeptides together. Typically but not necessarily, the two or more polypeptide molecules are linked or fused together by a peptide bond forming a single non-branched polypeptide chain.

The term “tag” as used herein is meant to be understood in its broadest sense and to include, but is not limited to any suitable enzymatic, fluorescent, or radioactive labels and suitable epitopes, including but not limited to HA-tag, Myc-tag, T7, His-tag, FLAG-tag, Calmodulin binding proteins, glutathione-S-transferase, strep-tag, KT3-epitope, EEF-epitopes, green-fluorescent protein and variants thereof.

The term “SWI/SNF complex” refers to SWItch/Sucrose Non-Fermentable, a nucleosome remodeling complex found in both eukaryotes and prokaryotes (Neigeborn Carlson (1984) *Genetics* 108:845-858; Stern et al. (1984) *J. Mol. Biol.* 178:853-868). The SWI/SNF complex was first discovered in the yeast, *Saccharomyces cerevisiae*, named after yeast mating types switching (SWI) and sucrose nonfermenting (SNF) pathways (Workman and Kingston (1998) *Annu Rev Biochem.* 67:545-579; Sudarsanam and Winston (2000) *Trends Genet.* 16:345-351). It is a group of proteins comprising, at least, SWI1, SWI2/SNF2, SWI3, SWI5, and SWI6, as well as other polypeptides (Pazin and Kadonaga (1997) *Cell* 88:737-740). A genetic screening for suppressive mutations of the SWI/SNF phenotypes identified different histones and chromatin components, suggesting that these proteins were possibly involved in histone binding and chromatin organization (Winston and Carlson (1992) *Trends Genet.* 8:387-391). Biochemical purification of the SWI/SNF2p in *S. cerevisiae* demonstrated that this protein was part of a complex containing an additional 11 polypeptides, with a combined molecular weight over 1.5 MDa. The SWI/SNF complex contains the ATPase Swi2/Snf2p, two actin-related proteins (Arp7p and Arp9) and other subunits involved in DNA and protein-protein interactions. The purified SWI/SNF complex was able to alter the nucleosome structure in an ATP-dependent manner (Workman and Kingston (1998), supra; Vignali et al. (2000) *Mol Cell Biol.* 20:1899-1910). The structures of the SWI/SNF and RSC complexes are highly conserved but not identical, reflecting an increasing complexity of chromatin (e.g., an increased genome size, the presence of DNA methylation, and more complex genetic organization) through evolution. For this reason, the SWI/SNF complex in higher eukaryotes maintains core components, but also substitute or add on other components with more specialized or tissue-specific domains. Yeast contains two distinct and similar remodeling complexes, SWI/SNF and RSC (Remodeling the Structure of Chromatin). In Drosophila, the two complexes are called BAP (Brahma Associated Protein) and PBAP (Polybromo-associated BAP) complexes. The human analogs are BAF (Brg1 Associated Factors, or SWI/SNF-A) and PBAF (Polybromo-associated BAF, or SWI/SNF-B). As shown in FIG. 9, the BAF complex comprises, at least, BAF250A (ARID1A), BAF250B (ARID1B), BAF57 (SMARCE1), BAF190/BRM (SMARCA2), BAF47 (SMARCB1), BAF53A (ACTL6A), BRG1/BAF190 (SMARCA4), BAF155 (SMARCC1), and BAF170 (SMARCC2). The PBAF complex comprises, at last, BAF200 (ARID2), BAF180 (PBRM1), BRD7, BAF45A (PHF10), BRG1/BAF190 (SMARCA4), BAF155 (SMARCC1), and BAF170 (SMARCC2). As in Drosophila, human BAF and PBAF share the different core components BAF47, BAF57, BAF60, BAF155, BAF170, BAF45 and the two actins b-Actin and BAF53 (Mohrmann and Verrijzer (2005) *Biochim Biophys Acta.* 1681:59-73). The central core of the BAF and PBAF is the ATPase catalytic subunit BRG1/hBRM, which contains multiple domains to bind to other protein subunits and acetylated histones. For a summary of different complex subunits and their domain structure, see Tang et al. (2010) *Prog Biophys Mol Biol.* 102:122-128 (e.g., FIG. 3), Hohmann and Vakoc (2014) *Trends Genet.* 30:356-363 (e.g., FIG. 1), and Kadoch and Crabtree (2015) *Sci. Adv.* 1: e1500447. For chromatin remodeling, the SWI/SNF complex use the energy of ATP hydrolysis to slide the DNA around the nucleosome. The first step consists in the binding between the remodeler and the nucleosome. This binding occurs with nanomolar affinity and reduces the digestion of nucleosomal DNA by nucleases. The 3-D structure of the yeast RSC complex was first solved and imaged using negative stain electron microscopy (Asturias et al. (2002) *Proc Natl Acad Sci USA* 99:13477-13480). The first Cryo-EM structure of the yeast SWI/SNF complex was published in 2008 (Dechassa et al. 2008). DNA footprinting data showed that the SWI/SNF complex makes close contacts with only one gyre of nucleosomal DNA. Protein crosslinking showed that the ATPase SWI2/SNF2p and Swi5p (the homologue of Ini1p in human), Snf6, Swi29, Snf11 and Sw82p (not conserved in human) make close contact with the histones. Several individual SWI/SNF subunits are encoded by gene families, whose protein products are mutually exclusive in the complex (Wu et al. (2009) *Cell* 136: 200-206). Thus, only one paralog is incorporated in a given SWI/SNF assembly. The only exceptions are BAF155 and BAF170, which are always present in the complex as homo- or hetero-dimers.

Combinatorial association of SWI/SNF subunits could in principle give rise to hundreds of distinct complexes, although the exact number has yet to be determined (Wu et al. (2009), supra). Genetic evidence suggests that distinct subunit configurations of SWI/SNF are equipped to perform specialized functions. As an example, SWI/SNF contains one of two ATPase subunits, BRG1 or BRM/SMARCA2, which share 75% amino acid sequence identity (Khavari et al. (1993) *Nature* 366:170-174). While in certain cell types BRG1 and BRM can compensate for loss of the other subunit, in other contexts these two ATPases perform divergent functions (Strobeck et al. (2002) *J Biol Chem.* 277: 4782-4789; Hoffman et al. (2014) *Proc Natl Acad Sci USA.* 111: 3128-3133). In some cell types, BRG1 and BRM can even functionally oppose one another to regulate differentiation (Flowers et al. (2009) *J Biol Chem.* 284:10067-10075). The functional specificity of BRG1 and BRM has been linked to sequence variations near their N-terminus, which have different interaction specificities for transcription factors (Kadam and Emerson (2003) *Mol Cell.* 11:377-389). Another example of paralogous subunits that form mutually exclusive SWI/SNF complexes are ARID1A/BAF250A, ARID1B/BAF250B, and ARID2/BAF200. ARID1A and ARID1B share 60% sequence identity, but yet can perform opposing functions in regulating the cell cycle, with MYC being an important downstream target of each paralog (Nagl et al. (2007) *EMBO J.* 26:752-763). ARID2 has diverged considerably from ARID1A/ARID1B and exists in a unique SWI/SNF assembly known as PBAF (or SWI/SNF-B), which contains several unique subunits not found in ARID1A/B-containing complexes. The composition of SWI/SNF can also be dynamically reconfigured during cell fate transitions through cell type-specific expression patterns of certain subunits. For example, BAF53A/ACTL6A is repressed and replaced by BAF53B/ACTL6B during neuronal differentiation, a switch that is essential for proper neuronal functions in vivo (Lessard et al. (2007) *Neuron* 55:201-215). These studies stress that SWI/SNF in fact represents a collection of multi-subunit complexes whose integrated functions control diverse cellular processes, which is also incorporated in the scope of definitions of the instant disclosure. Two recently published meta-analyses of cancer genome sequencing data estimate that nearly 20% of human cancers harbor mutations in one (or more) of the genes encoding SWI/SNF (Kadoch et al. (2013) *Nat Genet.* 45:592-601; Shain and Pollack (2013) *PLOS One.* 8: e55119). Such mutations are generally loss-of-function, implicating SWI/SNF as a major tumor suppressor in diverse cancers. Specific SWI/SNF gene mutations are generally linked to a specific subset of cancer lineages: SNF5 is mutated in malignant rhabdoid tumors (MRT), PBRM1/BAF180 is frequently inactivated in renal carcinoma, and BRG1 is mutated in non-small cell lung cancer (NSCLC) and several other cancers. In the instant disclosure, the scope of “SWI/SNF complex” may cover at least one fraction or the whole complex (e.g., some or all subunit proteins/other components), either in the human BAF/PBAF forms or their homologs/orthologs in other species (e.g., the yeast and drosophila forms described herein). Preferably, a “SWI/SNF complex” described herein contains at least part of the full complex bio-functionality, such as binding to other subunits/components, binding to DNA/histone, catalyzing ATP, promoting chromatin remodeling, etc.

The term “BAF complex” refers to at least one type of mammalian SWI/SNF complexes. Its nucleosome remodeling activity can be reconstituted with a set of four core subunits (BRG1/SMARCA4, SNF5/SMARCB1, BAF155/SMARCC1, and BAF170/SMARCC2), which have orthologs in the yeast complex (Phelan et al. (1999) *Mol Cell.* 3:247-253). However, mammalian SWI/SNF contains several subunits not found in the yeast counterpart, which can provide interaction surfaces for chromatin (e.g. acetyl-lysine recognition by bromodomains) or transcription factors and thus contribute to the genomic targeting of the complex (Wang et al. (1996) *EMBO J.* 15:5370-5382; Wang et al. (1996) *Genes Dev.* 10:2117-2130; Nie et al. (2000)). A key attribute of mammalian SWI/SNF is the heterogeneity of subunit configurations that can exist in different tissues and even in a single cell type (e.g., as BAF, PBAF, neural progenitor BAF (npBAF), neuron BAF (nBAF), embryonic stem cell BAF (esBAF), etc.). In some embodiments, the BAF complex described herein refers to one type of mammalian SWI/SNF complexes, which is different from PBAF complexes.

The term “PBAF complex” refers to one type of mammalian SWI/SNF complexes originally known as SWI/SNF-B. It is highly related to the BAF complex and can be separated with conventional chromatographic approaches. For example, human BAF and PBAF complexes share multiple identical subunits (such as BRG, BAF170, BAF155, BAF60, BAF57, BAF53, BAF45, actin, SS18, and hSNF5/INI1). However, while BAF contains BAF250 subunit, PBAF contains BAF180 and BAF200, instead (Lemon et al. (2001) *Nature* 414:924-998; Yan et al. (2005) *Genes Dev.* 19:1662-1667). Moreover, they do have selectivity in regulating interferon-responsive genes (Yan et al. (2005), supra, showing that BAF200, but not BAF180, is required for PBAF to mediate expression of IFITM1 gene induced by IFN-$\alpha$, while the IFITM3 gene expression is dependent on BAF but not PBAF). Due to these differences, PBAF, but not BAF, was able to activate vitamin D receptor-dependent transcription on a chromatinzed template in vitro (Lemon et al. (2001), supra). The 3-D structure of human PBAF complex preserved in negative stain was found to be similar to yeast RSC but dramatically different from yeast SWI/SNF (Leschziner et al. (2005) *Structure* 13:267-275).

The term “BRG” or “BRG1/BAF190 (SMARCA4)” refers to a subunit of the SWI/SNF complex, which can be find in either BAF or PBAF complex. It is an ATP-dependent helicase and a transcription activator, encoded by the SMARCA4 gene. BRG1 can also bind BRCA1, as well as regulate the expression of the tumorigenic protein CD44. BRG1 is important for development past the pre-implantation stage. Without having a functional BRG1, exhibited with knockout research, the embryo will not hatch out of the zona pellucida, which will inhibit implantation from occurring on the endometrium (uterine wall). BRG1 is also crucial to the development of sperm. During the first stages of meiosis in spermatogenesis there are high levels of BRG1. When BRG1 is genetically damaged, meiosis is stopped in prophase 1, hindering the development of sperm and would result in infertility. More knockout research has concluded BRG1’s aid in the development of smooth muscle. In a BRG1 knockout, smooth muscle in the gastrointestinal tract lacks contractility, and intestines are incomplete in some cases. Another defect occurring in knocking out BRG1 in smooth muscle development is heart complications such as an open ductus arteriosus after birth (Kim et al. (2012) *Development* 139:1133-1140; Zhang et al. (2011) *Mol. Cell. Biol.* 31:2618-2631). Mutations in SMARCA4 were first recognized in human lung cancer cell lines (Medina et al. (2008) *Hum. Mut.* 29:617-622). Later it was recognized that mutations exist in a significant frequency of medulloblastoma and pancreatic cancers among other tumor subtypes (Jones et al. (2012) *Nature* 488:100-105; Shain et al. (2012) *Proc Natl Acad Sci USA* 109: E252-E259; Shain and Pollack (2013), supra). Mutations in BRG1 (or SMARCA4) appear to be mutually exclusive with the presence of activation at any of the MYC-genes, which indicates that the BRG1 and MYC proteins are functionally related. Another recent study demonstrated a causal role of BRG1 in the control of retinoic acid and glucocorticoid-induced cell differentiation in lung cancer and in other tumor types. This enables the cancer cell to sustain undifferentiated gene expression programs that affect the control of key cellular processes. Furthermore, it explains why lung cancer and other solid tumors are completely refractory to treatments based on these compounds that are effective therapies for some types of leukemia (Romero et al. (2012) *EMBO Mol. Med.* 4:603-616). The role of BRG1 in sensitivity or resistance to anti-cancer drugs had been recently highlighted by the elucidation of the mechanisms of action of darinaparsin, an arsenic-based anti-cancer drugs. Darinaparsin has been shown to induce phosphorylation of BRG1, which leads to its exclusion from the chromatin. When excluded from the chromatin, BRG1 can no longer act as a transcriptional co-regulator. This leads to the inability of cells to express HO-1, a cytoprotective enzyme. BRG1 has been shown to interact with proteins such as ACTL6A, ARID1A, ARID1B, BRCA1, CTNNB1, CBX5, CREBBP, CCNE1, ESR1, FANCA, HSP90B1, ING1, Myc, NR3C1, P53, POLR2A, PHB, SIN3A, SMARCB1, SMARCC1, SMARCC2, SMARCE1, STAT2, STK11, etc.

The term “BRG” or “BRG1/BAF190 (SMARCA4)” is intended to include fragments, variants (e.g., allelic variants), and derivatives thereof. Representative human BRG1 (SMARCA4) cDNA and human BRG1 protein sequences are well-known in the art and are publicly available from the National Center for Biotechnology Information (NCBI). For example, seven different human BRG1 isoforms are known. Human BRG1 isoform A (NP_001122321.1) is encodable by the transcript variant 1 (NM_001128849.1), which is the longest transcript. Human BRG1 isoform B (NP_001122316.1 or NP_003063.2) is encodable by the transcript variant 2 (NM_001128844.1), which differs in the 5' UTR and lacks an alternate exon in the 3' coding region, compared to the variant 1, and also by the transcript variant 3 (NM_003072.3), which lacks an alternate exon in the 3' coding region compared to variant 1. Human BRG1 isoform C (NP_001122317.1) is encodable by the transcript variant 4 (NM_001128845.1), which lacks two alternate in-frame exons and uses an alternate splice site in the 3' coding region, compared to variant 1. Human BRG1 isoform D (NP_001122318.1) is encodable by the transcript variant 5 (NM_001128846.1), which lacks two alternate in-frame exons and uses two alternate splice sites in the 3' coding region, compared to variant 1. Human BRG1 isoform E (NP_001122319.1) is encodable by the transcript variant 6 (NM_001128847.1), which lacks two alternate in-frame exons in the 3' coding region, compared to variant 1. Human BRG1 isoform F (NP_001122320.1) is encodable by the transcript variant 7 (NM_001128848.1), which lacks two alternate in-frame exons and uses an alternate splice site in the 3' coding region, compared to variant 1. Nucleic acid and polypeptide sequences of BRG1 orthologs in organisms other than humans are well known and include, for example, chimpanzee BRG1 (XM_016935029.1 and XP_016790518.1, XM_016935038.1 and XP_016790527.1, XM_016935039.1 and XP_016790528.1, XM_016935036.1 and XP_016790525.1, XM_016935037.1 and XP_016790526.1, XM_016935041.1 and XP_016790530.1, XM_016935040.1 and XP_016790529.1, XM_016935042.1 and XP_016790531.1, XM_016935043.1 and XP_016790532.1, XM_016935035.1 and XP_016790524.1, XM_016935032.1 and XP_016790521.1, XM_016935033.1 and XP_016790522.1, XM_016935030.1 and XP_016790519.1, XM_016935031.1 and XP_016790520.1, and XM_016935034.1 and XP_016790523.1), Rhesus monkey BRG1 (XM_015122901.1 and XP_014978387.1, XM_015122902.1 and XP_014978388.1, XM_015122903.1 and XP_014978389.1, XM_015122906.1 and XP_014978392.1, XM_015122905.1 and XP_014978391.1, XM_015122904.1 and XP_014978390.1, XM_015122907.1 and XP_014978393.1, XM_015122909.1 and XP_014978395.1, and XM_015122910.1 and XP_014978396.1), dog BRG1 (XM_014122046.1 and XP_013977521.1, XM_014122043.1 and XP_013977518.1, XM_014122042.1 and XP_013977517.1, XM_014122041.1 and XP_013977516.1, XM_014122045.1 and XP_013977520.1, and XM_014122044.1 and XP_013977519.1), cattle BRG1 (NM_001105614.1 and NP_001099084.1), rat BRG1 (NM_134368.1 and NP_599195.1).

Anti-BRG1 antibodies suitable for detecting BRG1 protein are well-known in the art and include, for example, MABE1118, MABE121, MABE60, and 07-478 (poly- and mono-clonal antibodies from EMD Millipore, Billerica, MA), AM26021PU-N, AP23972PU-N, TA322909, TA322910, TA327280, TA347049, TA347050, TA347851, and TA349038 (antibodies from OriGene Technologies, Rockville, MD), NB100-2594, AF5738, NBP2-22234, NBP2-41270, NBP1-51230, and NBP1-40379 (antibodes from Novus Biologicals, Littleton, CO), ab110641, ab4081, ab215998, ab 108318, ab 70558, ab118558, ab 133257, ab92496, ab 196535, and ab 196315 (antibodies from AbCam, Cambridge, MA), Cat #: 720129, 730011, 730051, MA1-10062, PA5-17003, and PA5-17008 (antibodies from ThermoFisher Scientific, Waltham, MA), GTX633391, GTX32478, GTX31917, GTX16472, and GTX50842 (antibodies from GeneTex, Irvine, CA), antibody 7749 (ProSci, Poway, CA), Brg-1 (N-15), Brg-1 (N-15) X, Brg-1 (H-88), Brg-1 (H-88) X, Brg-1 (P-18), Brg-1 (P-18) X, Brg-1 (G-7), Brg-1 (G-7) X, Brg-1 (H-10), and Brg-1 (H-10) X (antibodies from Santa Cruz Biotechnology, Dallas, TX), antibody of Cat. AF5738 (R&D Systmes, Minneapolis, MN), etc. In addition, reagents are well-known for detecting BRG1 expression. Moreover, mutilple siRNA, shRNA, CRISPR constructs for reducing BRG1 Expression can be found in the commercial product lists of the above-referenced companies. PFI 3 is a known small molecule inhibitor of polybromo 1 and BRG1 (e.g., Cat. B7744 from APExBIO, Houston, TX). It is to be noted that the term can further be used to refer to any combination of features described herein regarding BRG1 molecules. For example, any combination of sequence composition, percentage identify, sequence length, domain structure, functional activity, etc. can be used to describe an BRG1 molecule encompassed by the present invention.

The term “BRM” or “BRM/BAF190 (SMARCA2)” refers to a subunit of the SWI/SNF complex, which can be found in either BAF or PBAF complexes. It is an ATP-dependent helicase and a transcription activator, encoded by the SMARCA2 gene. The catalytic core of the SWI/SNF complex can be either of two closely related ATPases, BRM or BRG1, with the potential that the choice of alternative subunits is a key determinant of specificity. Instead of impeding differentiation as was seen with BRG1 depletion, depletion of BRM caused accelerated progression to the differentiation phenotype. BRM was found to regulate genes different from those as BRG1 targets and be capable of overriding BRG1-dependent activation of the osteocalcin promoter, due to its interaction with different ARID family members (Flowers et al. (2009), supra). The known binding partners for BRM include, for example, ACTL6A, ARID1B, CEBPB, POLR2A, Prohibitin, SIN3A, SMARCB1, and SMARCC1.

The term “BRM” or “BRM/BAF190 (SMARCA2)” is intended to include fragments, variants (e.g., allelic variants), and derivatives thereof. Representative human BRM (SMARCA2) cDNA and human BRM protein sequences are well-known in the art and are publicly available from the National Center for Biotechnology Information (NCBI). For example, seven different human BRM isoforms are known. Human BRM (SMARCA2) isoform A (NP_003061.3 or NP_001276325.1) is encodable by the transcript variant 1 (NM_003070.4), which is the longest transcript, or the transcript variant 3 (NM_001289396.1), which differs in the 5' UTR, compared to variant 1. Human BRM (SMARCA2) isoform B (NP_620614.2) is encodable by the transcript variant 2 (NM_139045.3), which lacks an alternate in-frame exon in the coding region, compared to variant 1. Human BRM (SMARCA2) isoform C (NP_001276326.1) is encodable by the transcript variant 4 (NM_001289397.1), which uses an alternate in-frame splice site and lacks an alternate in-frame exon in the 3' coding region, compared to variant 1. Human BRM (SMARCA2) isoform D (NP_001276327.1) is encodable by the transcript variant 5 (NM_001289398.1), which differs in the 5' UTR, lacks a portion of the 5' coding region, and initiates translation at an alternate downstream start codon, compared to variant 1. Human BRM (SMARCA2) isoform E (NP_001276328.1) is encodable by the transcript variant 6 (NM_001289399.1), which differs in the 5' UTR, lacks a portion of the 5' coding region, and initiates translation at an alternate downstream start codon, compared to variant 1. Human BRM (SMARCA2) isoform F (NP_001276329.1) is encodable by the transcript variant 7 (NM_001289400.1), which differs in the 5' UTR, lacks a portion of the 5' coding region, and initiates translation at an alternate downstream start codon, compared to variant 1. Nucleic acid and polypeptide sequences of BRM orthologs in organisms other than humans are well known and include, for example, chimpanzee BRM (XM_016960529.2 and XP_016816018.2), dog BRM (XM_005615906.3 and XP_005615963.1, XM_845066.5 and XP_850159.1, XM_005615905.3 and XP_005615962.1, XM_022421616.1 and XP_022277324.1, XM_005615903.3 and XP_005615960.1, and XM_005615902.3 and XP_005615959.1), cattle BRM (NM_001099115.2 and NP_001092585.1), mouse BRM (NM_011416.2 and NP_035546.2, NM_026003.2 and NP_080279.1, and NM_001347439.1 and NP_001334368.1), rat BRM (NM_001004446.1 and NP_001004446.1), chicken BRM (NM_205139.1 and NP_990470.1), and zebrafish BRM (NM_001044775.2 and NP_001038240.1). Representative sequences of BRM (SMARCA2) orthologs are presented below in Table 1.

Anti-BRM antibodies suitable for detecting BRM protein are well-known in the art and include, for example, antibody MABE89 (EMD Millipore, Billerica, MA), antibody TA351725 (OriGene Technologies, Rockville, MD), NBP1-90015, NBP1-80042, NB100-55308, NB100-55309, NB100-55307, and H00006595-M06 (antibodes from Novus Biologicals, Littleton, CO), ab15597, ab12165, ab58188, and ab200480 (antibodies from AbCam, Cambridge, MA), Cat #: 11966 and 6889 (antibodies from Cell Signaling, Danvers, MA), etc. In addition, reagents are well-known for detecting BRM expression. Multiple clinical tests of SMARCA2 are available in NIH Genetic Testing Registry (GTR®) (e.g., GTR Test ID: GTR000517266.2, offered by Fulgent Clinical Diagnostics Lab (Temple City, CA)). Moreover, multiple siRNA, shRNA, CRISPR constructs for reducing BRM Expression can be found in the commercial product lists of the above-referenced companies. For example, BRM RNAi product H00006595-R02 (Novus Biologicals), siRNA products #sc-29831 and sc-29834 and CRISPR product #sc-401049-KO-2 from Santa Cruz Biotechnology, RNAi products SR304470 and TL301508V, and CRISPR product KN215950 (Origene), and multiple CRISPR products from GenScript (Piscataway, NJ). It is to be noted that the term can further be used to refer to any combination of features described herein regarding BRM molecules. For example, any combination of sequence composition, percentage identify, sequence length, domain structure, functional activity, etc. can be used to describe an BRM molecule encompassed by the present invention.

The term "BAF250A" or "ARID1A" refers to AT-rich interactive domain-containing protein 1A, a subunit of the SWI/SNF complex, which can be find in BAF but not PBAF complex. In humans there are two BAF250 isoforms, BAF250A/ARID1A and BAF250B/ARID1B. They are thought to be E3 ubiquitin ligases that target histone H2B (Li et al. (2010) *Mol. Cell. Biol.* 30:1673-1688). ARID1A is highly expressed in the spleen, thymus, prostate, testes, ovaries, small intestine, colon and peripheral leukocytes. ARID1A is involved in transcriptional activation and repression of select genes by chromatin remodeling. It is also involved in vitamin D-coupled transcription regulation by associating with the WINAC complex, a chromatin-remodeling complex recruited by vitamin D receptor. ARID1A belongs to the neural progenitors-specific chromatin remodeling (npBAF) and the neuron-specific chromatin remodeling (nBAF) complexes, which are involved in switching developing neurons from stem/progenitors to post-mitotic chromatin remodeling as they exit the cell cycle and become committed to their adult state. ARID1A also plays key roles in maintaining embryonic stem cell pluripotency and in cardiac development and function (Lei et al. (2012) *J. Biol. Chem.* 287:24255-24262; Gao et al. (2008) *Proc. Natl. Acad. Sci. U.S.A.* 105:6656-6661). Loss of BAF250a expression was seen in 42% of the ovarian clear cell carcinoma samples and 21% of the endometrioid carcinoma samples, compared with just 1% of the high-grade serous carcinoma samples. ARID1A deficiency also impairs the DNA damage checkpoint and sensitizes cells to PARP inhibitors (Shen et al. (2015) *Cancer Discov.* 5:752-767). Human ARID1A protein has 2285 amino acids and a molecular mass of 242045 Da, with at least a DNA-binding domain that can specifically bind an AT-rich DNA sequence, recognized by a SWI/SNF complex at the beta-globin locus, and a C-terminus domain for glucocorticoid receptor-dependent transcriptional activation. ARID1A has been shown to interact with proteins such as SMARCB1/BAF47 (Kato et al. (2002) *J. Biol. Chem.* 277:5498-505; Wang et al. (1996) *EMBO*) *J.* 15:5370-5382) and SMARCA4/BRG1 (Wang et al. (1996), supra; Zhao et al. (1998) *Cell* 95:625-636), etc.

The term "BAF250A" or "ARID1A" is intended to include fragments, variants (e.g., allelic variants), and derivatives thereof. Representative human BAF250A (ARID1A) cDNA and human BAF250A (ARID1A) protein sequences are well-known in the art and are publicly available from the National Center for Biotechnology Information (NCBI). For example, two different human ARID1A isoforms are known. Human ARID1A isoform A (NP_006006.3) is encodable by the transcript variant 1 (NM_006015.4), which is the longer transcript. Human ARID1A isoform B (NP_624361.1) is encodable by the transcript variant 2 (NM_139135.2), which lacks a segment in the coding region compared to variant 1. Isoform B thus lacks an internal segment, compared to isoform A. Nucleic acid and polypeptide sequences of ARID1A orthologs in organisms other than humans are well known and include, for example, chimpanzee ARID1A (XM_016956953.1 and XP_016812442.1, XM_016956958.1 and XP_016812447.1, and XM_009451423.2 and XP_009449698.2), Rhesus monkey ARID1A (XM_015132119.1 and XP_014987605.1, and XM_015132127.1 and XP_014987613.1), dog ARID1A (XM_847453.5 and XP_852546.3, XM_005617743.2 and XP_005617800.1, XM_005617742.2 and XP_005617799.1, XM_005617744.2 and XP_005617801.1, XM_005617746.2 and XP_005617803.1, and XM_005617745.2 and XP_005617802.1), cattle ARID1A (NM_001205785.1 and NP_001192714.1), rat ARID1A (NM_001106635.1 and NP_001100105.1).

Anti-ARID1A antibodies suitable for detecting ARID1A protein are well-known in the art and include, for example, antibody Cat #04-080 (EMD Millipore, Billerica, MA), antibodies TA349170, TA350870, and TA350871 (OriGene Technologies, Rockville, MD), antibodies NBP1-88932, NB100-55334, NBP2-43566, NB100-55333, and H00008289-Q01 (Novus Biologicals, Littleton, CO), antibodies ab182560, ab182561, ab176395, and ab97995 (AbCam, Cambridge, MA), antibodies Cat #: 12354 and 12854 (Cell Signaling Technology, Danvers, MA), antibodies GTX129433, GTX129432, GTX632013, GTX12388, and GTX31619 (GeneTex, Irvine, CA), etc. In addition, reagents are well-known for detecting ARID1A expression. For example, multiple clinical tests for ARID1A are available at NIH Genetic Testing Registry (GTR®) (e.g., GTR Test ID: GTR000520952.1 for mental retardation, offered by Centogene AG, Germany). Moreover, multiple siRNA, shRNA, CRISPR constructs for reducing ARID1A Expression can be found in the commercial product lists of the above-referenced companies, such as RNAi products H00008289-R01, H00008289-R02, and H00008289-R03 (Novus Biologicals) and CRISPR products KN301547G1 and KN301547G2 (Origene). Other CRISPR products include sc-400469 (Santa Cruz Biotechnology) and those from GenScript (Piscataway, NJ). It is to be noted that the term can further be used to refer to any combination of features described herein regarding ARID1A molecules. For example, any combination of sequence composition, percentage identify, sequence length, domain structure, functional activity, etc. can be used to describe an ARID1A molecule encompassed by the present invention.

The term "loss-of-function mutation" for BAF250A/ARID1A refers to any mutation in an ARID1A-related nucleic acid or protein that results in reduced or eliminated ARID1A protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of ARID1A. Such mutations reduce or eliminate ARID1A protein amounts and/or function by eliminating proper coding sequences required for proper ARID1A protein translation and/or coding for ARID1A proteins that are non-functional or have reduced function (e.g., deletion of enzymatic and/or structural domains, reduction in protein stability, alteration of sub-cellular localization, and the like). Such mutations are well-known in the art. In addition, a representative list describing a wide variety of structural mutations correlated with the functional result of reduced or eliminated ARID1A protein amounts and/or function is described in the Tables and the Examples.

The term "BAF250B" or "ARID1B" refers to AT-rich interactive domain-containing protein 1B, a subunit of the SWI/SNF complex, which can be find in BAF but not PBAF complex. ARID1B and ARID1A are alternative and mutually exclusive ARID-subunits of the SWI/SNF complex. Germline mutations in ARID1B are associated with Coffin-Siris syndrome (Tsurusaki et al. (2012) *Nat. Genet.* 44:376-378; Santen et al. (2012) *Nat. Genet.* 44:379-380). Somatic mutations in ARID1B are associated with several cancer subtypes, suggesting that it is a tumor suppressor gene (Shai and Pollack (2013) *PLOS ONE* 8: e55119; Sausen et al. (2013) *Nat. Genet.* 45:12-17; Shain et al. (2012) *Proc. Natl. Acad. Sci. U.S.A.* 109: E252-E259; Fujimoto et al. (2012) *Nat. Genet.* 44:760-764). Human ARID1A protein has 2236 amino acids and a molecular mass of 236123 Da, with at least a DNA-binding domain that can specifically bind an AT-rich DNA sequence, recognized by a SWI/SNF complex at the beta-globin locus, and a C-terminus domain for glucocorticoid receptor-dependent transcriptional activation. ARID1B has been shown to interact with SMARCA4/BRG1 (Hurlstone et al. (2002) *Biochem. J.* 364:255-264; Inoue et al. (2002). J. *Biol. Chem.* 277:41674-41685 and SMARCA2/BRM (Inoue et al. (2002), supra).

The term "BAF250B" or "ARID1B" is intended to include fragments, variants (e.g., allelic variants), and derivatives thereof. Representative human BAF250B (ARID1B) cDNA and human BAF250B (ARID1B) protein sequences are well-known in the art and are publicly available from the National Center for Biotechnology Information (NCBI). For example, three different human ARID1B isoforms are known. Human ARID1B isoform A (NP_059989.2) is encodable by the transcript variant 1 (NM_017519.2). Human ARID1B isoform B (NP_065783.3) is encodable by the transcript variant 2 (NM_020732.3). Human ARID1B isoform C (NP_001333742.1) is encodable by the transcript variant 3 (NM_001346813.1). Nucleic acid and polypeptide sequences of ARID1B orthologs in organisms other than humans are well known and include, for example, Rhesus monkey ARID1B (XM_015137088.1 and XP_014992574.1), dog ARID1B (XM_014112912.1 and XP_013968387.1), cattle ARID1B (XM_010808714.2 and XP_010807016.1, and XM_015464874.1 and XP_015320360.1), rat ARID1B (XM_017604567.1 and XP_017460056.1).

Anti-ARID1B antibodies suitable for detecting ARID1B protein are well-known in the art and include, for example, antibody Cat #ABE316 (EMD Millipore, Billerica, MA), antibody TA315663 (OriGene Technologies, Rockville, MD), antibodies H00057492-M02, H00057492-M01, NB100-57485, NBP1-89358, and NB100-57484 (Novus Biologicals, Littleton, CO), antibodies ab57461, ab69571, ab84461, and ab 163568 (AbCam, Cambridge, MA), antibodies Cat #: PA5-38739, PA5-49852, and PA5-50918 (ThermoFisher Scientific, Danvers, MA), antibodies GTX130708, GTX60275, and GTX56037 (GeneTex, Irvine, CA), ARID1B (KMN1) Antibody and other antibodies (Santa Cruz Biotechnology), etc. In addition, reagents are well-known for detecting ARID1B expression. For example, multiple clinical tests for ARID1B are available at NIH Genetic Testing Registry (GTRR) (e.g., GTR Test ID: GTR000520953.1 for mental retardation, offered by Centogene AG, Germany). Moreover, multiple siRNA, shRNA, CRISPR constructs for reducing ARID1B Expression can be found in the commercial product lists of the above-referenced companies, such as RNAi products H00057492-R03, H00057492-R01, and H00057492-R02 (Novus Biologicals) and CRISPR products KN301548 and KN214830 (Origene). Other CRISPR products include sc-402365 (Santa Cruz Biotechnology) and those from GenScript (Piscataway, NJ). It is to be noted that the term can further be used to refer to any combination of features described herein regarding ARID1B molecules. For example, any combination of sequence composition, percentage identify, sequence length, domain structure, functional activity, etc. can be used to describe an ARID1B molecule encompassed by the present invention.

The term "loss-of-function mutation" for BAF250B/ARID1B refers to any mutation in an ARID1B-related nucleic acid or protein that results in reduced or eliminated ARID1B protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of ARID1B. Such mutations reduce or eliminate ARID1B protein amounts and/or function by eliminating proper coding sequences required for proper ARID1B protein translation and/or coding for ARID1B proteins that are non-functional or have reduced function (e.g., deletion of enzymatic and/or structural domains, reduction in protein stability, alteration of sub-cellular localization, and the like). Such mutations are well-known in the art. In addition, a representative list describing a wide variety of structural mutations correlated with the functional result of reduced or eliminated ARID1B protein amounts and/or function is described in the Tables and the Examples.

The term "PBRM1" or "BAF180" refers to protein Polybromo-1, which is a subunit of ATP-dependent chromatin-remodeling complexes. PBRM1 functions in the regulation of gene expression as a constituent of the evolutionary-conserved SWI/SNF chromatin remodelling complexes (Euskirchen et al. (2012) *J. Biol. Chem.* 287:30897-30905). Beside BRD7 and BAF200, PBRM1 is one of the unique components of the SWI/SNF-B complex, also known as polybromo/BRG1-associated factors (or PBAF), absent in the SWI/SNF-A (BAF) complex (Xue et al. (2000) *Proc Natl Acad Sci USA.* 97:13015-13020; Brownlee et al. (2012) *Biochem Soc Trans.* 40:364-369). On that account, and because it contains bromodomains known to mediate binding to acetylated histones, PBRM1 has been postulated to target PBAF complex to specific chromatin sites, therefore providing the functional selectivity for the complex (Xue et al. (2000), supra; Lemon et al. (2001) *Nature* 414:924-928; Brownlee et al. (2012), supra). Although direct evidence for PBRM1 involvement is lacking, SWI/SNF complexes have also been shown to play a role in DNA damage response (Park et al. (2006) *EMBO J.* 25:3986-3997). In vivo studies have shown that PBRM1 deletion leads to embryonic lethality in mice, where PBRM1 is required for mammalian cardiac chamber maturation and coronary vessel formation (Wang et al. (2004) *Genes Dev.* 18:3106-3116; Huang et al. (2008) *Dev Biol.* 319:258-266). PBRM1 mutations are most predominant in renal cell carcinomas (RCCs) and have been detected in over 40% of cases, placing PBRM1 second (after VHL) on the list of most frequently mutated genes in this cancer (Varela et al. (2011) *Nature* 469:539-542; Hakimi et al. (2013) *Eur Urol.* 63:848-854; Pena-Llopis et al. (2012) *Nat Genet.* 44:751-759; Pawlowski et al. (2013) *Int J Cancer.* 132: E11-E17). PBRM1 mutations have also been found in a smaller group of breast and pancreatic cancers (Xia et al. (2008) *Cancer Res.* 68:1667-1674; Shain et al. (2012) *Proc Natl Acad Sci USA.* 109: E252-E259; Numata et al. (2013) *Int J Oncol.* 42:403-410). PBRM1 mutations are more common in patients with advance stages (Hakimi et al. (2013), supra) and loss of PBRM1 protein expression has been associated with advanced tumour stage, low differentiation grade and worse patient outcome (Pawlowski et al. (2013), supra). In another study, no correlation between PBRM1 status and tumour grade was found (Pena-Llopis et al. (2012), supra). Although PBRM1-mutant tumours are associated with better prognosis than BAP1-mutant tumours, tumours mutated for both PBRM1 and BAP1 exhibit the greatest aggressiveness (Kapur et al. (2013) *Lancet Oncol.* 14:159-167). PBRM1 is ubiquitously expressed during mouse embryonic development (Wang et al. (2004), supra) and has been detected in various human tissues including pancreas, kidney, skeletal muscle, liver, lung, placenta, brain, heart, intestine, ovaries, testis, prostate, thymus and spleen (Xue et al. (2000), supra; Horikawa and Barrett (2002) *DNA Seq.* 13:211-215).

PBRM1 protein localises to the nucleus of cells (Nicolas and Goodwin (1996) *Gene* 175:233-240). As a component of the PBAF chromatin-remodelling complex, it associates with chromatin (Thompson (2009) *Biochimie.* 91:309-319), and has been reported to confer the localisation of PBAF complex to the kinetochores of mitotic chromosomes (Xue et al. (2000), supra). Human PBRM1 gene encodes a 1582 amino acid protein, also referred to as BAF180. Six bromodomains (BD1-6), known to recognize acetylated lysine residues and frequently found in chromatin-associated proteins, constitute the N-terminal half of PBRM1 (e.g., six BD domains at amino acid residue no. 44-156, 182-284, 383-484, 519-622, 658-762, and 775-882 of SEQ ID NO:2). The C-terminal half of PBRM1 contains two bromo-adjacent homology (BAH) domains (BAH1 and BAH2, e.g., at amino acid residue no. 957-1049 and 1130-1248 of SE ID NO: 2), present in some proteins involved in transcription regulation. High mobility group (HMG) domain is located close to the C-terminus of PBRM1 (e.g., amino acid residue no. 1328-1377 of SEQ ID NO:2). HMG domains are found in a number of factors regulating DNA-dependent processes where HMG domains often mediate interactions with DNA.

The term "PBRM1" is intended to include fragments, variants (e.g., allelic variants), and derivatives thereof. Representative human PBRM1 cDNA and human PBRM1 protein sequences are well-known in the art and are publicly available from the National Center for Biotechnology Information (NCBI). For example, two different human PBRM1 isoforms are known. Human PBRM1 transcript variant 2 (NM_181042.4) represents the longest transcript. Human PBRM1 transcript variant 1 (NM_018313.4, having a CDS from the 115-4863 nucleotide residue of SEQ ID NO:1) differs in the 5' UTR and uses an alternate exon and splice site in the 3' coding region, thus encoding a distinct protein sequence (NP_060783.3, as SEQ ID NO:2) of the same length as the isoform (NP_851385.1) encoded by variant 2. Nucleic acid and polypeptide sequences of PBRM1 orthologs in organisms other than humans are well known and include, for example, chimpanzee PBRM1 (XM_009445611.2 and XP_009443886.1, XM_009445608.2 and XP_009443883.1, XM_009445602.2 and XP_009443877.1, XM_016941258.1 and XP_016796747.1, XM_016941256.1 and XP_016796745.1, XM_016941249.1 and XP_016796738.1, XM_016941260.1 and XP_016796749.1, XM_016941253.1 and XP_016796742.1, XM_016941250.1 and XP_016796739.1, XM_016941261.1 and XP_016796750.1, XM_009445605.2 and XP_009443880.1, XM_016941252.1 and XP_016796741.1, XM_009445603.2 and XP_009443878.1, XM_016941263.1 and XP_016796752.1, XM_016941262.1 and XP_016796751.1, XM_009445604.2 and XP_009443879.1, XM_016941251.1 and XP_016796740.1, XM_016941257.1 and XP_016796746.1, XM_016941255.1 and XP_016796744.1, XM_016941254.1 and XP_016796743.1, XM_016941265.1 and XP_016796754.1, XM_016941264.1 and XP_016796753.1, XM_016941248.1 and XP_016796737.1, XM_009445617.2 and XP_009443892.1, XM_009445616.2 and XP_009443891.1, XM_009445619.2 and XP_009443894.1 XM_009445615.2 and XP_009443890.1, XM_009445618.2 and XP_009443893.1, and XM_016941266.1 and XP_016796755.1), rhesus monkey PBRM1 (XM_015130736.1 and XP_014986222.1, XM_015130739.1 and XP_014986225.1, XM_015130737.1 and XP_014986223.1, XM_015130740.1 and XP_014986226.1, XM_015130727.1 and XP_014986213.1, XM_015130726.1 and XP_014986212.1, XM_015130728.1 and XP_014986214.1, XM_015130743.1 and XP_014986229.1, XM_015130731.1 and XP_014986217.1, XM_015130745.1 and XP_014986231.1, XM_015130741.1 and XP_014986227.1, XM_015130734.1 and XP_014986220.1, XM_015130744.1 and XP_014986230.1, XM_015130748.1 and XP_014986234.1, XM_015130746.1 and XP_014986232.1, XM_015130742.1 and XP_014986228.1, XM_015130747.1 and XP_014986233.1, XM_015130730.1 and XP_014986216.1, XM_015130732.1 and XP_014986218.1, XM_015130733.1 and XP_014986219.1, XM_015130735.1 and XP_014986221.1, XM_015130738.1 and XP_014986224.1, and XM_015130725.1 and XP_014986211.1), dog PBRM1 (XM_005632441.2 and XP_005632498.1, XM_014121868.1 and XP_013977343.1, XM_005632451.2 and XP_005632508.1, XM_014121867.1 and XP_013977342.1, XM_005632440.2 and XP_005632497.1, XM_005632446.2 and XP_005632503.1, XM_533797.5 and XP_533797.4, XM_005632442.2 and XP_005632499.1, XM_005632439.2 and XP_005632496.1, XM_014121869.1 and XP_013977344.1, XM_005632448.1 and XP_005632505.1, XM_005632449.1 and XP_005632506.1, XM_005632452.1 and XP_005632509.1, XM_005632445.1 and XP_005632502.1, XM_005632450.1 and XP_005632507.1, XM_005632453.1 and XP_005632510.1, XM_014121870.1 and XP_013977345.1, XM_005632443.1 and XP_005632500.1, XM_005632444.1 and XP_005632501.1, and XM_005632447.2 and XP_005632504.1), cow PBRM1 (XM_005222983.3 and XP_005223040.1, XM_005222979.3 and XP_005223036.1, XM_015459550.1 and XP_015315036.1, XM_015459551.1 and XP_015315037.1, XM_015459548.1 and XP_015315034.1, XM_010817826.1 and XP_010816128.1, XM_010817829.1 and XP_010816131.1, XM_010817830.1 and XP_010816132.1, XM_010817823.1 and XP_010816125.1, XM_010817824.2 and XP_010816126.1, XM_010817819.2 and XP_010816121.1, XM_010817827.2 and XP_010816129.1, XM_010817828.2 and XP_010816130.1, XM_010817817.2 and XP_010816119.1, and XM_010817818.2 and XP_010816120.1), mouse PBRM1 (NM_001081251.1 and NP_001074720.1), chicken PBRM1 (NM_205165.1 and NP_990496.1), tropical clawed frog PBRM1 (XM_018090224.1 and XP_017945713.1), zebrafish PBRM1 (XM_009305786.2 and XP_009304061.1, XM_009305785.2 and XP_009304060.1, and XM_009305787.2 and XP_009304062.1), fruit fly PBRM1 (NM_143031.2 and NP_651288.1), and worm PBRM1 (NM_001025837.3 and NP_001021008.1 and NM_001025838.2 and NP_001021009.1). Representative sequences of PBRM1 orthologs are presented below in Table 1. Anti-PBRM1 antibodies suitable for detecting PBRM1 protein are well-known in the art and include, for example, ABE70 (rabbit polyclonal antibody, EMD Millipore, Billerica, MA), TA345237 and TA345238 (rabbit polyclonal antibodies, OriGene Technologies, Rockville, MD), NBP2-30673 (mouse monoclonal) and other polyclonal antibodes (Novus Biologicals, Littleton, CO), ab196022 (rabiit mAb, AbCam, Cambridge, MA), PAH437Hu01 and PAH437Hu02 (rabbit polyclonal antibodies, Cloud-Clone Corp., Houston, TX), GTX100781 (GeneTex, Irvine, CA), 25-498 (ProSci, Poway, CA), sc-367222 (Santa Cruz Biotechnology, Dallas, TX), etc. In addition, reagents are well-known for detecting PBRM1 expression (see, for example, PBRM1 Hu-Cy3 or Hu-Cy5 SmartFlare™ RNA Detection Probe (EMD Millipore). Moreover, mutilple siRNA, shRNA, CRISPR constructs for reducing PBRM1 expression can be found in the commercial product lists of the above-referenced companies. Ribavirin and PFI 3 are known PBRM1 inhibitors. It is to be noted that the term can further be used to refer to any combination of features described herein regarding PBRM1 molecules. For example, any combination of sequence composition, percentage identify, sequence length, domain structure, functional activity, etc. can be used to describe an PBRM1 molecule encompassed by the present invention.

The term “PBRM1 loss of function mutation” refers to any mutation in a PBRM1-related nucleic acid or protein that results in reduced or eliminated PBRM1 protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a “nonsynonymous mutation,” meaning that the mutation alters the amino acid sequence of PBRM1. Such mutations reduce or eliminate PBRM1 protein amounts and/or function by eliminating proper coding sequences required for proper PBRM1 protein translation and/or coding for PBRM1 proteins that are non-functional or have reduced function (e.g., deletion of enzymatic and/or structural domains, reduction in protein stability, alteration of sub-cellular localization, and the like). Such mutations are well-known in the art. In addition, a representative list describing a wide variety of structural mutations correlated with the functional result of reduced or eliminated PBRM1 protein amounts and/or function is described in Table 1 and the Examples. Without being bound by theory, it is believed that nonsense, frameshift, and splice-site mutations are particularly amenable to PBRM1 loss of function because they are known to be indicative of lack of PBRM1 expression in cell lines harboring such mutations. The term “BAF200” or “ARID2” refers to AT-rich interactive domain-containing protein 2, a subunit of the SWI/SNF complex, which can be found in PBAF but not BAF complexes. It facilitates ligand-dependent transcriptional activation by nuclear receptors. The ARID2 gene, located on chromosome 12q in humans, consists of 21 exons; orthologs are known from mouse, rat, cattle, chicken, and mosquito (Zhao et al. (2011) *Oncotarget* 2:886-891). A conditional knockout mouse line, called Arid2$^{tm1a(EUCOMM)}$ $_{Wtsi}$ was generated as part of the International Knockout Mouse Consortium program, a high-throughput mutagenesis project to generate and distribute animal models of disease (Skarnes et al. (2011) *Nature* 474:337-342). Human ARID2 protein has 1835 amino acids and a molecular mass of 197391 Da. The ARID2 protein contains two conserved C-terminal C2H2 zinc fingers motifs, a region rich in the amino acid residues proline and glutamine, a RFX (regulatory factor X)-type winged-helix DNA-binding domain (e.g., amino acids 521-601 of SEQ ID NO:8), and a conserved N-terminal AT-rich DNA interaction domain (e.g., amino acids 19-101 of SEQ ID NO: 8; Zhao et al. (2011), supra). Mutation studies have revealed ARID2 to be a significant tumor suppressor in many cancer subtypes. ARID2 mutations are prevalent in hepatocellular carcinoma (Li et al. (2011) *Nature Genetics*. 43:828-829) and melanoma (Hodis et al. (2012) *Cell* 150:251-263; Krauthammer et al. (2012) *Nature Genetics*. 44:1006-1014). Mutations are present in a smaller but significant fraction in a wide range of other tumors (Shain and Pollack (2013), supra). ARID2 mutations are enriched in hepatitis C virus-associated hepatocellular carcinoma in the U.S. and European patient populations compared with the overall mutation frequency (Zhao et al. (2011), supra). The known binding partners for ARID2 include, e.g., Serum Response Factor (SRF) and SRF cofactors MYOCD, NKX2-5 and SRFBP1.

The term "BAF200" or "ARID2" is intended to include fragments, variants (e.g., allelic variants), and derivatives thereof. ReRepresentative human ARID2 cDNA and human ARID2 protein sequences are well-known in the art and are publicly available from the National Center for Biotechnology Information (NCBI). For example, two different human ARID2 isoforms are known. Human ARID2 isoform A (NP_689854.2) is encodable by the transcript variant 1 (NM_152641.3), which is the longer transcript. Human ARID2 isoform B (NP_001334768.1) is encodable by the transcript variant 2 (NM_001347839.1), which differs in the 3' UTR and 3' coding region compared to isoform A. The encoded isoform B has a shorter C-terminus compared to isoform A. Nucleic acid and polypeptide sequences of ARID2 orthologs in organisms other than humans are well known and include, for example, chimpanzee ARID2 (XM_016923581.1 and XP_016779070.1, and XM_016923580.1 and XP_016779069.1), Rhesus monkey ARID2 (XM_015151522.1 and XP_015007008.1), dog ARID2 (XM_003433553.2 and XP_003433601.2; and XM_014108583.1 and XP_013964058.1), cattle ARID2 (XM_002687323.5 and XP_002687369.1; and XM_015463314.1 and XP_015318800.1), mouse ARID2 (NM_175251.4 and NP_780460.3), rat ARID2 (XM_345867.8 and XP_345868.4; and XM_008776620.1 and XP_008774842.1), chicken ARID2 (XM_004937552.2 and XP_004937609.1, XM_004937551.2 and XP_004937608.1, XM_004937554.2 and XP_004937611.1, and XM_416046.5 and XP_416046.2), tropical clawed frog ARID2 (XM_002932805.4 and XP_002932851.1, XM_018092278.1 and XP_017947767.1, and XM_018092279.1 and XP_017947768.1), and zebrafish ARID2 (NM_001077763.1 and NP_001071231.1, and XM_005164457.3 and XP_005164514.1). ReRepresentative sequences of ARID2 orthologs are presented below in Table 1.

Anti-ARID2 antibodies suitable for detecting ARID2 protein are well-known in the art and include, for example, antibodies ABE316 and 04-080 (EMD Millipore, Billerica, MA), antibodies NBP1-26615, NBP2-43567, and NBP1-26614 (Novus Biologicals, Littleton, CO), antibodies ab51019, ab166850, ab113283, and ab56082 (AbCam, Cambridge, MA), antibodies Cat #: PA5-35857 and PA5-51258 (ThermoFisher Scientific, Waltham, MA), antibodies GTX129444, GTX129443, and GTX632011 (GeneTex, Irvine, CA), ARID2 (H-182) Antibody, ARID2 (H-182) X Antibody, ARID2 (S-13) Antibody, ARID2 (S-13) X Antibody, ARID2 (E-3) Antibody, and ARID2 (E-3) X Antibody (Santa Cruz Biotechnology), etc. In addition, reagents are well-known for detecting ARID2 expression. Multiple clinical tests of PBRM1 are available in NIH Genetic Testing Registry (GTR®) (e.g., GTR Test ID: GTR000541481.2, offered by Fulgent Clinical Diagnostics Lab (Temple City, CA)). Moreover, mutilple siRNA, shRNA, CRISPR constructs for reducing ARID2 expression can be found in the commercial product lists of the above-referenced companies, such as siRNA product #SR316272, shRNA products #TR306601, TR505226, TG306601, SR420583, and CRISPER products #KN212320 and KN30154 from Origene Technologies (Rockville, MD), RNAi product H00196528-R01 (Novus Biologicals), CRISPER gRNA products from GenScript (Cat. #KN301549 and KN212320, Piscataway, NJ) and from Santa Cruz (sc-401863), and RNAi products from Santa Cruz (Cat #sc-96225 and sc-77400). It is to be noted that the term can further be used to refer to any combination of features described herein regarding ARID2 molecules. For example, any combination of sequence composition, percentage identify, sequence length, domain structure, functional activity, etc. can be used to describe an ARID2 molecule encompassed by the present invention.

The term "loss-of-function mutation" for BAF200/ARID2 refers to any mutation in a ARID2-related nucleic acid or protein that results in reduced or eliminated ARID2 protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of ARID2. Such mutations reduce or eliminate ARID2 protein amounts and/or function by eliminating proper coding sequences required for proper ARID2 protein translation and/or coding for ARID2 proteins that are non-functional or have reduced function (e.g., deletion of enzymatic and/or structural domains, reduction in protein stability, alteration of sub-cellular localization, and the like). Such mutations are well-known in the art. In addition, a reRepresentative list describing a wide variety of structural mutations correlated with the functional result of reduced or eliminated ARID2 protein amounts and/or function is described in the Tables and the Examples.

The term "BRD7" refers to Bromodomain-containing protein 7, a subunit of the SWI/SNF complex, which can be found in PBAF but not BAF complexes. BRD7 is a transcriptional corepressor that binds to target promoters (e.g., the ESR1 promoter) and down-regulates the expression of target genes, leading to increased histone H3 acetylation at Lys-9 (H3K9ac). BRD7 can recruit other proteins such as BRCA1 and POU2F1 to, e.g., the ESR1 promoter for its function. BRD7 activates the Wnt signaling pathway in a DVL1-dependent manner by negatively regulating the GSK3B phosphotransferase activity, while BRD7 induces dephosphorylation of GSK3B at Tyr-216. BRD7 is also a coactivator for TP53-mediated activation of gene transcription and is required for TP53-mediated cell-cycle arrest in response to oncogene activation. BRD7 promotes acetylation of TP53 at Lys-382, and thereby promotes efficient recruitment of TP53 to target promoters. BRD7 also inhibits cell cycle progression from G1 to S phase. For studies on BRD7 functions, see Zhou et al. (2006) *J. Cell. Biochem.* 98:920-930; Harte et al. (2010) *Cancer Res.* 70:2538-2547; Drost et al. (2010) *Nat. Cell Biol.* 12:380-389. The known binding partners for BRD7 aslo include, e.g., Tripartite Motif Containing 24 (TRIM24), Protein Tyrosine Phosphatase, Non-Receptor Type 13 (PTPN13), Dishevelled Segment Polarity Protein 1 (DVL1), interferon regulatory factor 2 (IRF2) (Staal et al. (2000) *J. Cell. Physiol. US* 185:269-279) and heterogeneous nuclear ribonucleoprotein U-like protein 1 (HNRPUL1) (Kzhyshkowska et al. (2003) *Biochem. J. England.* 371:385-393). Human BRD7 protein has 651 amino acids and a molecular mass of 74139 Da, with a N-terminal nuclear localization signal (e.g., amino acids 65-96 of SEQ ID NO: 14), a Bromo-BRD7-like domain (e.g., amino acids 135-232 of SEQ ID NO: 14), and a DUF3512 domain (e.g., amino acids 287-533 of SEQ ID NO:14).

The term "BRD7" is intended to include fragments, variants (e.g., allelic variants), and derivatives thereof. ReRepresentative human BRD7 cDNA and human BRD7 protein sequences are well-known in the art and are publicly available from the National Center for Biotechnology Information (NCBI). For example, two different human BRD7 isoforms are known. Human BRD7 isoform A (NP_001167455.1) is encodable by the transcript variant 1 (NM_001173984.2), which is the longer transcript. Human BRD7 isoform B (NP_037395.2) is encodable by the transcript variant 2 (NM_013263.4), which uses an alternate in-frame splice site in the 3' coding region, compared to variant 1. The resulting isoform B lacks one internal residue, compared to isoform A. Nucleic acid and polypeptide sequences of BRD7 orthologs in organisms other than humans are well known and include, for example, chimpanzee BRD7 (XM_009430766.2 and XP_009429041.1, XM_016929816.1 and XP_016785305.1, XM_016929815.1 and XP_016785304.1, and XM_003315094.4 and XP_003315142.1), Rhesus monkey BRD7 (XM_015126104.1 and XP_014981590.1, XM_015126103.1 and XP_014981589.1, XM_001083389.3 and XP_001083389.2, and XM_015126105.1 and XP_014981591.1), dog BRD7 (XM_014106954.1 and XP_013962429.1), cattle BRD7 (NM_001103260.2 and NP_001096730.1), mouse BRD7 (NM_012047.2 and NP_036177.1), chicken BRD7 (NM_001005839.1 and NP_001005839.1), tropical clawed frog BRD7 (NM_001008007.1 and NP_001008008.1), and zebrafish BRD7 (NM_213366.2 and NP_998531.2). Representative sequences of BRD7 orthologs are presented below in Table 1.

Anti-BRD7 antibodies suitable for detecting BRD7 protein are well-known in the art and include, for example, antibody TA343710 (Origene), antibody NBP1-28727 (Novus Biologicals, Littleton, CO), antibodies ab56036, ab46553, ab202324, and ab114061 (AbCam, Cambridge, MA), antibodies Cat #: 15125 and 14910 (Cell Signaling), antibody GTX118755 (GeneTex, Irvine, CA), BRD7 (P-13) Antibody, BRD7 (T-12) Antibody, BRD7 (H-77) Antibody, BRD7 (H-2) Antibody, and BRD7 (B-8) Antibody (Santa Cruz Biotechnology), etc. In addition, reagents are well-known for detecting BRD7 expression. A clinical test of BRD7 is available in NIH Genetic Testing Registry (GTR®) with GTR Test ID: GTR000540400.2, offered by Fulgent Clinical Diagnostics Lab (Temple City, CA)). Moreover, mutilple siRNA, shRNA, CRISPR constructs for reducing BRD7 expression can be found in the commercial product lists of the above-referenced companies, such as shRNA product #TR100001 and CRISPER products #KN302255 and KN208734 from Origene Technologies (Rockville, MD), RNAi product H00029117-R01 (Novus Biologicals), and small molecule inhibitors BI 9564 and TP472 (Tocris Bioscience, UK). It is to be noted that the term can further be used to refer to any combination of features described herein regarding BRD7 molecules. For example, any combination of sequence composition, percentage identify, sequence length, domain structure, functional activity, etc. can be used to describe an BRD7 molecule encompassed by the present invention.

The term "loss-of-function mutation" for BRD7 refers to any mutation in a BRD7-related nucleic acid or protein that results in reduced or eliminated BRD7 protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of BRD7. Such mutations reduce or eliminate BRD7 protein amounts and/or function by eliminating proper coding sequences required for proper BRD7 protein translation and/or coding for BRD7 proteins that are non-functional or have reduced function (e.g., deletion of enzymatic and/or structural domains, reduction in protein stability, alteration of sub-cellular localization, and the like). Such mutations are well-known in the art. In addition, a reRepresentative list describing a wide variety of structural mutations correlated with the functional result of reduced or eliminated BRD7 protein amounts and/or function is described in the Tables and the Examples.

The term "BAF45A" or "PHF10" refers to PHD finger protein 10, a subunit of the PBAF complex having two zinc finger domains at its C-terminus. PHF10 belongs to the neural progenitors-specific chromatin remodeling complex (npBAF complex) and is required for the proliferation of neural progenitors. During neural development a switch from a stem/progenitor to a post-mitotic chromatin remodeling mechanism occurs as neurons exit the cell cycle and become committed to their adult state. The transition from proliferating neural stem/progenitor cells to post-mitotic neurons requires a switch in subunit composition of the npBAF and nBAF complexes. As neural progenitors exit mitosis and differentiate into neurons, npBAF complexes which contain ACTL6A/BAF53A and PHF10/BAF45A, are exchanged for homologous alternative ACTL6B/BAF53B and DPF1/BAF45B or DPF3/BAF45C subunits in neuron-specific complexes (nBAF). The npBAF complex is essential for the self-renewal/proliferative capacity of the multipotent neural stem cells. The nBAF complex along with CREST plays a role regulating the activity of genes essential for dendrite growth. PHF10 gene encodes at least two types of evolutionarily conserved, ubiquitously expressed isoforms that are incorporated into the PBAF complex in a mutually exclusive manner. One isoform contains C-terminal tandem PHD fingers, which in the other isoform are replaced by the consensus sequence for phosphorylation-dependent SUMO 1 conjugation (PDSM) (Brechalov et al. (2014) *Cell Cycle* 13:1970-1979). PBAF complexes containing different PHF10 isoforms can bind to the promoters of the same genes but produce different effects on the recruitment of Pol II to the promoter and on the level of gene transcription. PHF10 is a transcriptional repressor of caspase 3 and impares the programmed cell death pathway in human gastric cancer at the transcriptional level (Wei et al. (2010) *Mol Cancer Ther.* 9:1764-1774). Knockdown of PHF10 expression in gastric cancer cells led to significant induction of caspase-3 expression at both the RNA and protein levels and thus induced alteration of caspase-3 substrates in a time-dependent manner (Wei et al. (2010), supra). Results from luciferase assays by the same group indicated that PHF10 acted as a transcriptional repressor when the two PHD domains contained in PHF10 were intact. Human PHF10 protein has 498 amino acids and a molecular mass of 56051 Da, with two domains essential to induce neural progenitor proliferation (e.g., amino acids 89-185 and 292-334 of SEQ ID NO:20) and two PHD finger domains (e.g., amino acids 379-433 and 435-478 of SEQ ID NO:20). By similarity, PHF10 binds to ACTL6A/BAF53A, SMARCA2/BRM/BAF190B, SMARCA4/BRG1/BAF190A and PBRM1/BAF180.

The term "BAF45A" or "PHF10" is intended to include fragments, variants (e.g., allelic variants), and derivatives thereof. ReRepresentative human PHF10 cDNA and human PHF10 protein sequences are well-known in the art and are publicly available from the National Center for Biotechnology Information (NCBI). For example, two different human PHF10 isoforms are known. Human PHF10 isoform A (NP_060758.2) is encodable by the transcript variant 1 (NM_018288.3), which is the longer transcript. Human PHF10 isoform B (NP_579866.2) is encodable by the transcript variant 2 (NM_133325.2), which uses an alternate splice junction which results in six fewer nt when compared to variant 1. The isoform B lacks 2 internal amino acids compared to isoform A. Nucleic acid and polypeptide sequences of PHF10 orthologs in organisms other than humans are well known and include, for example, chimpanzee PHF10 (XM_016956680.1 and XP_016812169.1, XM_016956679.1 and XP_016812168.1, and XM_016956681.1 and XP_016812170.1), Rhesus monkey PHF10 (XM_015137735.1 and XP_014993221.1, and XM_015137734.1 and XP_014993220.1), dog PHF10 (XM_005627727.2 and XP_005627784.1, XM_005627726.2 and XP_005627783.1, XM_532272.5 and XP_532272.4, XM_014118230.1 and XP_013973705.1, and XM_014118231.1 and XP_013973706.1), cattle PHF10 (NM_001038052.1 and NP_001033141.1), mouse PHF10 (NM_024250.4 and NP_077212.3), rat PHF10 (NM_001024747.2 and NP_001019918.2), chicken PHF10 (XM_015284374.1 and XP_015139860.1), tropical clawed frog PHF10 (NM_001030472.1 and NP_001025643.1), zebrafish PHF10 (NM_200655.3 and NP_956949.3), and *C. elegans* PHF10 (NM_001047648.2 and NP_001041113.1, NM_001047647.2 and NP_001041112.1, and NM_001313168.1 and NP_001300097.1). Representative sequences of PHF10 orthologs are presented below in Table 1.

Anti-PHF10 antibodies suitable for detecting PHF10 protein are well-known in the art and include, for example, antibody TA346797 (Origene), antibodies NBP1-52879, NBP2-19795, NBP2-33759, and H00055274-B01P (Novus Biologicals, Littleton, CO), antibodies ab 154637, ab80939, and ab68114 (AbCam, Cambridge, MA), antibody Cat #PA5-30678 (ThermoFisher Scientific), antibody Cat #26-352 (ProSci, Poway, CA), etc. In addition, reagents are well-known for detecting PHF10 expression. A clinical test of PHF10 for hereditary disease is available with the test ID no. GTR000536577 in NIH Genetic Testing Registry (GTR), offered by Fulgent Clinical Diagnostics Lab (Temple City, CA). Moreover, mutilple siRNA, shRNA, CRISPR constructs for reducing PHF10 expression can be found in the commercial product lists of the above-referenced companies, such as siRNA product #sc-95343 and sc-152206 and CRISPER products #sc-410593 from Santa Cruz Biotechnology, RNAi products H00055274-R01 and H00055274-R02 (Novus Biologicals), and multiple CRISPER products from GenScript (Piscataway, NJ). Human PHF10 knockout cell (from HAP1 cell line) is also available from Horizon Discovery (Cat #HZGHC002778c011, UK). It is to be noted that the term can further be used to refer to any combination of features described herein regarding PHF10 molecules. For example, any combination of sequence composition, percentage identify, sequence length, domain structure, functional activity, etc. can be used to describe an PHF10 molecule encompassed by the present invention.

The term "loss-of-function mutation" for BAF45A/PHF10 refers to any mutation in a PHF10-related nucleic acid or protein that results in reduced or eliminated PHF10 protein amounts and/or function. For example, nucleic acid mutations include single-base substitutions, multi-base substitutions, insertion mutations, deletion mutations, frameshift mutations, missesnse mutations, nonsense mutations, splice-site mutations, epigenetic modifications (e.g., methylation, phosphorylation, acetylation, ubiquitylation, sumoylation, histone acetylation, histone deacetylation, and the like), and combinations thereof. In some embodiments, the mutation is a "nonsynonymous mutation," meaning that the mutation alters the amino acid sequence of PHF10. Such mutations reduce or eliminate PHF10 protein amounts and/or function by eliminating proper coding sequences required for proper PHF10 protein translation and/or coding for PHF10 proteins that are non-functional or have reduced function (e.g., deletion of enzymatic and/or structural domains, reduction in protein stability, alteration of subcellular localization, and the like). Such mutations are well-known in the art. In addition, a reRepresentative list describing a wide variety of structural mutations correlated with the functional result of reduced or eliminated PHF10 protein amounts and/or function is described in the Tables and the Examples.

The term "SMARCC1" refers to SWI/SNF related, matrix associated, actin dependent regulator of chromatin subfamily c member 1. SMARCC1 is a member of the SWI/SNF family of proteins, whose members display helicase and ATPase activities and which are thought to regulate transcription of certain genes by altering the chromatin structure around those genes. The encoded protein is part of the large ATP-dependent chromatin remodeling complex SNF/SWI and contains a predicted leucine zipper motif typical of many transcription factors. SMARCC1 is a component of SWI/SNF chromatin remodeling complexes that carry out key enzymatic activities, changing chromatin structure by altering DNA-histone contacts within a nucleosome in an ATP-dependent manner. SMARCC1 stimulates the ATPase activity of the catalytic subunit of the complex (Phelan et al. (1999) *Mol Cell* 3:247-253). SMARCC1 belongs to the neural progenitors-specific chromatin remodeling complex (npBAF complex) and the neuron-specific chromatin remodeling complex (nBAF complex). During neural development a switch from a stem/progenitor to a postmitotic chromatin remodeling mechanism occurs as neurons exit the cell cycle and become committed to their adult state. The transition from proliferating neural stem/progenitor cells to postmitotic neurons requires a switch in subunit composition of the npBAF and nBAF complexes. As neural progenitors exit mitosis and differentiate into neurons, npBAF complexes which contain ACTL6A/BAF53A and PHF10/BAF45A, are exchanged for homologous alternative ACTL6B/BAF53B and DPF1/BAF45B or DPF3/BAF45C subunits in neuron-specific complexes (nBAF). The npBAF complex is essential for the self-renewal/proliferative capacity of the multipotent neural stem cells. The nBAF complex along with CREST plays a role regulating the activity of genes essential for dendrite growth. Human SMARCC1 protein has 1105 amino acids and a molecular mass of 122867 Da. Binding partners of SMARCC1 include, e.g., NR3C1, SMARD1, TRIP12, CEBPB, KDM6B, and MKKS.

The term "SMARCC1" is intended to include fragments, variants (e.g., allelic variants), and derivatives thereof. Representative human SMARCC1 cDNA and human SMARCC1 protein sequences are well-known in the art and are publicly available from the National Center for Biotechnology Information (NCBI). For example, human SMARCC1 protein (NP_003065.3) is encodable by the transcript (NM_003074.3). Nucleic acid and polypeptide sequences of SMARCC1 orthologs in organisms other than humans are well known and include, for example, chimpanzee SMARCC1 (XM_016940956.2 and XP_016796445.1, XM_001154676.6 and XP_001154676.1, XM_016940957.1 and XP_016796446.1, and XM_009445383.3 and XP_009443658.1), Rhesus monkey SMARCC1 (XM_015126104.1 and XP_014981590.1, XM_015126103.1 and XP_014981589.1, XM_001083389.3 and XP_001083389.2, and XM_015126105.1 and XP_014981591.1), dog SMARCC1 (XM_533845.6 and XP_533845.2, XM_014122183.2 and XP_013977658.1, and XM_014122184.2 and XP_013977659.1), cattle SMARCC1 (XM_024983285.1 and XP_024839053.1), mouse SMARCC1 (NM_009211.2 and NP_033237.2), rat SMARCC1 (NM_001106861.1 and NP_001100331.1), chicken SMARCC1 (XM_025147375.1 and XP_025003143.1, and XM_015281170.2 and XP_015136656.2), tropical clawed frog SMARCC1 (XM_002942718.4 and XP_002942764.2), and zebrafish SMARCC1 (XM_003200246.5 and XP_003200294.1, and XM_005158282.4 and XP_005158339.1). Representative sequences of SMARCC1 orthologs are presented below in Table 1.

Anti-SMARCC1 antibodies suitable for detecting SMARCC1 protein are well-known in the art and include, for example, antibody TA334040 (Origene), antibodies NBP1-88720, NBP2-20415, NBP1-88721, and NB100-55312 (Novus Biologicals, Littleton, CO), antibodies ab172638, ab126180, and ab22355 (AbCam, Cambridge, MA), antibody Cat #PA5-30174 (ThermoFisher Scientific), antibody Cat #27-825 (ProSci, Poway, CA), etc. In addition, reagents are well-known for detecting SMARCC1. A clinical test of SMARCC1 for hereditary disease is available with the test ID no. GTR000558444.1 in NIH Genetic Testing Registry (GTR®), offered by Tempus Labs, Inc., (Chicago, IL). Moreover, mutilple siRNA, shRNA, CRISPR constructs for reducing SMARCC1 expression can be found in the commercial product lists of the above-referenced companies, such as siRNA products #sc-29780 and sc-29781 and CRISPR product #sc-400838 from Santa Cruz Biotechnology, RNAi products SR304474 and TL309245V, and CRISPR product KN208534 (Origene), and multiple CRISPR products from GenScript (Piscataway, NJ). It is to be noted that the term can further be used to refer to any combination of features described herein regarding SMARCC1 molecules. For example, any combination of sequence composition, percentage identify, sequence length, domain structure, functional activity, etc. can be used to describe a SMARCC1 molecule encompassed by the present invention.

The term "SMARCC2" refers to SWI/SNF related, matrix associated, actin dependent regulator of chromatin subfamily c member 2. SMARCC2 is an important paralog of gene SMARCC1. SMARCC2 is a member of the SWI/SNF family of proteins, whose members display helicase and ATPase activities and which are thought to regulate transcription of certain genes by altering the chromatin structure around those genes. The encoded protein is part of the large ATP-dependent chromatin remodeling complex SNF/SWI and contains a predicted leucine zipper motif typical of many transcription factors. SMARCC2 is a component of SWI/SNF chromatin remodeling complexes that carry out key enzymatic activities, changing chromatin structure by altering DNA-histone contacts within a nucleosome in an ATP-dependent manner (Kadam et al. (2000) *Genes Dev* 14:2441-2451). SMARCC2 can stimulate the ATPase activity of the catalytic subunit of the complex (Phelan et al. (1999) *Mol Cell* 3:247-253). SMARCC2 is required for CoREST dependent repression of neuronal specific gene promoters in non-neuronal cells (Battaglioli et al. (2002) *J Biol Chem* 277:41038-41045). SMARCC2 belongs to the neural progenitors-specific chromatin remodeling complex (npBAF complex) and the neuron-specific chromatin remodeling complex (nBAF complex). SMARCC2 is a critical regulator of myeloid differentiation, controlling granulocytopoiesis and the expression of genes involved in neutrophil granule formation. Human SMARCC2 protein has 1214 amino acids and a molecular mass of 132879 Da. Binding partners of SMARCC2 include, e.g., SIN3A, SMARD1, KDM6B, and RCOR1.

The term "SMARCC2" is intended to include fragments, variants (e.g., allelic variants), and derivatives thereof. Representative human SMARCC2 cDNA (NM_003074.3) and human SMARCC2 protein sequences (NP_003065.3) are well-known in the art and are publicly available from the National Center for Biotechnology Information (NCBI). For example, four different human SMARCC2 isoforms are known. Human SMARCC2 isoform a (NP_003066.2) is encodable by the transcript variant 1 (NM_003075.4). Human SMARCC2 isoform b (NP_620706.1) is encodable by the transcript variant 2 (NM_139067.3), which contains an alternate in-frame exon in the central coding region and uses an alternate in-frame splice site in the 3' coding region, compared to variant 1. The encoded isoform (b), contains a novel internal segment, lacks a segment near the C-terminus, and is shorter than isoform a. Human SMARCC2 isoform c (NP_001123892.1) is encodable by the transcript variant 3 (NM_001130420.2), which contains an alternate in-frame exon in the central coding region and contains alternate in-frame segment in the 3' coding region, compared to variant 1. The encoded isoform (c), contains a novel internal segment, lacks a segment near the C-terminus, and is shorter than isoform a. Human SMARCC2 isoform d (NP_001317217.1) is encodable by the transcript variant 4 (NM_001330288.1), which contains an alternate in-frame exon in the central coding region compared to variant 1. The encoded isoform (d), contains the same N- and C-termini, but is longer than isoform a. Nucleic acid and polypeptide sequences of SMARCC2 orthologs in organisms other than humans are well known and include, for example, chimpanzee SMARCC2 (XM_016923208.2 and XP_016778697.1, XM_016923212.2 and XP_016778701.1, XM_016923214.2 and XP_016778703.1, XM_016923210.2 and XP_016778699.1, XM_016923209.2 and XP_016778698.1, XM_016923213.2 and XP_016778702.1, XM_016923211.2 and XP_016778700.1, and XM_016923216.2 and XP_016778705.1), Rhesus monkey SMARCC2 (XM_015151975.1 and XP_015007461.1, XM_015151976.1 and XP_015007462.1, XM_015151974.1 and XP_015007460.1, XM_015151969.1 and XP_015007455.1, XM_015151972.1 and XP_015007458.1, XM_015151973.1 and XP_015007459.1, and XM_015151970.1 and XP_015007456.1), dog SMARCC2 (XM_022424046.1 and XP_022279754.1, XM_014117150.2 and XP_013972625.1, XM_014117149.2 and XP_013972624.1, XM_005625493.3 and XP_005625550.1, XM_014117151.2 and XP_013972626.1, XM_005625492.3 and XP_005625549.1, XM_005625495.3 and XP_005625552.1, XM_005625494.3 and XP_005625551.1, and XM_022424047.1 and XP_022279755.1), cattle SMARCC2 (NM_001172224.1 and NP_001165695.1), mouse SMARCC1 (NM_001114097.1 and NP_001107569.1, NM_001114096.1 and NP_001107568.1, and NM_198160.2 and NP_937803.1), rat SMARCC2 (XM_002729767.5 and XP_002729813.2, XM_006240805.3 and XP_006240867.1, XM_006240806.3 and XP_006240868.1, XM_001055795.6 and XP_001055795.1, XM_006240807.3 and XP_006240869.1, XM_008765050.2 and XP_008763272.1, XM_017595139.1 and XP_017450628.1, XM_001055673.6 and XP_001055673.1, and XM_001055738.6 and XP_001055738.1), and zebrafish SMARCC2 (XM_021474611.1 and XP_021330286.1). Representative sequences of SMARCC2 orthologs are presented below in Table 1.

Anti-SMARCC2 antibodies suitable for detecting SMARCC2 protein are well-known in the art and include, for example, antibody TA314552 (Origene), antibodies NBP1-90017 and NBP2-57277 (Novus Biologicals, Littleton, CO), antibodies ab71907, ab84453, and ab64853 (AbCam, Cambridge, MA), antibody Cat #PA5-54351 (ThermoFisher Scientific), etc. In addition, reagents are well-known for detecting SMARCC2. A clinical test of SMARCC2 for hereditary disease is available with the test ID no. GTR000546600.2 in NIH Genetic Testing Registry (GTR®), offered by Fulgent Clinical Diagnostics Lab (Temple City, CA). Moreover, mutilple siRNA, shRNA, CRISPR constructs for reducing SMARCC2 expression can be found in the commercial product lists of the above-referenced companies, such as siRNA products #sc-29782 and sc-29783 and CRISPR product #sc-402023 from Santa Cruz Biotechnology, RNAi products SR304475 and TL301505V, and CRISPR product KN203744 (Origene), and multiple CRISPR products from GenScript (Piscataway, NJ). It is to be noted that the term can further be used to refer to any combination of features described herein regarding SMARCC2 molecules. For example, any combination of sequence composition, percentage identify, sequence length, domain structure, functional activity, etc. can be used to describe a SMARCC2 molecule encompassed by the present invention.

The term "SMARCD1" refers to SWI/SNF related, matrix associated, actin dependent regulator of chromatin subfamily D member 1. SMARCD1 is a member of the SWI/SNF family of proteins, whose members display helicase and ATPase activities and which are thought to regulate transcription of certain genes by altering the chromatin structure around those genes. The encoded protein is part of the large ATP-dependent chromatin remodeling complex SNF/SWI and has sequence similarity to the yeast Swp73 protein. SMARCD1 is a component of SWI/SNF chromatin remodeling complexes that carry out key enzymatic activities, changing chromatin structure by altering DNA-histone contacts within a nucleosome in an ATP-dependent manner (Wang et al. (1996) *Genes Dev* 10:2117-2130). SMARCD1 belongs to the neural progenitors-specific chromatin remodeling complex (npBAF complex) and the neuron-specific chromatin remodeling complex (nBAF complex). SMARCD1 has a strong influence on vitamin D-mediated transcriptional activity from an enhancer vitamin D receptor element (VDRE). SMARCD1 a link between mammalian SWI-SNF-like chromatin remodeling complexes and the vitamin D receptor (VDR) heterodimer (Koszewski et al. (2003) *J Steroid Biochem Mol Biol* 87:223-231). SMARCD1 mediates critical interactions between nuclear receptors and the BRG1/SMARCA4 chromatin-remodeling complex for transactivation (Hsiao et al. (2003) *Mol Cell Biol* 23:6210-6220). Human SMARCD1 protein has 515 amino acids and a molecular mass of 58233 Da. Binding partners of SMARCD1 include, e.g., ESR1, NR3C1, NR1H4, PGR, SMARCA4, SMARCC1 and SMARCC2.

The term "SMARCD1" is intended to include fragments, variants (e.g., allelic variants), and derivatives thereof. Representative human SMARCD1 cDNA and human SMARCD1 protein sequences are well-known in the art and are publicly available from the National Center for Biotechnology Information (NCBI). For example, two different human SMARCD1 isoforms are known. Human SMARCD1 isoform a (NP_003067.3) is encodable by the transcript variant 1 (NM_003076.4), which is the longer transcript. Human SMARCD1 isoform b (NP_620710.2) is encodable by the transcript variant 2 (NM_139071.2), which lacks an alternate in-frame exon, compared to variant 1, resulting in a shorter protein (isoform b), compared to isoform a. Nucleic acid and polypeptide sequences of SMARCD1 orthologs in organisms other than humans are well known and include, for example, chimpanzee SMARCD1 (XM_016923432.2 and XP_016778921.1, XM_016923431.2 and XP_016778920.1, and XM_016923433.2 and XP_016778922.1), Rhesus monkey SMARCD1 (XM_001111275.3 and XP_001111275.3, XM_001111166.3 and XP_001111166.3, and XM_001111207.3 and XP_001111207.3), dog SMARCD1 (XM_543674.6 and XP_543674.4), cattle SMARCD1 (NM_001038559.2 and NP_001033648.1), mouse SMARCD1 (NM_031842.2 and NP_114030.2), rat SMARCD1 (NM_001108752.1 and NP_001102222.1), chicken SMARCD1 (XM_424488.6 and XP_424488.3), tropical clawed frog SMARCD1 (NM_001004862.1 and NP_001004862.1), and zebrafish SMARCD1 (NM_198358.1 and NP_938172.1). Representative sequences of SMARCD1 orthologs are presented below in Table 1.

Anti-SMARCD1 antibodies suitable for detecting SMARCD1 protein are well-known in the art and include, for example, antibody TA344378 (Origene), antibodies NBP1-88719 and NBP2-20417 (Novus Biologicals, Littleton, CO), antibodies ab224229, ab83208, and ab86029 (AbCam, Cambridge, MA), antibody Cat #PA5-52049 (ThermoFisher Scientific), etc. In addition, reagents are well-known for detecting SMARCD1. A clinical test of SMARCD1 for hereditary disease is available with the test ID no. GTR000558444.1 in NIH Genetic Testing Registry (GTR®), offered by Tempus Labs, Inc., (Chicago, IL). Moreover, mutilple siRNA, shRNA, CRISPR constructs for reducing SMARCD1 expression can be found in the commercial product lists of the above-referenced companies, such as siRNA products #sc-72597 and sc-725983 and CRISPR product #sc-402641 from Santa Cruz Biotechnology, RNAi products SR304476 and TL301504V, and CRISPR product KN203474 (Origene), and multiple CRISPR products from GenScript (Piscataway, NJ). It is to be noted that the term can further be used to refer to any combination of features described herein regarding SMARCD1 molecules. For example, any combination of sequence composition, percentage identify, sequence length, domain structure, functional activity, etc. can be used to describe a SMARCD1 molecule encompassed by the present invention.

The term “SMARCD2” refers to SWI/SNF related, matrix associated, actin dependent regulator of chromatin subfamily D member 2. SMARCD2 is a member of the SWI/SNF family of proteins, whose members display helicase and ATPase activities and which are thought to regulate transcription of certain genes by altering the chromatin structure around those genes. The encoded protein is part of the large ATP-dependent chromatin remodeling complex SNF/SWI and has sequence similarity to the yeast Swp73 protein. SMARCD2 is a component of SWI/SNF chromatin remodeling complexes that carry out key enzymatic activities, changing chromatin structure by altering DNA-histone contacts within a nucleosome in an ATP-dependent manner (Euskirchen et al. (2012) *J Biol Chem* 287:30897-30905; Kadoch et al. (2015) *Sci Adv* 1 (5):e1500447). SMARCD2 is a critical regulator of myeloid differentiation, controlling granulocytopoiesis and the expression of genes involved in neutrophil granule formation (Witzel et al. (2017) *Nat Genet* 49:742-752). Human SMARCD2 protein has 531 amino acids and a molecular mass of 589213 Da. Binding partners of SMARCD2 include, e.g., UNKL and CEBPE.

The term “SMARCD2” is intended to include fragments, variants (e.g., allelic variants), and derivatives thereof. Representative human SMARCD2 cDNA and human SMARCD2 protein sequences are well-known in the art and are publicly available from the National Center for Biotechnology Information (NCBI). For example, three different human SMARCD2 isoforms are known. Human SMARCD2 isoform 1 (NP_001091896.1) is encodable by the transcript variant 1 (NM_001098426.1). Human SMARCD2 isoform 2 (NP_001317368.1) is encodable by the transcript variant 2 (NM_001330439.1). Human SMARCD2 isoform 3 (NP_001317369.1) is encodable by the transcript variant 3 (NM_001330440.1). Nucleic acid and polypeptide sequences of SMARCD2 orthologs in organisms other than humans are well known and include, for example, chimpanzee SMARCD2 (XM_009433047.3 and XP_009431322.1, XM_001148723.6 and XP_001148723.1, XM_009433048.3 and XP_009431323.1, XM_009433049.3 and XP_009431324.1, XM_024350546.1 and XP_024206314.1, and XM_024350547.1 and XP_024206315.1), Rhesus monkey SMARCD2 (XM_015120093.1 and XP_014975579.1), dog SMARCD2 (XM_022422831.1 and XP_022278539.1, XM_005624251.3 and XP_005624308.1, XM_845276.5 and XP_850369.1, and XM_005624252.3 and XP_005624309.1), cattle SMARCD2 (NM_001205462.3 and NP_001192391.1), mouse SMARCC1 (NM_001130187.1 and NP_001123659.1, and NM_031878.2 and NP_114084.2), rat SMARCD2 (NM_031983.2 and NP_114189.1), chicken SMARCD2 (XM_015299406.2 and XP_015154892.1), tropical clawed frog SMARCD2 (NM_001045802.1 and NP_001039267.1), and zebrafish SMARCD2 (XM_687657.6 and XP_692749.2, and XM_021480266.1 and XP_021335941.1). Representative sequences of SMARCD2 orthologs are presented below in Table 1.

Anti-SMARCD2 antibodies suitable for detecting SMARCD2 protein are well-known in the art and include, for example, antibody TA335791 (Origene), antibodies H00006603-M02 and H00006603-M01 (Novus Biologicals, Littleton, CO), antibodies ab81622, ab56241, and ab221084 (AbCam, Cambridge, MA), antibody Cat #51-805 (ProSci, Poway, CA), etc. In addition, reagents are well-known for detecting SMARCD2. A clinical test of SMARCD2 for hereditary disease is available with the test ID no. GTR000558444.1 in NIH Genetic Testing Registry (GTR®), offered by Tempus Labs, Inc., (Chicago, IL). Moreover, mutilple siRNA, shRNA, CRISPR constructs for reducing SMARCD2 expression can be found in the commercial product lists of the above-referenced companies, such as siRNA products #sc-93762 and sc-153618 and CRISPR product #sc-403091 from Santa Cruz Biotechnology, RNAi products SR304477 and TL309244V, and CRISPR product KN214286 (Origene), and multiple CRISPR products from GenScript (Piscataway, NJ). It is to be noted that the term can further be used to refer to any combination of features described herein regarding SMARCD2 molecules. For example, any combination of sequence composition, percentage identify, sequence length, domain structure, functional activity, etc. can be used to describe a SMARCD2 molecule encompassed by the present invention.

The term “SMARCD3” refers to SWI/SNF related, matrix associated, actin dependent regulator of chromatin subfamily D member 3. SMARCD3 is a member of the SWI/SNF family of proteins, whose members display helicase and ATPase activities and which are thought to regulate transcription of certain genes by altering the chromatin structure around those genes. The encoded protein is part of the large ATP-dependent chromatin remodeling complex SNF/SWI and has sequence similarity to the yeast Swp73 protein. SMARCD3 is a component of SWI/SNF chromatin remodeling complexes that carry out key enzymatic activities, changing chromatin structure by altering DNA-histone contacts within a nucleosome in an ATP-dependent manner. SMARCD3 stimulates nuclear receptor mediated transcription. SMARCD3 belongs to the neural progenitors-specific chromatin remodeling complex (npBAF complex) and the neuron-specific chromatin remodeling complex (nBAF complex). Human SMARCD3 protein has 483 amino acids and a molecular mass of 55016 Da. Binding partners of SMARCD3 include, e.g., PPARG/NR1C3, RXRA/NRIF1, ESR1, NR5A1, NR5A2/LRH1 and other transcriptional activators including the HLH protein SREBF1/SREBP1 and the homeobox protein PBX1.

The term “SMARCD3” is intended to include fragments, variants (e.g., allelic variants), and derivatives thereof. Representative human SMARCD3 cDNA and human SMARCD3 protein sequences are well-known in the art and are publicly available from the National Center for Biotechnology Information (NCBI). For example, two different human SMARCD3 isoforms are known. Human SMARCD3 isoform 1 (NP_001003802.1 and NP_003069.2) is encodable by the transcript variant 1 (NM_001003802.1) and the transcript variant 2 (NM_003078.3). Human SMARCD2 isoform 2 (NP_001003801.1) is encodable by the transcript variant 3 (NM_001003801.1). Nucleic acid and polypeptide sequences of SMARCD3 orthologs in organisms other than humans are well known and include, for example, chimpanzee SMARCD3 (XM_016945944.2 and XP_016801433.1, XM_016945946.2 and XP_016801435.1, XM_016945945.2 and XP_016801434.1, and XM_016945943.2 and XP_016801432.1), Rhesus monkey SMARCD3 (NM_001260684.1 and NP_001247613.1), cattle SMARCD3 (NM_001078154.1 and NP_001071622.1), mouse SMARCC3 (NM_025891.3 and NP_080167.3), rat SMARCD3 (NM_001011966.1 and NP_001011966.1). Representative sequences of SMARCD3 orthologs are presented below in Table 1.

Anti-SMARCD3 antibodies suitable for detecting SMARCD3 protein are well-known in the art and include, for example, antibody TA811107 (Origene), antibodies H00006604-M01 and NBP2-39013 (Novus Biologicals, Littleton, CO), antibodies ab171075, ab131326, and ab50556 (AbCam, Cambridge, MA), antibody Cat #720131 (ThermoFisher Scientific), antibody Cat #28-327 (ProSci, Poway, CA), etc. In addition, reagents are well-known for detecting SMARCD3. A clinical test of SMARCD3 for hereditary disease is available with the test ID no. GTR000558444.1 in NIH Genetic Testing Registry (GTR®), offered by Tempus Labs, Inc., (Chicago, IL). Moreover, mutilple siRNA, shRNA, CRISPR constructs for reducing SMARCD3 expression can be found in the commercial product lists of the above-referenced companies, such as siRNA products #sc-89355 and sc-108054 and CRISPR product #sc-402705 from Santa Cruz Biotechnology, RNAi products SR304478 and TL309243V, and CRISPR product KN201135 (Origene), and multiple CRISPR products from GenScript (Piscataway, NJ). It is to be noted that the term can further be used to refer to any combination of features described herein regarding SMARCD3 molecules. For example, any combination of sequence composition, percentage identify, sequence length, domain structure, functional activity, etc. can be used to describe a SMARCD3 molecule encompassed by the present invention.

The term "SMARCB1" refers to SWI/SNF related, matrix associated, actin dependent regulator of chromatin subfamily B member 1. The protein encoded by this gene is part of a complex that relieves repressive chromatin structures, allowing the transcriptional machinery to access its targets more effectively. The encoded nuclear protein may also bind to and enhance the DNA joining activity of HIV-1 integrase. This gene has been found to be a tumor suppressor, and mutations in it have been associated with malignant rhabdoid tumors. SMARCB1 is a core component of the BAF (SWI/SNF) complex. This ATP-dependent chromatin-remodeling complex plays important roles in cell proliferation and differentiation, in cellular antiviral activities and inhibition of tumor formation. The BAF complex is able to create a stable, altered form of chromatin that constrains fewer negative supercoils than normal. This change in supercoiling would be due to the conversion of up to one-half of the nucleosomes on polynucleosomal arrays into asymmetric structures, termed altosomes, each composed of 2 histones octamers. SMARCB1 stimulates in vitro the remodeling activity of SMARCA4/BRG1/BAF190A. SMARCB1 is involved in activation of CSF1 promoter. SMARCB1 belongs to the neural progenitors-specific chromatin remodeling complex (npBAF complex) and the neuron-specific chromatin remodeling complex (nBAF complex). SMARCB1 plays a key role in cell-cycle control and causes cell cycle arrest in G0/G1. Human SMARCB1 protein has 385 amino acids and a molecular mass of 44141 Da. Binding partners of SMARCB1 include, e.g., CEBPB, PIHID1, MYK, PPPIR15A, and MAEL. SMARCB1 binds tightly to the human immunodeficiency virus-type 1 (HIV-1) integrase in vitro and stimulates its DNA-joining activity. SMARCB1 interacts with human papillomavirus 18 E1 protein to stimulate its viral replication (Lee et al. (1999) *Nature* 399:487-491). SMARCB1 interacts with Epstein-Barr virus protein EBNA-2 (Wu et al. (1996) *J Virol* 70:6020-6028). SMARCB1 binds to double-stranded DNA.

The term "SMARCB1" is intended to include fragments, variants (e.g., allelic variants), and derivatives thereof. Representative human SMARCB1 cDNA and human SMARCB1 protein sequences are well-known in the art and are publicly available from the National Center for Biotechnology Information (NCBI). For example, four different human SMARCB1 isoforms are known. Human SMARCB1 isoform a (NP_003064.2) is encodable by the transcript variant 1 (NM_003073.4). Human SMARCB1 isoform b (NP_001007469.1) is encodable by the transcript variant 2 (NM_001007468.2). Human SMARCB1 isoform c (NP_001304875.1) is encodable by the transcript variant 3 (NM_001317946.1). Human SMARCB1 isoform d (NP_001349806.1) is encodable by the transcript variant 4 (NM_001362877.1). Nucleic acid and polypeptide sequences of SMARCB1 orthologs in organisms other than humans are well known and include, for example, chimpanzee SMARCC1 (XM_001169712.6 and XP_001169712.1, XM_016939577.2 and XP_016795066.1, XM_515023.6 and XP_515023.2, and XM_016939576.2 and XP_016795065.1), Rhesus monkey SMARCB1 (NM_001257888.2 and NP_001244817.1), dog SMARCB1 (XM_543533.6 and XP_543533.2, and XM_852177.5 and XP_857270.2), cattle SMARCB1 (NM_001040557.2 and NP_001035647.1), mouse SMARCB1 (NM_011418.2 and NP_035548.1, and NM_001161853.1 and NP_001155325.1), rat SMARCB1 (NM_001025728.1 and NP_001020899.1), chicken SMARCB1 (NM_001039255.1 and NP_001034344.1), tropical clawed frog SMARCB1 (NM_001006818.1 and NP_001006819.1), and zebrafish SMARCB1 (NM_001007296.1 and NP_001007297.1). Representative sequences of SMARCB1 orthologs are presented below in Table 1.

Anti-SMARCB1 antibodies suitable for detecting SMARCB1 protein are well-known in the art and include, for example, antibody TA350434 (Origene), antibodies H00006598-M01 and NBP1-90014 (Novus Biologicals, Littleton, CO), antibodies ab222519, ab12167, and ab 192864 (AbCam, Cambridge, MA), antibody Cat #PA5-53932 (ThermoFisher Scientific), antibody Cat #51-916 (ProSci, Poway, CA), etc. In addition, reagents are well-known for detecting SMARCB1. A clinical test of SMARCB1 for hereditary disease is available with the test ID no. GTR000517131.2 in NIH Genetic Testing Registry (GTR®), offered by Fulgent Genetics Clinical Diagnostics Lab (Temple City, CA). Moreover, mutilple siRNA, shRNA, CRISPR constructs for reducing SMARCB1 expression can be found in the commercial product lists of the above-referenced companies, such as siRNA products #sc-304473 and sc-35670 and CRISPR product #sc-401485 from Santa Cruz Biotechnology, RNAi products SR304478 and TL309246V, and CRISPR product KN217885 (Origene), and multiple CRISPR products from GenScript (Piscataway, NJ). It is to be noted that the term can further be used to refer to any combination of features described herein regarding SMARCB1 molecules. For example, any combination of sequence composition, percentage identify, sequence length, domain structure, functional activity, etc. can be used to describe a SMARCB1 molecule encompassed by the present invention.

The term "SMARCE1" refers to SWI/SNF related, matrix associated, actin dependent regulator of chromatin subfamily E member 1. The protein encoded by this gene is part of the large ATP-dependent chromatin remodeling complex SWI/SNF, which is required for transcriptional activation of genes normally repressed by chromatin. The encoded protein, either alone or when in the SWI/SNF complex, can bind to 4-way junction DNA, which is thought to mimic the topology of DNA as it enters or exits the nucleosome. The protein contains a DNA-binding HMG domain, but disruption of this domain does not abolish the DNA-binding or nucleosome-displacement activities of the SWI/SNF complex. Unlike most of the SWI/SNF complex proteins, this protein has no yeast counterpart. SMARCE1 is a component of SWI/SNF chromatin remodeling complexes that carry out key enzymatic activities, changing chromatin structure by altering DNA-histone contacts within a nucleosome in an ATP-dependent manner. SMARCE1 belongs to the neural progenitors-specific chromatin remodeling complex (npBAF complex) and the neuron-specific chromatin remodeling complex (nBAF complex). SMARCE1 is required for the coactivation of estrogen responsive promoters by SWI/SNF complexes and the SRC/p160 family of histone acetyltransferases (HATs). SMARCE1 also specifically interacts with the CoREST corepressor resulting in repression of neuronal specific gene promoters in non-neuronal cells. Human SMARCE1 protein has 411 amino acids and a molecular mass of 46649 Da. SMARCE1 interacts with BRDT, and also binds to the SRC/p160 family of histone acetyltransferases (HATs) composed of NCOA1, NCOA2, and NCOA3. SMARCE1 interacts with RCOR1/CoREST, NR3C1 and ZMIM2/ZIMP7.

The term “SMARCE1” is intended to include fragments, variants (e.g., allelic variants), and derivatives thereof. Representative human SMARCEL cDNA and human SMARCE1 protein sequences are well-known in the art and are publicly available from the National Center for Biotechnology Information (NCBI). For example, human SMARCE1 protein (NP_003070.3) is encodable by transcript (NM_003079.4). Nucleic acid and polypeptide sequences of SMARCEL orthologs in organisms other than humans are well known and include, for example, chimpanzee SMARCE1 (XM_009432223.3 and XP_009430498.1, XM_511478.7 and XP_511478.2, XM_009432222.3 and XP_009430497.1, and XM_001169953.6 and XP_001169953.1), Rhesus monkey SMARCE1 (NM_001261306.1 and NP_001248235.1), cattle SMARCE1 (NM_001099116.2 and NP_001092586.1), mouse SMARCE1 (NM_020618.4 and NP_065643.1), rat SMARCE1 (NM_001024993.1 and NP_001020164.1), chicken SMARCE1 (NM_001006335.2 and NP_001006335.2), tropical clawed frog SMARCE1 (NM_001005436.1 and NP_001005436.1), and zebrafish SMARCE1 (NM_201298.1 and NP_958455.2). Representative sequences of SMARCE1 orthologs are presented below in Table 1.

Anti-SMARCE1 antibodies suitable for detecting SMARCE1 protein are well-known in the art and include, for example, antibody TA335790 (Origene), antibodies NBP1-90012 and NB100-2591 (Novus Biologicals, Littleton, CO), antibodies ab131328, ab228750, and ab 137081 (AbCam, Cambridge, MA), antibody Cat #PA5-18185 (ThermoFisher Scientific), antibody Cat #57-670 (ProSci, Poway, CA), etc. In addition, reagents are well-known for detecting SMARCE1. A clinical test of SMARCE1 for hereditary disease is available with the test ID no. GTR000558444.1 in NIH Genetic Testing Registry (GTR®), offered by Tempus Labs, Inc., (Chicago, IL). Moreover, mutilple siRNA, shRNA, CRISPR constructs for reducing SMARCEL expression can be found in the commercial product lists of the above-referenced companies, such as siRNA products #sc-45940 and sc-45941 and CRISPR product #sc-404713 from Santa Cruz Biotechnology, RNAi products SR304479 and TL309242, and CRISPR product KN217885 (Origene), and multiple CRISPR products from GenScript (Piscataway, NJ). It is to be noted that the term can further be used to refer to any combination of features described herein regarding SMARCE1 molecules. For example, any combination of sequence composition, percentage identify, sequence length, domain structure, functional activity, etc. can be used to describe a SMARCE1 molecule encompassed by the present invention.

The term “DPF1” refers to Double PHD Fingers 1. DPF1 has an important role in developing neurons by participating in regulation of cell survival, possibly as a neurospecific transcription factor. DPF1 belongs to the neuron-specific chromatin remodeling complex (nBAF complex). During neural development a switch from a stem/progenitor to a post-mitotic chromatin remodeling mechanism occurs as neurons exit the cell cycle and become committed to their adult state. The transition from proliferating neural stem/progenitor cells to post-mitotic neurons requires a switch in subunit composition of the npBAF and nBAF complexes. As neural progenitors exit mitosis and differentiate into neurons, npBAF complexes which contain ACTL6A/BAF53A and PHF10/BAF45A, are exchanged for homologous alternative ACTL6B/BAF53B and DPF1/BAF45B or DPF3/BAF45C subunits in neuron-specific complexes (nBAF). The npBAF complex is essential for the self-renewal/proliferative capacity of the multipotent neural stem cells. The nBAF complex along with CREST plays a role regulating the activity of genes essential for dendrite growth. Human DPF1 protein has 380 amino acids and a molecular mass of 425029 Da. DPF1 is a component of neuron-specific chromatin remodeling complex (nBAF complex) composed of at least, ARID1A/BAF250A or ARID1B/BAF250B, SMARCD1/BAF60A, SMARCD3/BAF60C, SMARCA2/BRM/BAF190B, SMARCA4/BRG1/BAF190A, SMARCB1/BAF47, SMARCC1/BAF155, SMARCE1/BAF57, SMARCC2/BAF170, DPF1/BAF45B, DPF3/BAF45C, ACTL6B/BAF53B and actin.

The term “DPF1” is intended to include fragments, variants (e.g., allelic variants), and derivatives thereof. Representative human DPF1 cDNA and human DPF1 protein sequences are well-known in the art and are publicly available from the National Center for Biotechnology Information (NCBI). For example, five different human DPF1 isoforms are known. Human DPF1 isoform a (NP_001128627.1) is encodable by the transcript variant 1 (NM_001135155.2). Human DPF1 isoform b (NP_004638.2) is encodable by the transcript variant 2 (NM_004647.3). Human DPF1 isoform c (NP_001128628.1) is encodable by the transcript variant 3 (NM_001135156.2). Human DPF1 isoform d (NP_001276907.1) is encodable by the transcript variant 4 (NM_001289978.1). Human DPF1 isoform e (NP_001350508.1) is encodable by the transcript variant 5 (NM_001363579.1). Nucleic acid and polypeptide sequences of DPF1 orthologs in organisms other than humans are well known and include, for example, Rhesus monkey DPF1 (XM_015123830.1 and XP_014979316.1, XM_015123829.1 and XP_014979315.1, XM_015123835.1 and XP_014979321.1, XM_015123831.1 and XP_014979317.1, XM_015123833.1 and XP_014979319.1, and XM_015123832.1 and XP_014979318.1), cattle DPF1 (NM_001076855.1 and NP_001070323.1), mouse DPF1 (NM_013874.2 and NP_038902.1), rat DPF1 (NM_001105729.3 and NP_001099199.2), and tropical clawed frog DPF1 (NM_001097276.1 and NP_001090745.1). Representative sequences of DPF1 orthologs are presented below in Table 1.

Anti-DPF1 antibodies suitable for detecting DPF1 protein are well-known in the art and include, for example, antibody TA311193 (Origene), antibodies NBP2-13932 and NBP2-19518 (Novus Biologicals, Littleton, CO), antibodies ab 199299, ab 173160, and ab3940 (AbCam, Cambridge, MA), antibody Cat #PA5-61895 (ThermoFisher Scientific), antibody Cat #28-079 (ProSci, Poway, CA), etc. In addition, reagents are well-known for detecting DPF1. Moreover, mutilple siRNA, shRNA, CRISPR constructs for reducing DPF1 expression can be found in the commercial product lists of the above-referenced companies, such as siRNA products #sc-97084 and sc-143155 and CRISPR product #sc-409539 from Santa Cruz Biotechnology, RNAi products SR305389 and TL313388V, and CRISPR product KN213721 (Origene), and multiple CRISPR products from GenScript (Piscataway, NJ). It is to be noted that the term can further be used to refer to any combination of features described herein regarding DPF1 molecules. For example, any combination of sequence composition, percentage identify, sequence length, domain structure, functional activity, etc. can be used to describe a DPF1 molecule encompassed by the present invention.

The term "DPF2" refers to Double PHD Fingers 2. DPF2 protein is a member of the d4 domain family, characterized by a zinc finger-like structural motif. It functions as a transcription factor which is necessary for the apoptotic response following deprivation of survival factors. It likely serves a regulatory role in rapid hematopoietic cell growth and turnover. This gene is considered a candidate gene for multiple endocrine neoplasia type I, an inherited cancer syndrome involving multiple parathyroid, enteropancreatic, and pituitary tumors. DPF2 is a transcription factor required for the apoptosis response following survival factor withdrawal from myeloid cells. DPF2also has a role in the development and maturation of lymphoid cells. Human DPF2 protein has 391 amino acids and a molecular mass of 44155 Da.

The term "DPF2" is intended to include fragments, variants (e.g., allelic variants), and derivatives thereof. Representative human DPF2 cDNA and human DPF2 protein sequences are well-known in the art and are publicly available from the National Center for Biotechnology Information (NCBI). For example, two different human DPF2 isoforms are known. Human DPF2 isoform 1 (NP_006259.1) is encodable by the transcript variant 1 (NM_006268.4). Human DPF2 isoform 2 (NP_001317237.1) is encodable by the transcript variant 2 (NM_001330308.1). Nucleic acid and polypeptide sequences of DPF2 orthologs in organisms other than humans are well known and include, for example, chimpanzee DPF2 (NM_001246651.1 and NP_001233580.1), Rhesus monkey DPF2 (XM_002808062.2 and XP_002808108.2, and XM_015113800.1 and XP_014969286.1), dog DPF2 (XM_861495.5 and XP_866588.1, and XM_005631484.3 and XP_005631541.1), cattle DPF2 (NM_001100356.1 and NP_001093826.1), mouse DPF2 (NM_001291078.1 and NP_001278007.1, and NM_011262.5 and NP_035392.1), rat DPF2 (NM_001108516.1 and NP_001101986.1), chicken DPF2 (NM_204331.1 and NP_989662.1), tropical clawed frog DPF2 (NM_001197172.2 and NP_001184101.1), and zebrafish DPF2 (NM_001007152.1 and NP_001007153.1). Representative sequences of DPF2 orthologs are presented below in Table 1.

Anti-DPF2 antibodies suitable for detecting DPF2 protein are well-known in the art and include, for example, antibody TA312307 (Origene), antibodies NBP1-76512 and NBP1-87138 (Novus Biologicals, Littleton, CO), antibodies ab 134942, ab232327, and ab227095 (AbCam, Cambridge, MA), etc. In addition, reagents are well-known for detecting DPF2. A clinical test of DPF2 for hereditary disease is available with the test ID no. GTR000536833.2 in NIH Genetic Testing Registry (GTR®), offered by Fulgent Genetics Clinical Diagnostics Lab (Temple City, CA). Moreover, mutilple siRNA, shRNA, CRISPR constructs for reducing DPF2 expression can be found in the commercial product lists of the above-referenced companies, such as siRNA products #sc-97031 and sc-143156 and CRISPR product #sc-404801-KO-2 from Santa Cruz Biotechnology, RNAi products SR304035 and TL313387V, and CRISPR product KN202364 (Origene), and multiple CRISPR products from GenScript (Piscataway, NJ). It is to be noted that the term can further be used to refer to any combination of features described herein regarding DPF2 molecules. For example, any combination of sequence composition, percentage identify, sequence length, domain structure, functional activity, etc. can be used to describe a DPF2 molecule encompassed by the present invention.

The term "DPF3" refers to Double PHD Fingers 3, a member of the D4 protein family. The encoded protein is a transcription regulator that binds acetylated histones and is a component of the BAF chromatin remodeling complex. DPF3 belongs to the neuron-specific chromatin remodeling complex (nBAF complex). During neural development a switch from a stem/progenitor to a post-mitotic chromatin remodeling mechanism occurs as neurons exit the cell cycle and become committed to their adult state. The transition from proliferating neural stem/progenitor cells to post-mitotic neurons requires a switch in subunit composition of the npBAF and nBAF complexes. As neural progenitors exit mitosis and differentiate into neurons, npBAF complexes which contain ACTL6A/BAF53A and PHF10/BAF45A, are exchanged for homologous alternative ACTL6B/BAF53B and DPF1/BAF45B or DPF3/BAF45C subunits in neuron-specific complexes (nBAF). The npBAF complex is essential for the self-renewal/proliferative capacity of the multipotent neural stem cells. The nBAF complex along with CREST plays a role regulating the activity of genes essential for dendrite growth (By similarity). DPF3 is a muscle-specific component of the BAF complex, a multiprotein complex involved in transcriptional activation and repression of select genes by chromatin remodeling (alteration of DNA-nucleosome topology). DPF3 specifically binds acetylated lysines on histone 3 and 4 (H3K14ac, H3K9ac, H4K5ac, H4K8ac, H4K12ac, H4K16ac). In the complex, DPF3 acts as a tissue-specific anchor between histone acetylations and methylations and chromatin remodeling. DPF3 plays an essential role in heart and skeletal muscle development. Human DPF3 protein has 378 amino acids and a molecular mass of 43084 Da. The PHD-type zinc fingers of DPF3 mediate its binding to acetylated histones. DPF3 belongs to the requiem/DPF family.

The term "DPF3" is intended to include fragments, variants (e.g., allelic variants), and derivatives thereof. Representative human DPF3 cDNA and human DPF3 protein sequences are well-known in the art and are publicly available from the National Center for Biotechnology Information (NCBI). For example, four different human DPF3 isoforms are known. Human DPF3 isoform 1 (NP_036206.3) is encodable by the transcript variant 1 (NM_012074.4). Human DPF3 isoform 2 (NP_001267471.1) is encodable by the transcript variant 2 (NM_001280542.1). Human DPF3 isoform 3 (NP_001267472.1) is encodable by the transcript variant 3 (NM_001280543.1). Human DPF3 isoform 4 (NP_001267473.1) is encodable by the transcript variant 4 (NM_001280544.1). Nucleic acid and polypeptide sequences of DPF3 orthologs in organisms other than humans are well known and include, for example, chimpanzee DPF3 (XM_016926314.2 and XP_016781803.1, XM_016926316.2 and XP_016781805.1, and XM_016926315.2 and XP_016781804.1), dog DPF3 (XM_014116039.1 and XP_013971514.1), mouse DPF3 (NM_001267625.1 and NP_001254554.1, NM_001267626.1 and NP_001254555.1, and NM_058212.2 and NP_478119.1), chicken DPF3 (NM_204639.2 and NP_989970.1), tropical clawed frog DPF3 (NM_001278413.1 and NP_001265342.1), and zebrafish DPF3 (NM_001111169.1 and NP_001104639.1). Representative sequences of DPF3 orthologs are presented below in Table 1.

Anti-DPF3 antibodies suitable for detecting DPF3 protein are well-known in the art and include, for example, antibody TA335655 (Origene), antibodies NBP2-49494 and NBP2-14910 (Novus Biologicals, Littleton, CO), antibodies ab 180914, ab 127703, and ab85360 (AbCam, Cambridge, MA), antibody PA5-38011 (ThermoFisher Scientific), antibody Cat #7559 (ProSci, Poway, CA), etc. In addition, reagents are well-known for detecting DPF3. Moreover, mutilple siRNA, shRNA, CRISPR constructs for reducing DPF3 expression can be found in the commercial product lists of the above-referenced companies, such as siRNA products #sc-97031 and sc-92150 and CRISPR product #sc-143157 from Santa Cruz Biotechnology, RNAi products SR305368 and TL313386V, and CRISPR product KN218937 (Origene), and multiple CRISPR products from GenScript (Piscataway, NJ). It is to be noted that the term can further be used to refer to any combination of features described herein regarding DPF3 molecules. For example, any combination of sequence composition, percentage identify, sequence length, domain structure, functional activity, etc. can be used to describe a DPF3 molecule encompassed by the present invention.

The term "ACTL6A" refers to Actin Like 6A, a family member of actin-related proteins (ARPs), which share significant amino acid sequence identity to conventional actins. Both actins and ARPs have an actin fold, which is an ATP-binding cleft, as a common feature. The ARPs are involved in diverse cellular processes, including vesicular transport, spindle orientation, nuclear migration and chromatin remodeling. This gene encodes a 53 kDa subunit protein of the BAF (BRG1/brm-associated factor) complex in mammals, which is functionally related to SWI/SNF complex in *S. cerevisiae* and Drosophila; the latter is thought to facilitate transcriptional activation of specific genes by antagonizing chromatin-mediated transcriptional repression. Together with beta-actin, it is required for maximal ATPase activity of BRG1, and for the association of the BAF complex with chromatin/matrix. ACTL6A is a component of SWI/SNF chromatin remodeling complexes that carry out key enzymatic activities, changing chromatin structure by altering DNA-histone contacts within a nucleosome in an ATP-dependent manner. ACTL6A is required for maximal ATPase activity of SMARCA4/BRG1/BAF190A and for association of the SMARCA4/BRG1/BAF190A containing remodeling complex BAF with chromatin/nuclear matrix. ACTL6A belongs to the neural progenitors-specific chromatin remodeling complex (npBAF complex) and is required for the proliferation of neural progenitors. During neural development a switch from a stem/progenitor to a post-mitotic chromatin remodeling mechanism occurs as neurons exit the cell cycle and become committed to their adult state. The transition from proliferating neural stem/progenitor cells to post-mitotic neurons requires a switch in subunit composition of the npBAF and nBAF complexes. As neural progenitors exit mitosis and differentiate into neurons, npBAF complexes which contain ACTL6A/BAF53A and PHF10/BAF45A, are exchanged for homologous alternative ACTL6B/BAF53B and DPF1/BAF45B or DPF3/BAF45C subunits in neuron-specific complexes (nBAF). The npBAF complex is essential for the self-renewal/proliferative capacity of the multipotent neural stem cells. The nBAF complex along with CREST plays a role regulating the activity of genes essential for dendrite growth. ACTL6A is a component of the NuA4 histone acetyltransferase (HAT) complex which is involved in transcriptional activation of select genes principally by acetylation of nucleosomal histones H4 and H2A. This modification may both alter nucleosome-DNA interactions and promote interaction of the modified histones with other proteins which positively regulate transcription. This complex may be required for the activation of transcriptional programs associated with oncogene and proto-oncogene mediated growth induction, tumor suppressor mediated growth arrest and replicative senescence, apoptosis, and DNA repair. NuA4 may also play a direct role in DNA repair when recruited to sites of DNA damage. Putative core component of the chromatin remodeling INO80 complex which is involved in transcriptional regulation, DNA replication and probably DNA repair. Human ACTL6A protein has 429 amino acids and a molecular mass of 47461 Da.

The term "ACTL6A" is intended to include fragments, variants (e.g., allelic variants), and derivatives thereof. Representative human ACTL6A cDNA and human ACTL6A protein sequences are well-known in the art and are publicly available from the National Center for Biotechnology Information (NCBI). For example, two different human ACTL6A isoforms are known. Human ACTL6A isoform 1 (NP_004292.1) is encodable by the transcript variant 1 (NM_004301.4). Human ACTL6A isoform 2 (NP_817126.1 and NP_829888.1) is encodable by the transcript variant 2 (NM_177989.3) and transcript variant 3 (NM_178042.3). Nucleic acid and polypeptide sequences of ACTL6A orthologs in organisms other than humans are well known and include, for example, chimpanzee ACTL6A (NM_001271671.1 and NP_001258600.1), Rhesus monkey ACTL6A (NM_001104559.1 and NP_001098029.1), cattle ACTL6A (NM_001105035.1 and NP_001098505.1), mouse ACTL6A (NM_019673.2 and NP_062647.2), rat ACTL6A (NM_001039033.1 and NP_001034122.1), chicken ACTL6A (XM_422784.6 and XP_422784.3), tropical clawed frog ACTL6A (NM_204006.1 and NP_989337.1), and zebrafish ACTL6A (NM_173240.1 and NP_775347.1). Representative sequences of ACTL6A orthologs are presented below in Table 1.

Anti-ACTL6A antibodies suitable for detecting ACTL6A protein are well-known in the art and include, for example, antibody TA345058 (Origene), antibodies NB100-61628 and NBP2-55376 (Novus Biologicals, Littleton, CO), antibodies ab131272 and ab 189315 (AbCam, Cambridge, MA), antibody 702414 (ThermoFisher Scientific), antibody Cat #45-314 (ProSci, Poway, CA), etc. In addition, reagents are well-known for detecting ACTL6A. Moreover, mutilple siRNA, shRNA, CRISPR constructs for reducing ACTL6A expression can be found in the commercial product lists of the above-referenced companies, such as siRNA products #sc-60239 and sc-60240 and CRISPR product #sc-403200-KO-2 from Santa Cruz Biotechnology, RNAi products SR300052 and TL306860V, and CRISPR product KN201689 (Origene), and multiple CRISPR products from GenScript (Piscataway, NJ). It is to be noted that the term can further be used to refer to any combination of features described herein regarding ACTL6A molecules. For example, any combination of sequence composition, percentage identify, sequence length, domain structure, functional activity, etc. can be used to describe an ACTL6A molecule encompassed by the present invention.

The term "β-Actin" refers to Actin Beta. This gene encodes one of six different actin proteins. Actins are highly conserved proteins that are involved in cell motility, structure, integrity, and intercellular signaling. The encoded protein is a major constituent of the contractile apparatus and one of the two nonmuscle cytoskeletal actins that are ubiquitously expressed. Mutations in this gene cause Baraitser-Winter syndrome 1, which is characterized by intellectual disability with a distinctive facial appearance in human patients. Numerous pseudogenes of this gene have been identified throughout the human genome. Actins are highly conserved proteins that are involved in various types of cell motility and are ubiquitously expressed in all eukaryotic cells. Actin is found in two main states: G-actin is the globular monomeric form, whereas F-actin forms helical polymers. Both G- and F-actin are intrinsically flexible structures. Human β-Actin protein has 375 amino acids and a molecular mass of 41737 Da. The binding partners of β-Actin include, e.g., CPNE1, CPNE4, DHX9, GCSAM, ERBB2, XPO6, and EMD.

The term "β-Actin" is intended to include fragments, variants (e.g., allelic variants), and derivatives thereof. Representative human β-Actin cDNA and human β-Actin protein sequences are well-known in the art and are publicly available from the National Center for Biotechnology Information (NCBI). For example, human β-Actin (NP_001092.1) is encodable by the transcript (NM_001101.4). Nucleic acid and polypeptide sequences of β-Actin orthologs in organisms other than humans are well known and include, for example, chimpanzee β-Actin (NM_001009945.1 and NP_001009945.1), Rhesus monkey β-Actin (NM_001033084.1 and NP_001028256.1), dog β-Actin (NM_001195845.2 and NP_001182774.2), cattle β-Actin (NM_173979.3 and NP_776404.2), mouse β-Actin (NM_007393.5 and NP_031419.1), rat β-Actin (NM_031144.3 and NP_112406.1), chicken β-Actin (NM_205518.1 and NP_990849.1), and tropical clawed frog β-Actin (NM_213719.1 and NP_998884.1). Representative sequences of β-Actin orthologs are presented below in Table 1.

Anti-β-Actin antibodies suitable for detecting β-Actin protein are well-known in the art and include, for example, antibody TA353557 (Origene), antibodies NB600-501 and NB600-503 (Novus Biologicals, Littleton, CO), antibodies ab8226 and ab8227 (AbCam, Cambridge, MA), antibody AM4302 (ThermoFisher Scientific), antibody Cat #PM-7669-biotin (ProSci, Poway, CA), etc. In addition, reagents are well-known for detecting β-Actin. Moreover, mutilple siRNA, shRNA, CRISPR constructs for reducing β-Actin expression can be found in the commercial product lists of the above-referenced companies, such as siRNA products #sc-108069 and sc-108070 and CRISPR product #sc-400000-KO-2 from Santa Cruz Biotechnology, RNAi products SR300047 and TL314976V, and CRISPR product KN203643 (Origene), and multiple CRISPR products from GenScript (Piscataway, NJ). It is to be noted that the term can further be used to refer to any combination of features described herein regarding β-Actin molecules. For example, any combination of sequence composition, percentage identify, sequence length, domain structure, functional activity, etc. can be used to describe a β-Actin molecule encompassed by the present invention.

The term "BCL7A" refers to BCL Tumor Suppressor 7A. This gene is directly involved, with Myc and IgH, in a three-way gene translocation in a Burkitt lymphoma cell line. As a result of the gene translocation, the N-terminal region of the gene product is disrupted, which is thought to be related to the pathogenesis of a subset of high-grade B cell non-Hodgkin lymphoma. The N-terminal segment involved in the translocation includes the region that shares a strong sequence similarity with those of BCL7B and BCL7C. Diseases associated with BCL7A include Lymphoma and Burkitt Lymphoma. An important paralog of this gene is BCL7C. Human BCL7A protein has 210 amino acids and a molecular mass of 22810 Da.

The term "BCL7A" is intended to include fragments, variants (e.g., allelic variants), and derivatives thereof. Representative human BCL7A cDNA and human BCL7A protein sequences are well-known in the art and are publicly available from the National Center for Biotechnology Information (NCBI). For example, two different human BCL7A isoforms are known. Human BCL7A isoform a (NP_066273.1) is encodable by the transcript variant 1 (NM_020993.4). Human BCL7A isoform b (NP_001019979.1) is encodable by the transcript variant 2 (NM_001024808.2). Nucleic acid and polypeptide sequences of BCL7A orthologs in organisms other than humans are well known and include, for example, chimpanzee BCL7A (XM_009426452.3 and XP_009424727.2, and XM_016924434.2 and XP_016779923.1), Rhesus monkey BCL7A (XM_015153012.1 and XP_015008498.1, and XM_015153013.1 and XP_015008499.1), dog BCL7A (XM_543381.6 and XP_543381.2, and XM_854760.5 and XP_859853.1), cattle BCL7A (XM_024977701.1 and XP_024833469.1, and XM_024977700.1 and XP_024833468.1), mouse BCL7A (NM_029850.3 and NP_084126.1), rat BCL7A (XM_017598515.1 and XP_017454004.1), chicken BCL7A (XM_004945565.3 and XP_004945622.1, and XM_415148.6 and XP_415148.2), tropical clawed frog BCL7A (NM_001006871.1 and NP_001006872.1), and zebrafish BCL7A (NM_212560.1 and NP_997725.1). Representative sequences of BCL7A orthologs are presented below in Table 1.

Anti-BCL7A antibodies suitable for detecting BCL7A protein are well-known in the art and include, for example, antibody TA344744 (Origene), antibodies NBP1-30941 and NBP1-91696 (Novus Biologicals, Littleton, CO), antibodies ab 137362 and ab 1075 (AbCam, Cambridge, MA), antibody PA5-27123 (ThermoFisher Scientific), antibody Cat #45-325 (ProSci, Poway, CA), etc. In addition, reagents are well-known for detecting BCL7A. Multiple clinical tests of BCL7A are available in NIH Genetic Testing Registry (GTR®) (e.g., GTR Test ID: GTR000541481.2, offered by Fulgent Clinical Diagnostics Lab (Temple City, CA)). Moreover, mutilple siRNA, shRNA, CRISPR constructs for reducing BCL7A expression can be found in the commercial product lists of the above-referenced companies, such as siRNA products #sc-96136 and sc-141671 and CRISPR product #sc-410702 from Santa Cruz Biotechnology, RNAi products SR300417 and TL314490V, and CRISPR product KN210489 (Origene), and multiple CRISPR products from GenScript (Piscataway, NJ). It is to be noted that the term can further be used to refer to any combination of features described herein regarding BCL7A molecules. For example, any combination of sequence composition, percentage identify, sequence length, domain structure, functional activity, etc. can be used to describe a BCL7A molecule encompassed by the present invention.

The term "BCL7B" refers to BCL Tumor Suppressor 7B, a member of the BCL7 family including BCL7A, BCL7B and BCL7C proteins. This member is BCL7B, which contains a region that is highly similar to the N-terminal segment of BCL7A or BCL7C proteins. The BCL7A protein is encoded by the gene known to be directly involved in a three-way gene translocation in a Burkitt lymphoma cell line. This gene is located at a chromosomal region commonly deleted in Williams syndrome. This gene is highly conserved from *C. elegans* to human. BCL7B is a positive regulator of apoptosis. BCL7B plays a role in the Wnt signaling pathway, negatively regulating the expression of Wnt signaling components CTNNB1 and HMGA1 (Uehara et al. (2015) *PLOS Genet* 11 (1):e1004921). BCL7B is involved in cell cycle progression, maintenance of the nuclear structure and stem cell differentiation (Uehara et al. (2015) *PLOS Genet* 11 (1):e1004921). It plays a role in lung tumor development or progression. Human BCL7B protein has 202 amino acids and a molecular mass of 22195 Da.

The term "BCL7B" is intended to include fragments, variants (e.g., allelic variants), and derivatives thereof. Representative human BCL7B cDNA and human BCL7B protein sequences are well-known in the art and are publicly available from the National Center for Biotechnology Information (NCBI). For example, three different human BCL7B isoforms are known. Human BCL7B isoform 1 (NP_001698.2) is encodable by the transcript variant 1 (NM_001707.3). Human BCL7B isoform 2 (NP_001184173.1) is encodable by the transcript variant 2 (NM_001197244.1). Human BCL7B isoform 3 (NP_001287990.1) is encodable by the transcript variant 3 (NM_001301061.1). Nucleic acid and polypeptide sequences of BCL7B orthologs in organisms other than humans are well known and include, for example, chimpanzee BCL7B (XM_003318671.3 and XP_003318719.1, and XM_003318672.3 and XP_003318720.1), Rhesus monkey BCL7B (NM_001194509.1 and NP_001181438.1), dog BCL7B (XM_546926.6 and XP_546926.1, and XM_005620975.2 and XP_005621032.1), cattle BCL7B (NM_001034775.2 and NP_001029947.1), mouse BCL7B (NM_009745.2 and NP_033875.2), chicken BCL7B (XM_003643231.4 and XP_003643279.1, XM_004949975.3 and XP_004950032.1, and XM_025142155.1 and XP_024997923.1), tropical clawed frog BCL7B (NM_001103072.1 and NP_001096542.1), and zebrafish BCL7B (NM_001006018.1 and NP_001006018.1, and NM_213165.1 and NP_998330.1). Representative sequences of BCL7B orthologs are presented below in Table 1.

Anti-BCL7B antibodies suitable for detecting BCL7B protein are well-known in the art and include, for example, antibody TA809485 (Origene), antibodies H00009275-M01 and NBP2-34097 (Novus Biologicals, Littleton, CO), antibodies ab 130538 and ab172358 (AbCam, Cambridge, MA), antibody MA527163 (ThermoFisher Scientific), antibody Cat #58-996 (ProSci, Poway, CA), etc. In addition, reagents are well-known for detecting BCL7B. Moreover, mutilple siRNA, shRNA, CRISPR constructs for reducing BCL7B expression can be found in the commercial product lists of the above-referenced companies, such as siRNA products #sc-89728 and sc-141672 and CRISPR product #sc-411262 from Santa Cruz Biotechnology, RNAi products SR306141 and TL306418V, and CRISPR product KN201696 (Origene), and multiple CRISPR products from GenScript (Piscataway, NJ). It is to be noted that the term can further be used to refer to any combination of features described herein regarding BCL7B molecules. For example, any combination of sequence composition, percentage identify, sequence length, domain structure, functional activity, etc. can be used to describe a BCL7B molecule encompassed by the present invention.

The term "BCL7C" refers to BCL Tumor Suppressor 7C, a member of the BCL7 family including BCL7A, BCL7B and BCL7C proteins. This gene is identified by the similarity of its product to the N-terminal region of BCL7A protein. BCL7C may play an anti-apoptotic role. Diseases associated with BCL7C include Lymphoma. Human BCL7C protein has 217 amino acids and a molecular mass of 23468 Da.

The term "BCL7C" is intended to include fragments, variants (e.g., allelic variants), and derivatives thereof. Representative human BCL7C cDNA and human BCL7C protein sequences are well-known in the art and are publicly available from the National Center for Biotechnology Information (NCBI). For example, two different human BCL7C isoforms are known. Human BCL7C isoform 1 (NP_001273455.1) is encodable by the transcript variant 1 (NM_001286526.1). Human BCL7C isoform 2 (NP_004756.2) is encodable by the transcript variant 2 (NM_004765.3). Nucleic acid and polypeptide sequences of BCL7C orthologs in organisms other than humans are well known and include, for example, chimpanzee BCL7C (XM_016929717.2 and XP_016785206.1, XM_016929716.2 and XP_016785205.1, and XM_016929718.2 and XP_016785207.1), Rhesus monkey BCL7C (NM_001265776.2 and NP_001252705.1), cattle BCL7C (NM_001099722.1 and NP_001093192.1), mouse BCL7C (NM_001347652.1 and NP_001334581.1, and NM_009746.2 and NP_033876.1), and rat BCL7C (NM_001106298.1 and NP_001099768.1). Representative sequences of BCL7C orthologs are presented below in Table 1.

Anti-BCL7C antibodies suitable for detecting BCL7C protein are well-known in the art and include, for example, antibody TA347083 (Origene), antibodies NBP2-15559 and NBP1-86441 (Novus Biologicals, Littleton, CO), antibodies ab 126944 and ab231278 (AbCam, Cambridge, MA), antibody PA5-30308 (ThermoFisher Scientific), etc. In addition, reagents are well-known for detecting BCL7C. Multiple clinical tests of BCL7C are available in NIH Genetic Testing Registry (GTR®) (e.g., GTR Test ID: GTR000540637.2, offered by Fulgent Clinical Diagnostics Lab (Temple City, CA)). Moreover, mutilple siRNA, shRNA, CRISPR constructs for reducing BCL7C expression can be found in the commercial product lists of the above-referenced companies, such as siRNA products #sc-93022 and sc-141673 and CRISPR product #sc-411261 from Santa Cruz Biotechnology, RNAi products SR306140 and TL315552V, and CRISPR product KN205720 (Origene), and multiple CRISPR products from GenScript (Piscataway, NJ). It is to be noted that the term can further be used to refer to any combination of features described herein regarding BCL7C molecules. For example, any combination of sequence composition, percentage identify, sequence length, domain structure, functional activity, etc. can be used to describe a BCL7C molecule encompassed by the present invention.

The term "SMARCA4" refers to SWI/SNF related, matrix associated, actin dependent regulator of chromatin, subfamily a, member 4, a member of the SWI/SNF family of proteins and is highly similar to the brahma protein of Drosophila. Members of this family have helicase and ATPase activities and are thought to regulate transcription of certain genes by altering the chromatin structure around those genes. The encoded protein is part of the large ATP-dependent chromatin remodeling complex SNF/SWI, which is required for transcriptional activation of genes normally repressed by chromatin. In addition, this protein can bind BRCA1, as well as regulate the expression of the tumorigenic protein CD44. Mutations in this gene cause rhabdoid tumor predisposition syndrome type 2. SMARCA4 is a component of SWI/SNF chromatin remodeling complexes that carry out key enzymatic activities, changing chromatin structure by altering DNA-histone contacts within a nucleosome in an ATP-dependent manner. SMARCA4 is a component of the CREST-BRG1 complex, a multiprotein complex that regulates promoter activation by orchestrating a calcium-dependent release of a repressor complex and a recruitment of an activator complex. In resting neurons, transcription of the c-FOS promoter is inhibited by BRG1-dependent recruitment of a phospho-RB1-HDAC repressor complex. Upon calcium influx, RB1 is dephosphorylated by calcineurin, which leads to release of the repressor complex. At the same time, there is increased recruitment of CREBBP to the promoter by a CREST-dependent mechanism, which leads to transcriptional activation. The CREST-BRG1 complex also binds to the NR2B promoter, and activity-dependent induction of NR2B expression involves a release of HDAC1 and recruitment of CREBBP. SMARCA4 belongs to the neural progenitors-specific chromatin remodeling complex (npBAF complex) and the neuron-specific chromatin remodeling complex (nBAF complex). During neural development a switch from a stem/progenitor to a postmitotic chromatin remodeling mechanism occurs as neurons exit the cell cycle and become committed to their adult state. The transition from proliferating neural stem/progenitor cells to postmitotic neurons requires a switch in subunit composition of the npBAF and nBAF complexes. As neural progenitors exit mitosis and differentiate into neurons, npBAF complexes which contain ACTL6A/BAF53A and PHF10/BAF45A, are exchanged for homologous alternative ACTL6B/BAF53B and DPF1/BAF45B or DPF3/BAF45C subunits in neuron-specific complexes (nBAF). The npBAF complex is essential for the self-renewal/proliferative capacity of the multipotent neural stem cells. The nBAF complex along with CREST plays a role regulating the activity of genes essential for dendrite growth. SMARCA4/BAF190A promote neural stem cell self-renewal/proliferation by enhancing Notch-dependent proliferative signals, while concurrently making the neural stem cell insensitive to SHH-dependent differentiating cues. SMARCA4 acts as a corepressor of ZEB 1 to regulate E-cadherin transcription and is required for induction of epithelial-mesenchymal transition (EMT) by ZEB1. Human SMARCA4 protein has 1647 amino acids and a molecular mass of 184646 Da. The known binding partners of SMARCA4 include, e.g., PHF10/BAF45A, MYOG, IKFZ1, ZEB1, NR3C1, PGR, SMARD1, TOPBP1 and ZMIM2/ZIMP7.

The term "SMARCA4" is intended to include fragments, variants (e.g., allelic variants), and derivatives thereof. Representative human SMARCA4 cDNA and human SMARCA4 protein sequences are well-known in the art and are publicly available from the National Center for Biotechnology Information (NCBI). For example, six different human SMARCA4 isoforms are known. Human SMARCA4 isoform A (NP_001122321.1) is encodable by the transcript variant 1 (NM_001128849.1). Human SMARCA4 isoform B (NP_001122316.1 and NP_003063.2) is encodable by the transcript variant 2 (NM_001128844.1) and the transcript variant 3 (NM_003072.3). Human SMARCA4 isoform C (NP_001122317.1) is encodable by the transcript variant 4 (NM_001128845.1). Human SMARCA4 isoform D (NP_001122318.1) is encodable by the transcript variant 5 (NM_001128846.1). Human SMARCA4 isoform E (NP_001122319.1) is encodable by the transcript variant 6 (NM_001128847.1). Human SMARCA4 isoform F (NP_001122320.1) is encodable by the transcript variant 7 (NM_001128848.1). Nucleic acid and polypeptide sequences of SMARCA4 orthologs in organisms other than humans are well known and include, for example, Rhesus monkey SMARCA4 (XM_015122901.1 and XP_014978387.1, XM_015122902.1 and XP_014978388.1, XM_015122903.1 and XP_014978389.1, XM_015122906.1 and XP_014978392.1, XM_015122905.1 and XP_014978391.1, XM_015122904.1 and XP_014978390.1, XM_015122907.1 and XP_014978393.1, XM_015122909.1 and XP_014978395.1, and XM_015122910.1 and XP_014978396.1), cattle SMARCA4 (NM_001105614.1 and NP_001099084.1), mouse SMARCA4 (NM_001174078.1 and NP_001167549.1, NM_011417.3 and NP_035547.2, NM_001174079.1 and NP_001167550.1, NM_001357764.1 and NP_001344693.1), rat SMARCA4 (NM_134368.1 and NP_599195.1), chicken SMARCA4 (NM_205059.1 and NP_990390.1), and zebrafish SMARCA4 (NM_181603.1 and NP_853634.1). Representative sequences of SMARCA4 orthologs are presented below in Table 1.

Anti-SMARCA4 antibodies suitable for detecting SMARCA4 protein are well-known in the art and include, for example, antibody AM26021PU-N(Origene), antibodies NB100-2594 and AF5738 (Novus Biologicals, Littleton, CO), antibodies ab110641 and ab4081 (AbCam, Cambridge, MA), antibody 720129 (ThermoFisher Scientific), antibody 7749 (ProSci), etc. In addition, reagents are well-known for detecting SMARCA4. Multiple clinical tests of SMARCA4 are available in NIH Genetic Testing Registry (GTR®) (e.g., GTR Test ID: GTR000517106.2, offered by Fulgent Clinical Diagnostics Lab (Temple City, CA)). Moreover, mutilple siRNA, shRNA, CRISPR constructs for reducing SMARCA4 expression can be found in the commercial product lists of the above-referenced companies, such as siRNA products #sc-29827 and sc-44287 and CRISPR product #sc-400168 from Santa Cruz Biotechnology, RNAi products SR321835 and TL309249V, and CRISPR product KN219258 (Origene), and multiple CRISPR products from GenScript (Piscataway, NJ). It is to be noted that the term can further be used to refer to any combination of features described herein regarding SMARCA4 molecules. For example, any combination of sequence composition, percentage identify, sequence length, domain structure, functional activity, etc. can be used to describe a SMARCA4 molecule encompassed by the present invention.

The term "SS18" refers to SS18, NBAF Chromatin Remodeling Complex Subunit. SS18 functions synergistically with RBM14 as a transcriptional coactivator. Isoform 1 and isoform 2 of SS18 function in nuclear receptor coactivation. Isoform 1 and isoform 2 of SS18 function in general transcriptional coactivation. Diseases associated with SS18 include Sarcoma, Synovial Cell Sarcoma. Among its related pathways are transcriptional misregulation in cancer and chromatin regulation/acetylation. Human SS18 protein has 418 amino acids and a molecular mass of 45929 Da. The known binding partners of SS18 include, e.g., MLLT10 and RBM14 isoform 1.

The term "SS18" is intended to include fragments, variants (e.g., allelic variants), and derivatives thereof. Representative human SS18 cDNA and human SS18 protein sequences are well-known in the art and are publicly available from the National Center for Biotechnology Information (NCBI). For example, three different human SS18 isoforms are known. Human SS18 isoform 1 (NP_001007560.1) is encodable by the transcript variant 1 (NM_001007559.2). Human SS18 isoform 2

(NP_005628.2) is encodable by the transcript variant 2 (NM_005637.3). Human SS18 isoform 3 (NP_001295130.1) is encodable by the transcript variant 3 (NM_001308201.1). Nucleic acid and polypeptide sequences of SS18 orthologs in organisms other than humans are well known and include, for example, dog SS18 (XM_005622940.3 and XP_005622997.1, XM_537295.6 and XP_537295.3, XM_003434925.4 and XP_003434973.1, and XM_005622941.3 and XP_005622998.1), mouse SS18 (NM_009280.2 and NP_033306.2, NM_001161369.1 and NP_001154841.1, NM_001161370.1 and NP_001154842.1, and NM_001161371.1 and NP_001154843.1), rat SS18 (NM_001100900.1 and NP_001094370.1), chicken SS18 (XM_015277943.2 and XP_015133429.1, and XM_015277944.2 and XP_015133430.1), tropical clawed frog SS18 (XM_012964966.1 and XP_012820420.1, XM_018094711.1 and XP_017950200.1, XM_012964964.2 and XP_012820418.1, and XM_012964965.2 and XP_012820419.1), and zebrafish SS18 (NM_001291325.1 and NP_001278254.1, and NM_199744.2 and NP_956038.1). Representative sequences of BRD7 orthologs are presented below in Table 1.

Anti-SS18 antibodies suitable for detecting SS18 protein are well-known in the art and include, for example, antibody TA314572 (Origene), antibodies NBP2-31777 and NBP2-31612 (Novus Biologicals, Littleton, CO), antibodies ab 179927 and ab89086 (AbCam, Cambridge, MA), antibody PA5-63745 (ThermoFisher Scientific), etc. In addition, reagents are well-known for detecting SS18. Multiple clinical tests of SS18 are available in NIH Genetic Testing Registry (GTR®) (e.g., GTR Test ID: GTR000546059.2, offered by Fulgent Clinical Diagnostics Lab (Temple City, CA)). Moreover, mutilple siRNA, shRNA, CRISPR constructs for reducing SS18 expression can be found in the commercial product lists of the above-referenced companies, such as siRNA products #sc-38449 and sc-38450 and CRISPR product #sc-401575 from Santa Cruz Biotechnology, RNAi products SR304614 and TL309102V, and CRISPR product KN215192 (Origene), and multiple CRISPR products from GenScript (Piscataway, NJ). It is to be noted that the term can further be used to refer to any combination of features described herein regarding SS18 molecules. For example, any combination of sequence composition, percentage identify, sequence length, domain structure, functional activity, etc. can be used to describe a SS18 molecule encompassed by the present invention.

The term "SS18L1" refers to SS18L1, NBAF Chromatin Remodeling Complex Subunit. This gene encodes a calcium-responsive transactivator which is an essential subunit of a neuron-specific chromatin-remodeling complex. The structure of this gene is similar to that of the SS18 gene. Mutations in this gene are involved in amyotrophic lateral sclerosis (ALS). SS18L1 is a transcriptional activator which is required for calcium-dependent dendritic growth and branching in cortical neurons. SS18L1 recruits CREB-binding protein (CREBBP) to nuclear bodies. SS18L1 is a component of the CREST-BRG1 complex, a multiprotein complex that regulates promoter activation by orchestrating a calcium-dependent release of a repressor complex and a recruitment of an activator complex. In resting neurons, transcription of the c-FOS promoter is inhibited by BRG1-dependent recruitment of a phospho-RB1-HDAC1 repressor complex. Upon calcium influx, RB1 is dephosphorylated by calcineurin, which leads to release of the repressor complex. At the same time, there is increased recruitment of CREBBP to the promoter by a CREST-dependent mechanism, which leads to transcriptional activation. The CREST-BRG1 complex also binds to the NR2B promoter, and activity-dependent induction of NR2B expression involves a release of HDAC1 and recruitment of CREBBP. Human SS18L1 protein has 396 amino acids and a molecular mass of 42990 Da. The known binding partners of SS18L1 include, e.g., CREBBP (via N-terminus), EP300 and SMARCA4/BRG1.

The term "SS18L1" is intended to include fragments, variants (e.g., allelic variants), and derivatives thereof. Representative human SS18L1 cDNA and human SS18L1 protein sequences are well-known in the art and are publicly available from the National Center for Biotechnology Information (NCBI). For example, two different human SS18L1 isoforms are known. Human SS18L1 isoform 1 (NP_945173.1) is encodable by the transcript variant 1 (NM_198935.2), which encodes the longer isoform. Human SS18L1 isoform 2 (NP_001288707.1) is encodable by the transcript variant 2 (NM_001301778.1), which has an additional exon in the 5' region and an alternate splice acceptor site, which results in translation initiation at a downstream AUG start codon, compared to variant 1. The resulting isoform (2) has a shorter N-terminus, compared to isoform 1. Nucleic acid and polypeptide sequences of SS18L1 orthologs in organisms other than humans are well known and include, for example, Rhesus monkey SS18 (XM_015148655.1 and XP_015004141.1, XM_015148658.1 and XP_015004144.1, XM_015148656.1 and XP_015004142.1, XM_015148657.1 and XP_015004143.1, and XM_015148654.1 and XP_015004140.1), dog SS18L1 (XM_005635257.3 and XP_005635314.2), cattle SS18 (NM_001078095.1 and NP_001071563.1), mouse SS18L1 (NM_178750.5 and NP_848865.4), rat SS18L1 (NM_138918.1 and NP_620273.1), chicken SS18L1 (XM_417402.6 and XP_417402.4), and tropical clawed frog SS18L1 (NM_001195706.2 and NP_001182635.1). Representative sequences of SS18L1 orthologs are presented below in Table 1.

Anti-SS18L1 antibodies suitable for detecting SS18L1 protein are well-known in the art and include, for example, antibody TA333342 (Origene), antibodies NBP2-20486 and NBP2-20485 (Novus Biologicals, Littleton, CO), antibody PA5-30571 (ThermoFisher Scientific), antibody 59-703 (ProSci), etc. In addition, reagents are well-known for detecting SS18L1. Multiple clinical tests of SS18L1 are available in NIH Genetic Testing Registry (GTR®) (e.g., GTR Test ID: GTR000546798.2, offered by Fulgent Clinical Diagnostics Lab (Temple City, CA)). Moreover, mutilple siRNA, shRNA, CRISPR constructs for reducing SS18L1 expression can be found in the commercial product lists of the above-referenced companies, such as siRNA products #sc-60442 and sc-60441 and CRISPR product #sc-403134 from Santa Cruz Biotechnology, RNAi products SR308680 and TF301381, and CRISPR product KN212373 (Origene), and multiple CRISPR products from GenScript (Piscataway, NJ). It is to be noted that the term can further be used to refer to any combination of features described herein regarding SS18L1 molecules. For example, any combination of sequence composition, percentage identify, sequence length, domain structure, functional activity, etc. can be used to describe a SS18L1 molecule encompassed by the present invention.

The term "GLTSCR1" or "BICRA" refers to BRD4 Interacting Chromatin Remodeling Complex Associated Protein. GLTSCR1 plays a role in BRD4-mediated gene transcription. Diseases associated with BICRA include Acoustic Neuroma and Neuroma. An important paralog of this gene is BICRAL. Human GLTSCR1 protein has 1560 amino acids and a molecular mass of 158490 Da. The known binding partners of GLTSCR1 include, e.g., BRD4.

The term "GLTSCR1" is intended to include fragments, variants (e.g., allelic variants), and derivatives thereof. Representative human GLTSCR1 cDNA and human GLTSCR1 protein sequences are well-known in the art and are publicly available from the National Center for Biotechnology Information (NCBI). For example, human GLTSCR1 (NP_056526.3) is encodable by the transcript variant 1 (NM_015711.3). Nucleic acid and polypeptide sequences of GLTSCR1 orthologs in organisms other than humans are well known and include, for example, chimpanzee GLTSCR1 (XM_003316479.3 and XP_003316527.1, XM_009435940.2 and XP_009434215.1, XM_009435938.3 and XP_009434213.1, and XM_009435941.2 and XP_009434216.1), Rhesus monkey GLTSCR1 (XM_015124361.1 and XP_014979847.1, and XM_015124362.1 and XP_014979848.1), dog GLTSCR1 (XM_014116569.2 and XP_013972044.1), mouse GLTSCR1 (NM_001081418.1 and NP_001074887.1), rat GLTSCR1 (NM_001106226.2 and NP_001099696.2), chicken GLTSCR1 (XM_025144460.1 and XP_025000228.1), and tropical clawed frog GLTSCR1 (NM_001113827.1 and NP_001107299.1). Representative sequences of GLTSCR1 orthologs are presented below in Table 1.

Anti-GLTSCR1 antibodies suitable for detecting GLTSCR1 protein are well-known in the art and include, for example, antibody AP51862PU-N (Origene), antibody NBP2-30603 (Novus Biologicals, Littleton, CO), etc. In addition, reagents are well-known for detecting GLTSCR1. Multiple clinical tests of GLTSCR1 are available in NIH Genetic Testing Registry (GTR®) (e.g., GTR Test ID: GTR000534926.2, offered by Fulgent Clinical Diagnostics Lab (Temple City, CA)). Moreover, mutilple siRNA, shRNA, CRISPR constructs for reducing GLTSCR1 expression can be found in the commercial product lists of the above-referenced companies, such as RNAi products SR309337 and TL304311V, and CRISPR product KN214080 (Origene), and multiple CRISPR products from GenScript (Piscataway, NJ). It is to be noted that the term can further be used to refer to any combination of features described herein regarding GLTSCR1 molecules. For example, any combination of sequence composition, percentage identify, sequence length, domain structure, functional activity, etc. can be used to describe a GLTSCR1 molecule encompassed by the present invention.

The term "GLTSCR1L" or "BICRAL" refers to BRD4 Interacting Chromatin Remodeling Complex Associated Protein Like. An important paralog of this gene is BICRA. Human GLTSCR1L protein has 1079 amino acids and a molecular mass of 115084 Da.

The term "GLTSCR1L" is intended to include fragments, variants (e.g., allelic variants), and derivatives thereof. Representative human GLTSCR1L cDNA and human GLTSCR1L protein sequences are well-known in the art and are publicly available from the National Center for Biotechnology Information (NCBI). For example, human GLTSCR1L protein (NP_001305748.1 and NP_056164.1) is encodable by the transcript variant 1 (NM_001318819.1) and the transcript variant 2 (NM_015349.2). Nucleic acid and polypeptide sequences of GLTSCR1 orthologs in organisms other than humans are well known and include, for example, chimpanzee GLTSCR1L (XM_016955520.2 and XP_016811009.1, XM_024357216.1 and XP_024212984.1, XM_016955522.2 and XP_016811011.1, XM_009451272.3 and XP_009449547.1, and XM_001135166.6 and XP_001135166.1), Rhesus monkey GLTSCR1L (XM_015136397.1 and XP_014991883.1), dog GLTSCR1L (XM_005627362.3 and XP_005627419.1, XM_014118453.2 and XP_013973928.1, and XM_005627363.3 and XP_005627420.1), cattle GLTSCR1L (NM_001205780.1 and NP_001192709.1), mouse GLTSCR1L (NM_001100452.1 and NP_001093922.1), tropical clawed frog GLTSCR1L (XM_002934681.4 and XP_002934727.2, and XM_018094119.1 and XP_017949608.1), and zebrafish GLTSCR1L (XM_005156379.4 and XP_005156436.1, and XM_682390.9 and XP_687482.4). Representative sequences of GLTSCR1L orthologs are presented below in Table 1.

Anti-GLTSCR1L antibodies suitable for detecting GLTSCR1L protein are well-known in the art and include, for example, antibodies NBP1-86359 and NBP1-86360 (Novus Biologicals, Littleton, CO), etc. In addition, reagents are well-known for detecting GLTSCR1L. Multiple clinical tests of GLTSCR1L are available in NIH Genetic Testing Registry (GTR®) (e.g., GTR Test ID: GTR000534926.2, offered by Fulgent Clinical Diagnostics Lab (Temple City, CA)). Moreover, mutilple siRNA, shRNA, CRISPR constructs for reducing GLTSCR1L expression can be found in the commercial product lists of the above-referenced companies, such as RNAi products SR308318 and TL303775V, and CRISPR product KN211609 (Origene), and multiple CRISPR products from GenScript (Piscataway, NJ). It is to be noted that the term can further be used to refer to any combination of features described herein regarding GLTSCR1L molecules. For example, any combination of sequence composition, percentage identify, sequence length, domain structure, functional activity, etc. can be used to describe a GLTSCR1L molecule encompassed by the present invention.

The term "BRD9" refers to Bromodomain Containing 9. An important paralog of this gene is BRD7. BRD9 plays a role in chromatin remodeling and regulation of transcription (Filippakopouplos et al. (2012) *Cell* 149:214-231; Flynn et al. (2015) *Structure* 23:1801-1814). BRD9 acts as a chromatin reader that recognizes and binds acylated histones. BRD9 binds histones that are acetylated and/or butyrylated (Flynn et al. (2015) *Structure* 23:1801-1814). Human BRD9 protein has 597 amino acids and a molecular mass of 67000 Da. BRD9 binds acetylated histones H3 and H4, as well as butyrylated histone H4.

The term "BRD9" is intended to include fragments, variants (e.g., allelic variants), and derivatives thereof. Representative human BRD9 cDNA and human BRD9 protein sequences are well-known in the art and are publicly available from the National Center for Biotechnology Information (NCBI). For example, three different human BRD9 isoforms are known. Human BRD9 isoform 1 (NP_076413.3) is encodable by the transcript variant 1 (NM_023924.4). Human BRD9 isoform 2 (NP_001009877.2) is encodable by the transcript variant 2 (NM_001009877.2). Human BRD9 isoform 3 (NP_001304880.1) is encodable by the transcript variant 3 (NM_001317951.1). Nucleic acid and polypeptide sequences of BRD9 orthologs in organisms other than humans are well known and include, for example, chimpanzee BRD9 (XM_016952886.2 and XP_016808375.1, XM_016952888.2 and XP_016808377.1, XM_016952889.1 and XP_016808378.1, and XM_024356518.1 and XP_024212286.1), Rhesus monkey BRD9 (NM_001261189.1 and NP_001248118.1), dog BRD9 (XM_014110323.2 and XP_013965798.2), cattle BRD9 (NM_001193092.2 and NP_001180021.1), mouse BRD9 (NM_001024508.3 and NP_001019679.2, and NM_001308041.1 and NP_001294970.1), rat BRD9 (NM_001107453.1 and NP_001100923.1), chicken BRD9 (XM_015275919.2 and XP_015131405.1, XM_015275920.2 and XP_015131406.1, and XM_015275921.2 and XP_015131407.1), tropical clawed frog BRD9 (NM_213697.2 and NP_998862.1), and zebrafish BRD9 (NM_200275.1 and NP_956569.1). Representative sequences of BRD9 orthologs are presented below in Table 1.

Anti-BRD9 antibodies suitable for detecting BRD9 protein are well-known in the art and include, for example, antibody TA337992 (Origene), antibodies NBP2-15614 and NBP2-58517 (Novus Biologicals, Littleton, CO), antibodies ab 155039 and ab 137245 (AbCam, Cambridge, MA), antibody PA5-31847 (ThermoFisher Scientific), antibody 28-196 (ProSci), etc. In addition, reagents are well-known for detecting BRD9. Multiple clinical tests of BRD9 are available in NIH Genetic Testing Registry (GTR®) (e.g., GTR Test ID: GTR000540343.2, offered by Fulgent Clinical Diagnostics Lab (Temple City, CA)). Moreover, mutilple siRNA, shRNA, CRISPR constructs for reducing BRD9 expression can be found in the commercial product lists of the above-referenced companies, such as siRNA products #sc-91975 and sc-141743 and CRISPR product #sc-404933 from Santa Cruz Biotechnology, RNAi products SR312243 and TL314434, and CRISPR product KN208315 (Origene), and multiple CRISPR products from GenScript (Piscataway, NJ). It is to be noted that the term can further be used to refer to any combination of features described herein regarding BRD9 molecules. For example, any combination of sequence composition, percentage identify, sequence length, domain structure, functional activity, etc. can be used to describe a BRD9 molecule encompassed by the present invention.

There is a known and definite correspondence between the amino acid sequence of a particular protein and the nucleotide sequences that can code for the protein, as defined by the genetic code (shown below). Likewise, there is a known and definite correspondence between the nucleotide sequence of a particular nucleic acid and the amino acid sequence encoded by that nucleic acid, as defined by the genetic code.

| GENETIC CODE | |
|---|---|
| Alanine (Ala, A) | GCA, GCC, GCG, GCT |
| Arginine (Arg, R) | AGA, ACG, CGA, CGC, CGG, CGT |
| Asparagine (Asn, N) | AAC, AAT |
| Aspartic acid (Asp, D) | GAC, GAT |
| Cysteine (Cys, C) | TGC, TGT |
| Glutamic acid (Glu, E) | GAA, GAG |
| Glutamine (Gln, Q) | CAA, CAG |
| Glycine (Gly, G) | GGA, GGC, GGG, GGT |

-continued

| GENETIC CODE | |
|---|---|
| Histidine (His, H) | CAC, CAT |
| Isoleucine (Ile, I) | ATA, ATC, ATT |
| Leucine (Leu, L) | CTA, CTC, CTG, CTT, TTA, TTG |
| Lysine (Lys, K) | AAA, AAG |
| Methionine (Met, M) | ATG |
| Phenylalanine (Phe, F) | TTC, TTT |
| Proline (Pro, P) | CCA, CCC, CCG, CCT |
| Serine (Ser, S) | AGC, AGT, TCA, TCC, TCG, TCT |
| Threonine (Thr, T) | ACA, ACC, ACG, ACT |
| Tryptophan (Trp, W) | TGG |
| Tyrosine (Tyr, Y) | TAC, TAT |
| Valine (Val, V) | GTA, GTC, GTG, GTT |
| Termination signal (end) | TAA, TAG, TGA |

An important and well-known feature of the genetic code is its redundancy, whereby, for most of the amino acids used to make proteins, more than one coding nucleotide triplet may be employed (illustrated above). Therefore, a number of different nucleotide sequences may code for a given amino acid sequence. Such nucleotide sequences are considered functionally equivalent since they result in the production of the same amino acid sequence in all organisms (although certain organisms may translate some sequences more efficiently than they do others). Moreover, occasionally, a methylated variant of a purine or pyrimidine may be found in a given nucleotide sequence. Such methylations do not affect the coding relationship between the trinucleotide codon and the corresponding amino acid.

In view of the foregoing, the nucleotide sequence of a DNA or RNA encoding a protein subunit nucleic acid (or any portion thereof) can be used to derive the polypeptide amino acid sequence, using the genetic code to translate the DNA or RNA into an amino acid sequence. Likewise, for polypeptide amino acid sequence, corresponding nucleotide sequences that can encode the polypeptide can be deduced from the genetic code (which, because of its redundancy, will produce multiple nucleic acid sequences for any given amino acid sequence). Thus, description and/or disclosure herein of a nucleotide sequence which encodes a polypeptide should be considered to also include description and/or disclosure of the amino acid sequence encoded by the nucleotide sequence. Similarly, description and/or disclosure of a polypeptide amino acid sequence herein should be considered to also include description and/or disclosure of all possible nucleotide sequences that can encode the amino acid sequence.

Finally, nucleic acid and amino acid sequence information for subunits of the SWI/SNF protein complexes encompassed by the present invention are well-known in the art and readily available on publicly available databases, such as the National Center for Biotechnology Information (NCBI). For example, exemplary nucleic acid and amino acid sequences derived from publicly available sequence databases are provided in Table 1 below.

TABLE 1

```
Subunit_1: SMARCC1 or SMARCC2
Subunit_2: SMARCC1 or SMARCC2
Subunit_3: SMARCD1, SMARCD2, or SMARCD3
Subunit_4: SMARCB1
Subunit_5: SMARCE1
Subunit_6: ARID1A or ARID1B
Subunit_7: DPF1, DPF2, or DPF3
Subunit_8: ACTL6A
Subunit_9: β-Actin
```

TABLE 1-continued

| |
|---|
| Subunit_10: BCL7A, BCL7B, or BCL7C |
| Subunit_11: SMARCA2 or SMARCA4 |
| Subunit_12: SS18 or SS18L1 |
| Subunit_1: SMARCC1 or SMARCC2 |
| Subunit_2: SMARCC1 or SMARCC2 |
| Subunit_3: SMARCD1, SMARCD2, or SMARCD3 |
| Subunit_4: SMARCB1 |
| Subunit_5: SMARCE1 |
| Subunit_6: ARID2 |
| Subunit_7: BRD7 |
| Subunit_8: PHF10 |
| Subunit_9: ACTL6A |
| Subunit_10: β-Actin |
| Subunit_11: BCL7A, BCL7B, or BCL7C |
| Subunit_12: SMARCA2 or SMARCA4 |
| Subunit_13: PBRM1 |
| Subunit_14: PBRM1 |
| SMARCC1 |
| SMARCC2 |
| SMARCD1 |
| SMARCD2 |
| SMARCD3 |
| SMARCB1 |
| SMARCE1 |
| ARID1A |
| ARID1B |
| DPF1 |
| DPF2 |
| DPF3 |
| ACTL6A |
| β-Actin |
| BCL7A |
| BCL7B |
| BCL7C |
| SMARCA2 |
| SMARCA4 |
| SS18 |
| SS18L1 |
| ARID2 |
| BRD7 |
| PHF10 |
| PBRM1 |
| GLTSCR1 |
| GLTSCR1L |
| BRD9 |

SEQ ID NO: 1 Human PBRM1 Transcript Variant 1 cDNA Sequence (NM_018313.4)

```
   1 gcggccgcgg ccggaggagc aatagcagca gccgtggcgg ccacggggcg gggcgcggcg
  61 gtcggtgacc gcggccgggg ctgcaggcgg cggagcggct ggaagttgga ttccatgggt
 121 tccaagagaa gaagagctac ctccccttcc agcagtgtca gcggggactt tgatgatggg
 181 caccattctg tgtcaacacc aggcccaagc aggaaaagga ggagactttc caatcttcca
 241 actgtagatc ctattgccgt gtgccatgaa ctctataata ccatccgaga ctataaggat
 301 gaacagggca gacttctctg tgagctcttc attagggcac caaagcgaag aaatcaacca
 361 gactattatg aagtggtttc tcagcccatt gacttgatga aaatccaaca gaaactaaaa
 421 atggaagagt atgatgatgt taatttgctg actgctgact tccagcttct tttaacaat
 481 gcaaagtcct attataagcc agattctcct gaatataaag ccgcttgcaa actctgggat
 541 ttgtaccttc gaacaagaaa tgagtttgtt cagaaaggag aagcagatga cgaagatgat
 601 gatgaagatg ggcaagacaa tcagggcaca gtgactgaag gatcttctcc agcttacttg
 661 aaggagatcc tggagcagct tcttgaagcc atagttgtag ctacaaatcc atcaggacgt
 721 ctcattagcg aactttttca gaaactgcct tctaaagtgc aatatccaga ttattatgca
 781 ataattaagg agcctataga tctcaagacc attgcccaga ggatacagaa tggaagctac
 841 aaaagtattc atgcaatggc caaagatata gatctcctcg caaaaaatgc caaaacttat
 901 aatgagcctg gctctcaagt attcaaggat gcaaattcaa ttaaaaaaat attttatatg
 961 aaaaaggctg aaattgaaca tcatgaaatg gctaagtcaa gtcttcgaat gaggactcca
1021 tccaacttgg ctgcagccag actgacaggt ccttcacaca gtaaaggcag ccttggtgaa
1081 gagagaaatc ccactagcaa gtattaccgt aataaaagag cagtacaagg aggtcgttta
1141 tcagcaatta caatggcact tcaatatggc tcagaaagtg aagaagatgc tgctttagct
1201 gctgcacgct atgaagaggg agagtcagaa gcagaaagca tcacttcctt tatggatgtt
1261 tcaaatcctt tttatcagct ttatgacaca gttaggagtt gtcggaataa ccaagggcag
1321 ctaatagctg aaccttttta ccatttgcct tcaaagaaaa aataccctga ttattaccag
1381 caaattaaaa tgcccatatc actacaacag atccgaacaa aactgaagaa tcaagaatat
1441 gaaactttag atcatttgga gtgtgatctg aatttaatgt ttgaaaatgc caaacgctat
1501 aatgtgccca attcagccat ctacaagcga gttctaaaat tgcagcaagt tatgcaggca
1561 aagaagaaag agcttgccag gagagacgat atcgaggacg gagacagcat gatctcttca
1621 gccacctctg atactggtag tgccaaaaga aaaagtaaaa agaacataag aaagcagcga
1681 atgaaaatct tattcaatgt tgttcttgaa gctcgagagc caggttcagg cagaagactt
1741 tgtgacctat ttatggttaa accatccaaa aaggactatc ctgattatta taaaatcatc
1801 ttggagccaa tggacttgaa aataattgag cataacatcc gcaatgacaa atatgctggt
1861 gaagagggaa tgatagaaga catgaagctg atgttccgga atgccaggca ctataatgag
1921 gagggctccc aggtttataa tgatgcacat atcctggaga agttactcaa ggagaaaagg
```

TABLE 1-continued

| | | | | | | |
|---|---|---|---|---|---|---|
| 1981 | aaagagctgg | gcccactgcc | tgatgatgat | gacatggctt | ctcccaaact | caagctgagt |
| 2041 | aggaagagtg | gcatttctcc | taaaaaatca | aaatacatga | ctccaatgca | gcagaaacta |
| 2101 | aatgaggtct | atgaagctgt | aaagaactat | actgataaga | ggggtcgccg | cctcagtgcc |
| 2161 | atatttctga | ggcttccctc | tagatctgag | ttgcctgact | actatctgac | tattaaaaag |
| 2221 | cccatggaca | tggaaaaaat | tcgaagtcac | atgatggcca | acaagtacca | agatattgac |
| 2281 | tctatggttg | aggactttgt | catgatgttt | aataatgcct | gtacatacaa | tgagccggag |
| 2341 | tctttgatct | acaaagatgc | tcttgttcta | cacaaagtcc | tgcttgaaac | acgcagagac |
| 2401 | ctggagggag | atgaggactc | tcatgtccca | aatgtgactt | tgctgattca | agagcttatc |
| 2461 | cacaatcttt | ttgtgtcagt | catgagtcat | caggatgatg | agggaagatg | ctacagcgat |
| 2521 | tctttagcag | aaattcctgc | tgtggatccc | aactttccta | acaaaccacc | ccttacattt |
| 2581 | gacataatta | ggaagaatgt | tgaaaataat | cgctaccgtc | ggcttgattt | atttcaagag |
| 2641 | catatgtttg | aagtattgga | acgagcaaga | aggatgaatc | ggacagattc | agaaatatat |
| 2701 | gaagatgcag | tagaacttca | gcagtttttt | attaaaattc | gtgatgaact | ctgcaaaaat |
| 2761 | ggagagattc | ttctttcacc | ggcactcagc | tataccacaa | aacatttgca | taatgatgtg |
| 2821 | gagaaagaga | gaaaggaaaa | attgccaaaa | gaaatagagg | aagataaact | aaaacgagaa |
| 2881 | gaagaaaaaa | gagaagctga | aaagagtgaa | gattcctctg | gtgctgcagg | cctctcaggc |
| 2941 | ttacatcgca | catacagcca | ggactgtagc | tttaaaaaca | gcatgtacca | tgttggagat |
| 3001 | tacgtctatg | tggaacctgc | agaggccaac | ctacaaccac | atatcgtctg | tattgaaaga |
| 3061 | ctgtgggagg | attcagctga | aaaagaagtt | tttaagagtg | actattacaa | caaagttcca |
| 3121 | gttagtaaaa | ttctaggcaa | gtgtgtggtc | atgtttgtca | aggaatactt | taagttatgc |
| 3181 | ccagaaaact | tccgagatga | ggatgttttt | gtctgtgaat | cacggtattc | tgccaaaacc |
| 3241 | aaatctttta | agaaaattaa | actgtggacc | atgcccatca | gctcagtcag | gtttgtccct |
| 3301 | cgggatgtgc | ctctgcctgt | ggttcgcgtg | gcctctgtat | ttgcaaatgc | agataaaggt |
| 3361 | gatgatgaga | agaatacaga | caactcagag | gacagtcgag | ctgaagacaa | ttttaacttg |
| 3421 | gaaaaggaaa | aagaagatgt | ccctgtggaa | atgtccaatg | gtgaaccagg | ttgccactac |
| 3481 | tttgagcagc | tccattacaa | tgacatgtgg | ctgaaggttg | gcgactgtgt | cttcatcaag |
| 3541 | tcccatggcc | tggtgcgtcc | tcgtgtgggc | agaattgaaa | aagtatgggt | tcgagatgga |
| 3601 | gctgcatatt | tttatggccc | catcttcatt | cacccagaag | aaacagagca | tgagcccaca |
| 3661 | aaaatgttct | acaaaaaaga | agtatttctg | agtaatctgg | aagaaacctg | ccccatgaca |
| 3721 | tgtattctcg | gaaagtgtgc | tgtgttgtca | ttcaaggact | tcctctcctg | caggccaact |
| 3781 | gaaataccag | aaaatgacat | tctgctttgt | gagagccgct | acaatgagag | cgacaagcag |
| 3841 | atgaagaaat | tcaaaggatt | gaagaggttt | tcactctctg | ctaaagtggt | agatgatgaa |
| 3901 | atttactact | tcagaaaacc | aattgttcct | cagaaggagc | catcaccttt | gctggaaaag |
| 3961 | aagatccagt | tgctagaagc | taaatttgcc | gagttagaag | gtggagatga | tgatattgaa |
| 4021 | gagatgggag | aagaagatag | tgagtctacc | ccaaagtctg | ccaaaggcag | tgcaaagaag |
| 4081 | gaaggctcca | aacggaaaat | caacatgagt | ggctacatcc | tgttcagcag | tgagatgagg |
| 4141 | gctgtgatta | aggcccaaca | cccagactac | tctttcgggg | agctcagccg | cctggtgggg |
| 4201 | acagaatgga | gaaatcttga | gacagccaag | aaagcagaat | atgaaggcat | gatgggtggc |
| 4261 | tatccgccag | gccttccacc | tttgcagggc | ccagttgatg | gccttgttag | catgggcagc |
| 4321 | atgcagccac | ttcaccctgg | ggggcctcca | ccccaccatc | ttccgccagg | tgtgcctggc |
| 4381 | ctcccgggca | tcccaccacc | gggtgtgatg | aaccaaggag | tggcccctat | ggtagggact |
| 4441 | ccagcaccag | gtggaagtcc | atatggacaa | caggtgggag | ttttggggcc | tccagggcag |
| 4501 | caggcaccac | ctccatatcc | cggcccacat | ccagctggac | cccctgtcat | acagcagcca |
| 4561 | acaacaccca | tgtttgtagc | tcccccacca | aagacccagc | ggcttcttca | ctcagaggcc |
| 4621 | tacctgaaat | acattgaagg | actcagtgcg | gagtccaaca | gcattagcaa | gtgggatcag |
| 4681 | acactggcag | ctcgaagacg | cgacgtccat | ttgtcgaaag | aacaggagag | ccgcctaccc |
| 4741 | tctcactggc | tgaaaagcaa | aggggcccac | accaccatgg | cagatgccct | ctggcgcctt |
| 4801 | cgagatttga | tgctccggga | caccctcaac | attcgccaag | catacaacct | agaaaatgtt |
| 4861 | taatcacatc | attacgtttc | ttttatatag | aagcataaag | agttgtggat | cagtagccat |
| 4921 | tttagttact | gggggtgggg | ggaaggaaca | aaggaggata | atttttattg | cattttactg |
| 4981 | tacatcacaa | ggccattttt | atatacggac | acttttaata | agctatttca | atttgtttgt |
| 5041 | tatattaagt | tgactttatc | aaatacacaa | agattttttt | gcatatgttt | ccttcgttta |
| 5101 | aaaccagttt | cataattggt | tgtatatgta | gacttggagt | tttatctttt | tacttgttgc |
| 5161 | catggaactg | aaaccattag | aggtttttgt | cttggcttgg | ggtttttgtt | ttcttggttt |
| 5221 | tgggtttttt | tatatatata | tataaaagaa | caaaatgaaa | aaaaacacac | acacacaaga |
| 5281 | gtttacagat | tagtttaaat | tgataatgaa | atgtgaagtt | tgtcctagtt | tacatcttag |
| 5341 | agaggggagt | atacttgtgt | ttgtttcatg | tgcctgaata | tcttaagcca | ctttctgcaa |
| 5401 | aagctgtttc | ttacagatga | agtgctttct | ttgaaaggtg | gttatttagg | ttttagatgt |
| 5461 | ttaatagaca | cagcacattt | gctctattaa | ctcagaggct | cactacagaa | atatgtaatc |
| 5521 | agtgctgtgc | atctgtctgc | agctaatgta | cctcctggac | accaggaggg | gaaaaagcac |
| 5581 | tttttcaatt | gtgctgagtt | agacatctgt | gagttagact | atggtgtcag | tgatttttgc |
| 5641 | agaacacgtg | cacaaccctg | aggtatgttt | aatctaggca | ggtacgttta | aggatatttt |
| 5701 | gatctattta | taatgaattc | acaatttatg | cctataaatt | tcagatgatt | taaaatttta |
| 5761 | aacctgttac | attgaaaaac | attgaagttc | gtcttgaaga | aagcattaag | gtatgcatgg |
| 5821 | aggtgattta | tttttaaaca | taacacctaa | cctaacatgg | gtaagagagt | atggaactag |
| 5881 | atatgagctg | tataagaagc | ataattgtga | acaagtagat | tgattgcctt | catatacaag |
| 5941 | tatgttttag | tattccttat | ttccttatta | tcagatgtat | tttttctttt | aagtttcaat |
| 6001 | gttgttataa | ttctcaacca | gaaatttaat | actttctaaa | atattttta | aatttagctt |
| 6061 | gtgcttttga | attacaggag | aagggaatca | taatttaata | aaacgcttac | tagaaagacc |
| 6121 | attacagatc | ccaaacactt | gggtttggtg | accctgtctt | tcttatatga | ccctacaata |
| 6181 | aacatttgaa | ggcagcatag | gatggcagac | agtaggaaca | ttgtttcact | tggcggcatg |
| 6241 | tttttgaaac | ctgctttata | gtaactgggt | gattgccatt | gtggtagagc | ttccactgct |
| 6301 | gtttataatc | tgagagagtt | aatctcagag | gatgcttttt | tccttttaat | ctgctatgaa |
| 6361 | tcagtaccca | gatgtttaat | tactgtactt | attaaatcat | gagggcaaaa | gagtgtagaa |
| 6421 | tggaaaaaag | tctcttgtat | ctagatactt | taaatatggg | aggcccttta | acttaattgc |
| 6481 | ctttagtcaa | ccactggatt | tgaatttgca | tcaagtattt | taaataatat | tgaatttaaa |
| 6541 | aaaatgtatt | gcagtagtgt | gtcagtacct | tattgttaaa | gtgagtcaga | taaatcttca |
| 6601 | attcctggct | atttgggcaa | ttgaatcatc | atggactgta | taatgcaatc | agattatttt |
| 6661 | gtttctagac | atccttgaat | tacaccaaag | aacatgaaat | ttagttgtgg | ttaaattatt |
| 6721 | tatttatttc | atgcattcat | tttatttccc | ttaaggtctg | gatgagactt | ctttggggag |

TABLE 1-continued

| | | | | | | |
|---|---|---|---|---|---|---|
| 6781 | cctctaaaaa | aatttttcac | tgggggccac | gtgggtcatt | agaagccaga | gctctcctcc |
| 6841 | aggctccttc | ccagtgccta | gaggtgctat | aggaaacata | gatccagcca | ggggcttccc |
| 6901 | taaagcagtg | cagcaccggc | ccagggcatc | actagacagg | ccctaattaa | gtttttttta |
| 6961 | aaaagcctgt | gtatttattt | tagaatcatg | tttttctgta | tattaacttg | ggggatatcg |
| 7021 | ttaatattta | ggatataaga | tttgaggtca | gccatcttca | aaaaagaaaa | aaaaattgac |
| 7081 | tcaagaaagt | acaagtaaac | tatacacctt | tttttcataa | gttttaggaa | ctgtagtaat |
| 7141 | gtggcttaga | aagtataatg | gcctaaatgt | tttcaaaatg | taagttcctg | tggagaagaa |
| 7201 | ttgtttatat | tgcaaacggg | gggactgagg | ggaacctgta | ggtttaaaac | agtatgtttg |
| 7261 | tcagccaact | gatttaaaag | gcctttaact | gttttggttg | ttgttttttt | tttaagccac |
| 7321 | tctccccttc | ctatgaggaa | gaattgagag | gggcacctat | ttctgtaaaa | tccccaaatt |
| 7381 | ggtgttgatg | attttgagct | tgaatgtttt | catacctgat | taaaacttgg | tttattctaa |
| 7441 | tttctgtatc | atatcatctg | aggtttacgt | ggtaactagt | cttataacat | gtatgtatct |
| 7501 | ttttttgtt | gttcatctaa | agctttttaa | tccaaataaa | tacagagttt | gcaaagtgat |
| 7561 | ttggattaac | caggaaaaaa | aaaaaaaaaa | aa | | |

SEQ ID NO: 2 Human PBRM1 Variant 1 Amino Acid Sequence (NP_060783.3)

| | | | | | | |
|---|---|---|---|---|---|---|
| 1 | mgskrrrats | psssysgdfd | dghhsystpg | psrkrrrlsn | lptvdpiavc | helyntirdy |
| 61 | kdeqgrllce | lfirapkrrn | qpdyyevvsq | pidlmkiqqk | lkmeeyddvn | lltadfqllf |
| 121 | nnaksyykpd | speykaackl | wdlylrtrne | fvqkgeadde | dddedgqdnq | gtvtegsspa |
| 181 | ylkeileqll | eaivvatnps | grliselfqk | lpskvqypdy | yaiikepidl | ktiaqriqng |
| 241 | syksihamak | didllaknak | tynepgsqvf | kdansikkif | ymkkaeiehh | emaksslrmr |
| 301 | tpsnlaaarl | tgpshskgsl | geernptsky | yrnkravqgg | rlsaitmalq | ygseseedaa |
| 361 | laaaryeege | seaesitsfm | dvsnpfyqly | dtvrscrnnq | gqliaepfyh | lpskkkypdy |
| 421 | yqqikmpisl | qqirtklknq | eyetldhlec | dlnlmfenak | rynvpnsaiy | krvlklqqvm |
| 481 | qakkkelarr | ddiedgdsmi | ssatsdtgsa | krkskknirk | qrmkilfnvv | learepgsgr |
| 541 | rlcdlfmvkp | skkdypdyyk | iilepmdlki | iehnirndky | ageegmiedm | klmfrnarhy |
| 601 | neegsqvynd | ahilekllke | krkelgplpd | dddmaspklk | lsrksgispk | kskymtpmqq |
| 661 | klnevyeavk | nytdkrgrrl | saiflrlpsr | selpdyylti | kkpmdmekir | shmmankyqd |
| 721 | idsmvedfvm | mfnnactyne | pesliykdal | vlhkvlletr | rdlegdedsh | vpnvtlliqe |
| 781 | lihnlfvsvm | shqddegrcy | sdslaeipav | dpnfpnkppl | tfdiirknve | nnryrrldlf |
| 841 | qehmfevler | arrmnrtdse | iyedavelqq | ffikirdelc | kngeillspa | lsyttkhlhn |
| 901 | dvekerkekl | pkeieedklk | reeekreaek | sedssgaagl | sglhrtysqd | csfknsmyhv |
| 961 | gdyvyvepae | anlqphivci | erlwedsaek | evfksdyynk | vpvskilgkc | vvmfvkeyfk |
| 1021 | lcpenfrded | vfvcesrysa | ktksfkkikl | wtmpissvrf | vprdvplpvv | rvasvfanad |
| 1081 | kgddekntdn | sedsraednf | nlekekedvp | vemsngepgc | hyfeqlhynd | mwlkvgdovf |
| 1141 | ikshglvrpr | vgriekvwvr | dgaayfygpi | fihpeetehe | ptkmfykkev | flsnleetcp |
| 1201 | mtcilgkcav | lsfkdflscr | pteipendil | lcesrynesd | kqmkkfkglk | rfslsakvvd |
| 1261 | deiyyfrkpi | vpqkepspll | ekkiqlleak | faeleggddd | ieemgeedse | stpksakgsa |
| 1321 | kkegskrkin | msgyilfsse | mravikaqhp | dysfgelsrl | vgtewrnlet | akkaeyegmm |
| 1381 | ggyppglppl | qgpvdglvsm | gsmqplhpgg | ppphhlppgv | pglpgipppg | vmnqgvapmv |
| 1441 | gtpapggspy | gqqvgvlgpp | gqqapppypg | phpagppviq | qpttpmfvap | ppktgrllhs |
| 1501 | eaylkyiegl | saesnsiskw | dqtlaarrrd | vhlskeqesr | lpshwlkskg | ahttmadalw |
| 1561 | rlrdlmlrdt | lnirqaynle | nv | | | |

SEQ ID NO: 3 Human PBRM1 Transcript Variant 2 cDNA Sequence (NM_181042.4)

| | | | | | | |
|---|---|---|---|---|---|---|
| 1 | gcggccgggg | ctgcaggcgg | cggagcggct | ggcttgccaa | cacttggtgt | cacatgtgag |
| 61 | cctcccacat | gtattcactc | tccattccag | ctctgtgatt | gaactctgct | cttattgact |
| 121 | agggggcagt | tgggcaggca | tgcctcattc | ctggaattga | cagtcattcc | taataagttg |
| 181 | gattccatgg | gttccaagag | aagaagagct | acctcccctt | ccagcagtgt | cagcggggac |
| 241 | tttgatgatg | ggcaccattc | tgtgtcaaca | ccaggcccaa | gcaggaaaag | gaggagactt |
| 301 | tccaatcttc | caactgtaga | tcctattgcc | gtgtgccatg | aactctataa | taccatccga |
| 361 | gactataagg | atgaacaggg | cagacttctc | tgtgagctct | tcattagggc | accaaagcga |
| 421 | agaaatcaac | cagactatta | tgaagtggtt | tctcagccca | ttgacttgat | gaaaatccaa |
| 481 | cagaaactaa | aaatggaaga | gtatgatgat | gttaatttgc | tgactgctga | cttccagctt |
| 541 | ctttttaaca | atgcaaagtc | ctattataag | ccagattctc | ctgaatataa | agccgcttgc |
| 601 | aaactctggg | atttgtacct | tcgaacaaga | aatgagtttg | ttcagaaagg | agaagcagat |
| 661 | gacgaagatg | atgatgaaga | tgggcaagac | aatcagggca | cagtgactga | aggatcttct |
| 721 | ccagcttact | tgaaggagat | cctggagcag | cttcttgaag | ccatagttgt | agctacaaat |
| 781 | ccatcaggac | gtctcattag | cgaacttttt | cagaaactgc | cttctaaagt | gcaatatcca |
| 841 | gattattatg | caataattaa | ggagcctata | gatctcaaga | ccattgccca | gaggatacag |
| 901 | aatggaagct | acaaaagtat | tcatgcaatg | gccaaagata | tagatctcct | cgcaaaaaat |
| 961 | gccaaaactt | ataatgagcc | tggctctcaa | gtattcaagg | atgcaaattc | aattaaaaaa |
| 1021 | atattttata | tgaaaaaggc | tgaaattgaa | catcatgaaa | tggctaagtc | aagtcttcga |
| 1081 | atgaggactc | catccaactt | ggctgcagcc | agactgacag | gtccttcaca | cagtaaaggc |
| 1141 | agccttggtg | aagagagaaa | tcccactagc | aagtattacc | gtaataaaag | agcagtacaa |
| 1201 | ggaggtcgtt | tatcagcaat | tacaatggca | cttcaatatg | gctcagaaag | tgaagaagat |
| 1261 | gctgctttag | ctgctgcacg | ctatgaagag | ggagagtcag | aagcagaaag | catcacttcc |
| 1321 | tttatggatg | tttcaaatcc | tttttatcag | ctttatgaca | cagttaggag | ttgtcggaat |
| 1381 | aaccaagggc | agctaatagc | tgaacctttt | taccatttgc | cttcaaagaa | aaaataccct |
| 1441 | gattattacc | agcaaattaa | aatgcccata | tcactacaac | agatccgaac | aaaactgaag |
| 1501 | aatcaagaat | atgaaacttt | agatcatttg | gagtgtgatc | tgaatttaat | gtttgaaaat |
| 1561 | gccaaacgct | ataatgtgcc | caattcagcc | atctacaagc | gagttctaaa | attgcagcaa |
| 1621 | gttatgcagg | caaagaagaa | agagcttgcc | aggagagacg | atatcgagga | cggagacagc |
| 1681 | atgatctctt | cagccacctc | tgatactggt | agtgccaaaa | gaaaaagtaa | aaagaacata |
| 1741 | agaaagcagc | gaatgaaaat | cttattcaat | gttgttcttg | aagctcgaga | gccaggttca |
| 1801 | ggcagaagac | tttgtgacct | atttatggtt | aaaccatcca | aaaaggacta | tcctgattat |
| 1861 | tataaaatca | tcttggagcc | aatggacttg | aaaataattg | agcataacat | ccgcaatgac |
| 1921 | aaatatgctg | gtgaagaggg | aatgatagaa | gacatgaagc | tgatgttccg | gaatgccagg |
| 1981 | cactataatg | aggagggctc | ccaggtttat | aatgatgcac | atatcctgga | gaagttactc |
| 2041 | aaggagaaaa | ggaaagagct | gggcccactg | cctgatgatg | atgacatggc | ttctcccaaa |

TABLE 1-continued

| | | | | | | |
|---|---|---|---|---|---|---|
| 2101 | ctcaagctga | gtaggaagag | tggcatttct | cctaaaaaat | caaaatacat | gactccaatg |
| 2161 | cagcagaaac | taaatgaggt | ctatgaagct | gtaaagaact | atactgataa | gaggggtcgc |
| 2221 | cgcctcagtg | ccatatttct | gaggcttccc | tctagatctg | agttgcctga | ctactatctg |
| 2281 | actattaaaa | agcccatgga | catggaaaaa | attcgaagtc | acatgatggc | caacaagtac |
| 2341 | caagatattg | actctatggt | tgaggacttt | gtcatgatgt | ttaataatgc | ctgtacatac |
| 2401 | aatgagccgg | agtctttgat | ctacaaagat | gctcttgttc | tacacaaagt | cctgcttgaa |
| 2461 | acacgcagag | acctggaggg | agatgaggac | tctcatgtcc | caaatgtgac | tttgctgatt |
| 2521 | caagagctta | tccacaatct | tttgtgtca | gtcatgagtc | atcaggatga | tgagggaaga |
| 2581 | tgctacagcg | attctttagc | agaaattcct | gctgtggatc | ccaactttcc | taacaaacca |
| 2641 | ccccttacat | ttgacataat | taggaagaat | gttgaaaata | atcgctaccg | tcggcttgat |
| 2701 | ttatttcaag | agcatatgtt | tgaagtattg | gaacgagcaa | gaaggatgaa | tcggacagat |
| 2761 | tcagaaatat | atgaagatgc | agtagaactt | cagcagtttt | ttattaaaat | tcgtgatgaa |
| 2821 | ctctgcaaaa | atggagagat | tcttctttca | ccggcactca | gctataccac | aaaacatttg |
| 2881 | cataatgatg | tggagaaaga | gagaaaggaa | aaattgccaa | aagaaataga | ggaagataaa |
| 2941 | ctaaaacgag | aagaagaaaa | aagagaagct | gaaaagagtg | aagattcctc | tggtgctgca |
| 3001 | ggcctctcag | gcttacatcg | cacatacagc | caggactgta | gctttaaaaa | cagcatgtac |
| 3061 | catgttggag | attacgtcta | tgtggaacct | gcagaggcca | acctacaacc | acatatcgtc |
| 3121 | tgtattgaaa | gactgtggga | ggattcagct | ggtgaaaaat | ggttgtatgg | ctgttggttt |
| 3181 | taccgaccaa | atgaaacatt | ccacctggct | acacgaaaat | ttctagaaaa | agaagttttt |
| 3241 | aagagtgact | attacaacaa | agttccagtt | agtaaaattc | taggcaagtg | tgtggtcatg |
| 3301 | tttgtcaagg | aatactttaa | gttatgccca | gaaaacttcc | gagatgagga | tgtttttgtc |
| 3361 | tgtgaatcac | ggtattctgc | caaaaccaaa | tcttttaaga | aaattaaact | gtggaccatg |
| 3421 | cccatcagct | cagtcaggtt | tgtccctcgg | gatgtgcctc | tgcctgtggt | tcgcgtggcc |
| 3481 | tctgtatttg | caaatgcaga | taaaggtgat | gatgagaaga | atacagacaa | ctcagaggac |
| 3541 | agtcgagctg | aagacaattt | taacttggaa | aaggaaaaag | aagatgtccc | tgtggaaatg |
| 3601 | tccaatggtg | aaccaggttg | ccactacttt | gagcagctcc | attacaatga | catgtggctg |
| 3661 | aaggttggcg | actgtgtctt | catcaagtcc | catggcctgg | tgcgtcctcg | tgtgggcaga |
| 3721 | attgaaaaag | tatgggttcg | agatggagct | gcatattttt | atggccccat | cttcattcac |
| 3781 | ccagaagaaa | cagagcatga | gcccacaaaa | atgttctaca | aaaaagaagt | atttctgagt |
| 3841 | aatctggaag | aaacctgccc | catgacatgt | attctcggaa | agtgtgctgt | gttgtcattc |
| 3901 | aaggacttcc | tctcctgcag | gccaactgaa | ataccagaaa | atgacattct | gctttgtgag |
| 3961 | agccgctaca | atgagagcga | caagcagatg | aagaaattca | aaggattgaa | gaggttttca |
| 4021 | ctctctgcta | aagtggtaga | tgatgaaatt | tactacttca | gaaaaccaat | tgttcctcag |
| 4081 | aaggagccat | cacctttgct | ggaaaagaag | atccagttgc | tagaagctaa | atttgccgag |
| 4141 | ttagaaggtg | gagatgatga | tattgaagag | atgggagaag | aagatagtga | ggtcattgaa |
| 4201 | cctccttctc | tacctcagct | tcagaccccc | ctggccagtg | agctggacct | catgccctac |
| 4261 | acacccccac | agtctacccc | aaagtctgcc | aaaggcagtg | caaagaagga | aggctccaaa |
| 4321 | cggaaaatca | acatgagtgg | ctacatcctg | ttcagcagtg | agatgagggc | tgtgattaag |
| 4381 | gcccaacacc | cagactactc | tttcggggag | ctcagccgcc | tggtggggac | agaatggaga |
| 4441 | aatcttgaga | cagccaagaa | agcagaatat | gaaggtgtga | tgaaccaagg | agtggcccct |
| 4501 | atggtaggga | ctccagcacc | aggtggaagt | ccatatggac | aacaggtggg | agttttgggg |
| 4561 | cctccagggc | agcaggcacc | acctccatat | cccggcccac | atccagctgg | acccccctgtc |
| 4621 | atacagcagc | caacaacacc | catgtttgta | gctcccccac | caaagaccca | gcggcttctt |
| 4681 | cactcagagg | cctacctgaa | atacattgaa | ggactcagtg | cggagtccaa | cagcattagc |
| 4741 | aagtgggatc | agacactggc | agctcgaaga | cgcgacgtcc | atttgtcgaa | agaacaggag |
| 4801 | agccgcctac | cctctcactg | gctgaaaagc | aaagggcccc | acaccaccat | ggcagatgcc |
| 4861 | ctctggcgcc | ttcgagattt | gatgctccgg | gacaccctca | acattcgcca | agcatacaac |
| 4921 | ctagaaaatg | tttaatcaca | tcattacgtt | tcttttatat | agaagcataa | agagttgtgg |
| 4981 | atcagtagcc | attttagtta | ctgggggtgg | ggggaaggaa | caaaggagga | taatttttat |
| 5041 | tgcattttac | tgtacatcac | aaggccattt | ttatatacgg | acacttttaa | taagctattt |
| 5101 | caatttgttt | gttatattaa | gttgacttta | tcaaatacac | aaagattttt | ttgcatatgt |
| 5161 | ttccttcgtt | taaaaccagt | ttcataattg | gttgtatatg | tagacttgga | gttttatctt |
| 5221 | tttacttgtt | gccatggaac | tgaaaccatt | agaggttttt | gtcttggctt | ggggtttttg |
| 5281 | ttttcttggt | tttgggtttt | tttatatata | tatataaaag | aacaaaatga | aaaaaaacac |
| 5341 | acacacacaa | gagtttacag | attagtttaa | attgataatg | aaatgtgaag | tttgtcctag |
| 5401 | tttacatctt | agagagggga | gtatacttgt | gtttgtttca | tgtgcctgaa | tatcttaagc |
| 5461 | cactttctgc | aaaagctgtt | tcttacagat | gaagtgcttt | ctttgaaagg | tggttattta |
| 5521 | ggttttagat | gtttaataga | cacagcacat | ttgctctatt | aactcagagg | ctcactacag |
| 5581 | aaatatgtaa | tcagtgctgt | gcatctgtct | gcagctaatg | tacctcctgg | acaccaggag |
| 5641 | gggaaaaagc | actttttcaa | ttgtgctgag | ttagacatct | gtgagttaga | ctatggtgtc |
| 5701 | agtgattttt | gcagaacacg | tgcacaaccc | tgaggtatgt | ttaatctagg | caggtacgtt |
| 5761 | taaggatatt | ttgatctatt | tataatgaat | tcacaattta | tgcctataaa | tttcagatga |
| 5821 | tttaaaattt | taaacctgtt | acattgaaaa | acattgaagt | tcgtcttgaa | gaaagcatta |
| 5881 | aggtatgcat | ggaggtgatt | tatttttaaa | cataacacct | aacctaacat | gggtaagaga |
| 5941 | gtatggaact | agatatgagc | tgtataagaa | gcataattgt | gaacaagtag | attgattgcc |
| 6001 | ttcatataca | agtatgtttt | agtattcctt | atttccttat | tatcagatgt | atttttttctt |
| 6061 | ttaagtttca | atgttgttat | aattctcaac | cagaaattta | atactttcta | aaatattttt |
| 6121 | taaatttagc | ttgtgctttt | gaattacagg | agaagggaat | cataatttaa | taaaacgctt |
| 6181 | actagaaaga | ccattacaga | tcccaaacac | ttgggtttgg | tgaccctgtc | tttcttatat |
| 6241 | gaccctacaa | taaacatttg | aaggcagcat | aggatggcag | acagtaggaa | cattgtttca |
| 6301 | cttggcggca | tgtttttgaa | acctgcttta | tagtaactgg | gtgattgcca | ttgtggtaga |
| 6361 | gcttccactg | ctgtttataa | tctgagagag | ttaatctcag | aggatgcttt | tttcctttta |
| 6421 | atctgctatg | aatcagtacc | cagatgttta | attactgtac | ttattaaatc | atgagggcaa |
| 6481 | aagagtgtag | aatggaaaaa | agtctcttgt | atctagatac | tttaaatatg | ggaggccctt |
| 6541 | taacttaatt | gcctttagtc | aaccactgga | tttgaatttg | catcaagtat | tttaaataat |
| 6601 | attgaattta | aaaaaatgta | ttgcagtagt | gtgtcagtac | cttattgtta | aagtgagtca |
| 6661 | gataaatctt | caattcctgg | ctatttgggc | aattgaatca | tcatggactg | tataatgcaa |
| 6721 | tcagattatt | ttgtttctag | acatccttga | attacaccaa | agaacatgaa | atttagttgt |
| 6781 | ggttaaatta | tttatttatt | tcatgcattc | attttatttc | ccttaaggtc | tggatgagac |
| 6841 | ttctttgggg | agcctctaaa | aaaatttttc | actgggggcc | acgtgggtca | ttagaagcca |

TABLE 1-continued

```
6901 gagctctcct ccaggctcct tcccagtgcc tagaggtgct ataggaaaca tagatccagc
6961 caggggcttc cctaaagcag tgcagcaccg gcccagggca tcactagaca ggccctaatt
7021 aagttttttt taaaaagcct gtgtatttat tttagaatca tgtttttctg tatattaact
7081 tgggggatat cgttaatatt taggatataa gatttgaggt cagccatctt caaaaaagaa
7141 aaaaaaattg actcaagaaa gtacaagtaa actatacacc ttttttcat aagttttagg
7201 aactgtagta atgtggctta gaaagtataa tggcctaaat gttttcaaaa tgtaagttcc
7261 tgtggagaag aattgtttat attgcaaacg gggggactga ggggaacctg taggtttaaa
7321 acagtatgtt tgtcagccaa ctgatttaaa aggcctttaa ctgttttggt tgttgttttt
7381 tttttaagcc actctcccct tcctatgagg aagaattgag aggggcacct atttctgtaa
7441 aatccccaaa ttggtgttga tgattttgag cttgaatgtt ttcatacctg attaaaactt
7501 ggtttattct aatttctgta tcatatcatc tgaggtttac gtggtaacta gtcttataac
7561 atgtatgtat cttttttttg ttgttcatct aaagcttttt aatccaaat
```

SEQ ID NO: 4 Human PBRM1 Variant 2 Amino Acid Sequence (NP_851385.1)

```
   1 mgskrrrats psssysgdfd dghhsystpg psrkrrrlsn lptvdpiavc helyntirdy
  61 kdeqgrllce lfirapkrrn qpdyyevvsq pidlmkiqqk lkmeeyddvn lltadfqllf
 121 nnaksyykpd speykaackl wdlylrtrne fvqkgeadde dddedgqdnq gtvtegsspa
 181 ylkeilegll eaivvatnps grliselfqk lpskvqypdy yaiikepidl ktiagrigng
 241 syksihamak didllaknak tynepgsqvf kdansikkif ymkkaeiehh emaksslrmr
 301 tpsnlaaarl tgpshskgsl geernptsky yrnkravqgg rlsaitmalq ygseseedaa
 361 laaaryeege seaesitsfm dvsnpfyqly dtvrscrnnq gqliaepfyh lpskkkypdy
 421 yqqikmpisl qqirtklknq eyetldhlec dlnlmfenak rynvpnsaiy krvlklqqvm
 481 qakkkelarr ddiedgdsmi sssatsdtgsa krkskknirk qrmkilfnvv leareprgsgr
 541 rlcdlfmvkp skkdypdyyk iilepmdlki iehnirndky ageegmiedm klmfrnarhy
 601 neegsqvynd ahileklkle krkelgplpd dddmaspklk lsrksgispk kskymtpmqq
 661 klnevyeavk nytdkrgrrl saiflrlpsr selpdyylti kkpmdmekir shmmankyqd
 721 idsmvedfvm mfnnactyne pesliykdal vlhkvlletr rdlegdedsh vpnvtlliqe
 781 lihnlfvsvm shqddegrcy sdslaeipav dpnfpnkppl tfdiirknve nnryrrldlf
 841 qehmfevler arrmnrtdse iyedavelqq ffikirdelc kngeillspa lsyttkhlhn
 901 dvekerkekl pkeieedklk reeekreaek sedssgaagl sglhrtysqd csfknsmyhv
 961 gdyvyvepae anlqphivci erlwedsage kwlygcwfyr pnetfhlatr kflekevfks
1021 dyynkvpvsk ilgkcvvmfv keyfklcpen frdedvfvce srysaktksf kkiklwtmpi
1081 ssvrfvprdv plpvvrvasv fanadkgdde kntdnsedsr aednfnleke kedvpvemsn
1141 gepgchyfeq lhyndmwlkv gdcvfikshg lvrprvgrie kvwvrdgaay fygpifihpe
1201 eteheptkmf ykkevflsnl eetcpmtcil gkcavlsfkd flscrpteip endillcesr
1261 ynesdkqmkk fkglkrfsls akvvddeiyy frkpivpqke psplleekkiq lleakfaele
1321 ggdddieemg eedseviepp slpqlqtpla seldlmpytp pgstpksakg sakkegskrk
1381 inmsgyilfs semravikaq hpdysfgels rlvgtewrnl etakkaeyeg vmnqgvapmv
1441 gtpapggspy gqqvgvlgpp gqqapppypg phpagppviq qpttpmfvap ppktgrllhs
1501 eaylkyiegl saesnsiskw dqtlaarrrd vhlskeqesr lpshwlkskg ahttmadalw
1561 rlrdlmlrdt lnirqaynle nv
```

SEQ ID NO: 5 Mouse PBRM1 cDNA Sequence (NM_001081251.1)

```
   1 ggatttacgg cagcactggg aggggtgagg gcggtgaggg cggcgggtgc cggagagacg
  61 gccgcggcca gaggagcgct agcagccgtg gcggccacgg ggcggggctc ggcggtcggg
 121 gaccgcagcc ggggctgcag gcggcggagc ggcgggcttg ccaacacttg gtgtcacatg
 181 tgagcctccc acatgtgtgc actctccatt ccagctctgt gattgaactc tgctcttatt
 241 gactaggggg cacttgggca ggcatgcttc attcctggag ttgacagtca tttcataaga
 301 agttggattc catgggttcc aagagaagaa gagccacctc tccttccagc agtgtcagtg
 361 gagactttga tgacgggcac cattctgtgc ctacaccagg cccaagcagg aaaaggagaa
 421 gactgtccaa tcttccaact gtagatccta ttgctgtgtg ccatgaactc tataacacca
 481 tccgagacta taaggatgaa cagggcagac tcctctgtga gctgttcatt agggctccaa
 541 agcggagaaa tcaaccagac tattatgaag tggtttctca gcccattgac ttgatgaaaa
 601 tccaacagaa acttaaaatg gaagagtatg atgatgttaa tctactgact gctgacttcc
 661 agctgctttt taacaatgca aaggcctact ataagccaga ttcccctgag tataaagctg
 721 cttgtaaact ctgggatttg taccttcgaa caagaaatga gtttgttcag aaaggagaag
 781 cagacgatga agatgatgac gaagatgggc aagacaatca aggcacactg gctgacggct
 841 cttctccagg ttatctgaag gagatcctgg agcagcttct tgaagccata gttgtagcca
 901 caaatccatc aggacggctc atcagtgaac tttttcagaa actgccttcc aaagtgcaat
 961 atccagacta ttatgcaata attaaggaac ctatagatct caagaccatt gctcagagga
1021 tacagaatgg aagctacaaa agtatacacg caatggccaa agatatagat cttctagcaa
1081 aaaatgccaa aacatacaat gagcctgggt ctcaagtatt caaggatgcc aattcgatta
1141 aaaaaatatt ttatatgaaa aaggcagaaa ttgaacatca tgaaatgact aaatcaagtc
1201 ttcgaataag gactgcatca aatttggctg cagccaggct gacaggtcct tcgcacaata
1261 aaagcagcct tggtgaagaa agaaacccca ctagcaagta ttaccgtaat aaaagagcag
1321 tccaaggggg tcgcttgtca gcaattacca tggcacttca gtatggatca gagagtgaag
1381 aggacgctgc tttagctgct gcacgctatg aagaagggga atctgaagca gagagcatca
1441 cttccttcat ggacgtttcc aacccctttc atcagcttta cgacacagtt aggagctgta
1501 ggaatcacca agggcagctc atagctgaac ctttcttcca tttgccttca aagaaaaaat
1561 acccagatta ttatcagcaa attaaaatgc ccatatcact tcaacagatc agaacaaagc
1621 taaagaacca agaatatgaa actttagatc atttggagtg tgatctgaat ttaatgtttg
1681 aaaatgccaa acgttataac gttcccaatt cagccatcta taagcgagtt ctaaaactgc
1741 agcaagtcat gcaggcaaag aagaaggagc ttgcgaggag agatgacatt gaggacggag
1801 acagcatgat ctcctcagcc acttctgaca ctggtagtgc caaaaggaaa aggaatactc
1861 atgacagtga gatgttgggt ctcaggaggc tatccagtaa aaagaacata agaaaacagc
1921 gaatgaaaat tttattcaat gttgttcttg aagctcgaga gccaggttca ggcagaagac
1981 tttgcgatct atttatggtt aagccatcca agaaggacta tcctgattat tataaaatca
2041 tcttagagcc aatggacctg aaaataattg agcataacat ccgaaatgac aaatatgcag
2101 gtgaagaagg aatgatggaa gacatgaaac tcatgttccg caatgccagg cactacaatg
2161 aggagggctc ccaggtatac aatgatgccc atatcctgga gaagttactc aaagataaaa
```

TABLE 1-continued

| | | | | | | |
|---|---|---|---|---|---|---|
| 2221 | ggaaagagct | gggccctctg | cctgatgatg | atgacatggc | ttctcccaaa | cttaaattga |
| 2281 | gtaggaagag | tggtgtttct | cctaagaaat | caaagtacat | gactccaatg | cagcagaaac |
| 2341 | tgaatgaagt | gtatgaagct | gtaaagaact | atactgataa | gaggggtcgc | cgccttagtg |
| 2401 | ctatatttct | aagactcccc | tctagatcag | agctgcctga | ctactacctg | accattaaaa |
| 2461 | agcccatgga | catggaaaaa | attcgaagtc | acatgatggc | aaacaagtac | caagacatag |
| 2521 | attctatggt | agaggacttt | gtcatgatgt | ttaataatgc | ctgtacctac | aatgaaccag |
| 2581 | agtctttgat | ctacaaagat | gcccttgtac | tgcataaagt | cctccttgag | actcggagag |
| 2641 | acctggaggg | agatgaggat | tctcatgtcc | ctaatgtgac | gttgctgatt | caagagctca |
| 2701 | tccataacct | tttgtgtca | gtcatgagtc | atcaggatga | cgaagggagg | tgttacagcg |
| 2761 | actccttagc | agaaattcct | gctgtggatc | ccaactctcc | caataaacct | ccccttacat |
| 2821 | ttgacattat | caggaaaaat | gttgaaagta | atcggtatcg | gcgacttgat | ttatttcagg |
| 2881 | agcatatgtt | tgaagtattg | gaacgggcaa | gaaggatgaa | ccggacagat | tccgaaatat |
| 2941 | atgaggatgc | tgtagaactt | cagcagtttt | ttattagaat | tcgtgatgaa | ctctgcaaaa |
| 3001 | atggagagat | ccttctttct | ccagcactca | gctataccac | aaaacacttg | cataacgatg |
| 3061 | tggaaaaaga | aaaaaaggaa | aaattgccta | aagaaataga | ggaagataaa | ctaaaacgcg |
| 3121 | aagaagaaaa | aagagaagct | gaaaaaagtg | aagattcctc | aggtactaca | ggcctctcag |
| 3181 | gcttacatcg | tacatacagc | caggactgca | gctttaagaa | cagcatgtat | catgtcggag |
| 3241 | attatgtcta | tgttgaacct | gcggaggcca | atctacaacc | acatatagtg | tgtattgaga |
| 3301 | gactgtggga | ggattcagct | ggtgaaaaat | ggttgtacgg | ctgttggttt | tatcggccaa |
| 3361 | atgaaacatt | ccatttggct | acacgaaaat | ttctagaaaa | agaagttttt | aagagtgact |
| 3421 | actacaataa | agtacctgtt | agtaaaattc | taggcaaatg | tgtagtcatg | tttgtcaagg |
| 3481 | aatactttaa | attatgtcca | gaaaactttc | gcgatgagga | tgtttttgtc | tgtgaatcga |
| 3541 | ggtattctgc | caaaaccaaa | tcttttaaga | aaattaaact | gtggaccatg | cccatcagtt |
| 3601 | cagttagatt | tgtccctcgg | gatgtgcctt | tgcctgtggt | ccgagtggcc | tctgtgtttg |
| 3661 | caaatgcaga | taaaggggat | gatgagaaga | atacagacaa | ctcagatgac | aatagagctg |
| 3721 | aagacaattt | taacttggaa | aaggaaaaag | aagatgttcc | tgtggagatg | tccaatggtg |
| 3781 | agccaggttg | ccactacttt | gagcagcttc | ggtacaatga | catgtggctg | aaggttggtg |
| 3841 | attgtgtctt | catcaaatcc | cacggcttgg | tgcgccctcg | tgtgggcaga | attgagaaag |
| 3901 | tatgggtccg | agatggagct | gcatattttt | atggccctat | cttcattcat | ccagaagaaa |
| 3961 | cagaacatga | gcccacaaaa | atgttctaca | aaaaagaagt | gtttctgagt | aatctggaag |
| 4021 | agacctgccc | tatgagttgt | attctgggga | aatgtgcagt | gctgtcattc | aaggacttcc |
| 4081 | tctcctgcag | gccaactgaa | ataccagaaa | atgacattct | gctttgtgag | agccgctata |
| 4141 | atgagagtga | caagcagatg | aagaagttca | agggtttgaa | gaggttttca | ctctctgcta |
| 4201 | aagttgtaga | tgatgaaatc | tactacttca | gaaaaccaat | cattcctcag | aaggaaccct |
| 4261 | cacctttgtt | agaaaagaag | atacaattgc | tagaagctaa | atttgcagag | ttagaaggag |
| 4321 | gagatgatga | tattgaggag | atgggagaag | aggatagtga | agtcattgaa | gctccatctc |
| 4381 | tacctcaact | gcagacaccc | ctggccaatg | agttggacct | catgccctat | acacccccac |
| 4441 | agtctacccc | aaagtctgcc | aaaggcagtg | caaagaagga | aagttctaaa | cgaaaaatca |
| 4501 | acatgagtgg | ctacattttg | ttcagcagtg | aaatgagagc | tgtgattaaa | gcccagcacc |
| 4561 | cagactactc | ttttggggag | ctcagcagac | tggtggggac | agaatggaga | aaccttgaaa |
| 4621 | cagccaagaa | agcagaatat | gaagagcggg | cagctaaagt | tgctgagcag | caggagagag |
| 4681 | agcgagcagc | acagcaacag | cagccgagtg | cttctccccg | agcaggcacc | cctgtggggg |
| 4741 | ctctcatggg | ggtggtgcca | ccaccaacac | caatggggat | gctcaatcag | cagttgacac |
| 4801 | ctgttgcagg | catgatgggt | ggctatccgc | caggccttcc | acctttgcag | ggcccagttg |
| 4861 | atggccttgt | tagcatgggc | agcatgcagc | cacttcaccc | tggggggcct | ccacctcacc |
| 4921 | atcttccgcc | aggtgtgcct | ggcctcccag | gcatcccacc | accgggtgtg | atgaatcaag |
| 4981 | gagtagcccc | catggtaggg | actccagcac | caggtggaag | tccgtatgga | caacaggtag |
| 5041 | gagttttggg | acctccaggg | cagcaggcac | cacctccata | tcctggtcct | catccagctg |
| 5101 | gcccccctgt | catacagcag | ccaacaacgc | ccatgtttgt | ggctccccca | ccaaagaccc |
| 5161 | aaaggcttct | ccactcagag | gcctacctga | aatacattga | aggactcagt | gctgaatcca |
| 5221 | acagcattag | caagtgggac | caaactttgg | cagctcgaag | acgggatgtc | catttgtcca |
| 5281 | aagaacagga | gagccgccta | ccttctcact | ggctcaaaag | taaaggggca | cacaccacca |
| 5341 | tggcagatgc | cctctggcgc | ctacgggatt | taatgcttcg | agacactctc | aacatccgac |
| 5401 | aggcatacaa | cctagaaaat | gtttaatcac | atcactgttt | cttctgtgga | agcaaagagt |
| 5461 | tgtggagcgg | tagccatttt | agttactggg | gtgggaggga | ggaacaaagg | atgataattt |
| 5521 | ttattgcatt | ttattgtaca | tcacacagcc | atttttatat | aaggacactt | ttaataagct |
| 5581 | atttcaaatt | tggttttgtt | acattaagtt | gactatcaaa | tacacaaaag | atttttttg |
| 5641 | catatgtttc | ctttgtttaa | aaccagtttc | ataattggtt | atatatagta | atagttttat |
| 5701 | ctttacttgt | taaaggactt | aaatcatcaa | aggttttggc | ttggcttagg | gttttcgttt |
| 5761 | tctttttat | aaatatatat | tatatatata | tacacatata | aaagaaaaaa | tgaaaaaaaa |
| 5821 | gtttacaaat | ttaagttgac | aatgaaatgt | gaagttggtc | ctagtttaca | tcttagagga |
| 5881 | atgtatatgt | atgttttaca | tgcctaaata | tctgcaggtt | ttcttacagg | taaagcgaag |
| 5941 | tgctttgaaa | agtttagatt | atacatgtgt | gacagatgcg | gcatatttgc | tctattaaca |
| 6001 | cagaggctta | ctatagaaat | ctaaagtcaa | tgctgtacat | ccatccagtt | agtgtaactg |
| 6061 | aagggaaatg | taactttgtg | ctgagttaga | catctgtatt | gtcagtgatt | cttgtagaat |
| 6121 | atgtgctcag | atctgagtta | tatttagttt | tggaaggtaa | gttgaagagt | acttttgatc |
| 6181 | agtttatgat | tcagtttatg | attttagttt | ttgccttcat | gttatacatt | tatgatttga |
| 6241 | aactgtacat | ctgttacctt | gaaaaacatt | gaagaaagta | ctgaagtgtg | catggaggtg |
| 6301 | gtttaagcat | aatacttaac | ccaagaaaga | gtgtaagtgg | acacaagctg | tgcctgcaca |
| 6361 | tagctgtgca | gggtagactg | cctacataca | catggccggg | attctttatt | tccttgttat |
| 6421 | caattatagt | gctttgtttg | tttcagggtt | ggaattctca | accagaaata | atactttcta |
| 6481 | aaatatttta | aaattcagct | tgtgctttgg | attatagaag | gaaattatac | tttaagaaaa |
| 6541 | tgttcacaaa | aaaaaaaaaa | aaaaaaggac | tattacagat | cccaatactt | ggatttggtg |
| 6601 | accttgtctt | tctttctttt | cttgagacat | ggtcctacta | ccaaccctgg | ctggactgga |
| 6661 | gctcagtgta | tagaccaggc | tagtctcaaa | ctctgcctct | tcctcccaag | tgctgggatt |
| 6721 | aagggcaggt | accatagtgc | tcagcaacca | caaccctgtc | tttccaacac | ggccctagcg |
| 6781 | taagcactga | ggcagtgtgc | agtgctcagg | cagcagcaaa | catttcccgg | gggtggtttt |
| 6841 | gaacctgctt | gggtggttgt | gtggtgctga | cgctgccact | gccctgttgt | tcattgagaa |
| 6901 | tgattgttaa | atgacactct | tcctttagaa | tataacggat | cagtactcat | gtttaattgc |
| 6961 | catgcttaat | aaatcatgag | aacaaaagag | tatagaatgg | aaagcattcc | ctggtagcta |

TABLE 1-continued

```
7021 ctttaaatac aggagccctg taacttaata ccagtagtca accactggat ctcagttttc
7081 atcaagtatt ttaaataaat aatcttaaat tttaaaatac gtactgcaga gtatgccagt
7141 atcttattgt taaaactgaa tcaaataaat cttcgattcc tggttatttg gaccattgac
7201 tcatcatgga ctatataatg taataagatt cttttctctt aaggtatcct tgaattacac
7261 caaagaacca gaaacttaat tttggttaaa ttatttattt atttcatgca ttaattttct
7321 ttttcttttt aaaggtttag atgaggctcc ttagggagtc tctaaaaccg cttcactatc
7381 agcaaccagg agtactagaa gccagagcac tcttcctcct ggctcctccc cagtgctcta
7441 gtgctgtagg aaccaagagc cagccccagg ttccccgagg cagtaaaaat ccagcacagg
7501 gggctgtgtc cctaaggcaa gccctgatta cctttaaaaa aaaccaaaaa aacaaacaaa
7561 aaaaaaaaac ctaattaact aaagcattta aggcactatt tattttagaa tcatgctttt
7621 gaagagcatc agtgattact tagggtgtaa tatgtaaaga tcagacatct ccaaaaacag
7681 aaaaagtaca agtaaacaac acactttctc atgactttta agaactgtag taatgtggct
7741 taggaaatat aatggcctaa ttgttttcaa aatgtaagtt cctgtgaaga attttgttta
7801 tattgggttg gggacctata ggtttaaaat agaatgtcag tcagctgact taaaaaacat
7861 tggttttact aagtctgcct tccccttcta aggaagaact gagtgggtaa gggacaggtg
7921 tgtaaaatct ccaaatggat gttacagctt tcagcttgaa cgtttgtttc cagacctgat
7981 taaaatttgg tttattctaa tttctgtact atatcatctg aggttttaag tggtaactgg
8041 ttctatacca tgtatgtatc atatgtttgt tcatcaaagc tttttaatcc aaataaaaac
8101 aacagtttgc aaagtga
```

SEQ ID NO: 6 Mouse PBRM1 Amino Acid Sequence (NP_001074720.1)

```
   1 mgskrrrats psssysgdfd dghhsvptpg psrkrrrlsn lptvdpiavc helyntirdy
  61 kdeqgrllce lfirapkrrn qpdyyevvsq pidlmkiqqk lkmeeyddvn lltadfqllf
 121 nnakayykpd speykaackl wdlylrtrne fvqkgeadde dddedgqdnq gtladgsspg
 181 ylkeileqll eaivvatnps grliselfqk lpskvqypdy yaiikepidl ktiaqriqng
 241 syksihamak didllaknak tynepgsqvf kdansikkif ymkkaeiehh emtksslrir
 301 tasnlaaarl tgpshnkssl geernptsky yrnkravqgg rlsaitmalq ygseseedaa
 361 laaaryeege seaesitsfm dvsnpfhqly dtvrscrnhq gqliaepffh lpskkkypdy
 421 yggikmpisl qqirtklknq eyetldhlec dlnlmfenak rynvpnsaiy krvlklqqvm
 481 qakkkelarr ddiedgdsmi ssatsdtgsa krkrnthdse mlglrrlssk knirkqrmki
 541 lfnvvleare pgsgrrlcdl fmvkpskkdy pdyykiilep mdlkiiehni rndkyageeg
 601 mmedmklmfr narhyneegs qvyndahile kllkdkrkel gplpddddma spklklsrks
 661 gvspkkskym tpmqqklnev yeavknytdk rgrrlsaifl rlpsrselpd yyltikkpmd
 721 mekirshmma nkyqdidsmv edfvmmfnna ctynepesli ykdalvlhkv lletrrdleg
 781 dedshvpnvt lliqelihnl fvsvmshqdd egrcysdsla eipavdpnsp nkppltfdii
 841 rknvesnryr rldlfgehmf evlerarrmn rtdseiyeda velqqffiri rdelckngei
 901 llspalsytt khlhndveke kkeklpkeie edklkreeek reaeksedss gttglsglhr
 961 tysqdcsfkn smyhvgdyvy vepaeanlqp hivcierlwe dsagekwlyg cwfyrpnetf
1021 hlatrkflek evfksdyynk vpvskilgkc vvmfvkeyfk lcpenfrded vfvcesrysa
1081 ktksfkkikl wtmpissvrf vprdvplpvv rvasvfanad kgddekntdn sddnraednf
1141 nlekekedvp vemsngepgc hyfeqlrynd mwlkvgdovf ikshglvrpr vgriekvwvr
1201 dgaayfygpi fihpeetehe ptkmfykkev flsnleetcp mscilgkcav lsfkdflscr
1261 pteipendil lcesrynesd kqmkkfkglk rfslsakvvd deiyyfrkpi ipqkepspll
1321 ekkiqlleak faeleggddd ieemgeedse vieapslpql qtplaneldl mpytppgstp
1381 ksakgsakke sskrkinmsg yilfssemra vikaqhpdys fgelsrlvgt ewrnletakk
1441 aeyeeraakv aeqqereraa qqqqpsaspr agtpvgalmg vvppptpmgm lnqqltpvag
1501 mmggyppglp plqgpvdglv smgsmqplhp ggppphhlpp gvpglpgipp pgvmnqgvap
1561 mvgtpapggs pygqqvgvlg ppgqqapppy pgphpagppv iqqpttpmfv apppktqrll
1621 hseaylkyie glsaesnsis kwdqtlaarr rdvhlskeqe srlpshwlks kgahttmada
1681 lwrlrdlmlr dtlnirqayn lenv
```

SEQ ID NO: 7 Human ARID2 cDNA Sequence Vairant 1 (NM_152641.3, CDS: from 129 to 5636)

```
   1 ggcccatgac tgagccccgc cgccgccggc cgaggaatgg gctccgggct ctggtaggaa
  61 gcgctgggag cgggggggcgc ttttaaaaca ccgatctggg ttttttaaaa acctcctttg
 121 aaaaaataat ggcaaactcg acggggaagg cgcctccgga cgagcggaga aagggactcg
 181 ctttcctgga cgagctgcgg cagttccacc acagcagagg gtcgcctttt aaaaaaatcc
 241 ctgcggtggg tgggaaggag ctggatcttc acggtctcta caccagagtc actactttag
 301 gcggattcgc gaaggtttct gagaagaatc agtggggaga aattgttgaa gagttcaact
 361 ttcccagaag ttgttctaac gctgcctttg ctttaaaaca gtattacttg cgttacctag
 421 aaaagtacga gaaagttcat catttggggg aggatgatga tgaggtacca ccaggcaatc
 481 caaagccaca gcttcctatt ggtgcaattc catcttccta caattaccag caacacagtg
 541 tgtcggatta tctgcgtcaa agttatgggc tgtccatgga ctttaattcg ccaaatgatt
 601 ataataaatt ggtgctttca ctgttatctg gactcccaaa tgaagtggac tttgctatta
 661 acgtatgcac tctcctatca aatgaaagca agcacgtcat gcaacttgaa aaagatccta
 721 aaatcatcac tttactactt gctaatgccg gggtgtttga cgacacttta ggatcctttt
 781 ccactgtatt tggagaagaa tggaaagaga agactgatag agacttcgtt aagttttgga
 841 aagacatcgt tgatgataat gaagttcgtg acctcatttc tgacagaaac aagtctcatg
 901 aaggtacatc aggagaatgg atttgggagt ctttatttca tccacctcga aagctgggca
 961 ttaacgatat tgaaggacag cgggtacttc agattgcagt gattttgaga aatctttcct
1021 ttgaggaggg caatgttaag ctcttggcag ctaatcgtac ctgtcttcgt ttcctattac
1081 tttctgcaca tagtcatttt atttctttaa ggcaattagg ccttgacaca ttaggaaata
1141 ttgcagctga gcttttactg gaccctgttg atttcaaaac tactcatctg atgtttcata
1201 ctgttacaaa atgtctaatg tcaagggata gatttttaaa gatgagaggc atggaaattt
1261 tgggaaatct ttgcaaagca gaagataatg gtgttttaat ttgtgaatat gtggatcagg
1321 attcctacag agagatcatt tgtcatctca ctttacctga tgtgctgctt gtaatctcaa
1381 cactcgaggt gctatacatg ctcacggaaa tgggagatgt tgcttgcaca aaaattgcaa
1441 aagtagaaaa gagcatagac atgttagtgt gtctggtttc tatggatatt cagatgtttg
1501 gccctgatgc actagctgcg gtaaaactca ttgaacaccc aagttccagt catcaaatgt
1561 tatctgaaat taggccacaa gctatagagc aagtccaaac ccagactcat gtagcatctg
```

TABLE 1-continued

| | | | | | | |
|---|---|---|---|---|---|---|
| 1621 | ccccagcttc | cagagcagtt | gtagcgcagc | atgttgctcc | acctccagga | atagtggaaa |
| 1681 | tagatagtga | gaagtttgct | tgtcagtggc | taaatgctca | ttttgaagta | aatccagatt |
| 1741 | gttctgtttc | tcgagcagaa | atgtattctg | aatacctctc | gacttgcagt | aaattagctc |
| 1801 | gtggtggaat | cctaacatca | actggatttt | ataaatgtct | tagaacggtc | tttccaaatc |
| 1861 | atacagtgaa | gagagtggag | gattccagta | gcaatgggca | ggcacatatt | catgtggtag |
| 1921 | gagtaaaacg | gagggctata | ccacttccca | ttcagatgta | ctatcagcag | caaccagttt |
| 1981 | ctacttctgt | tgttcgtgtt | gattctgttc | ctgatgtatc | tcctgctcct | tcacctgcag |
| 2041 | gaatccctca | tggatcacaa | accataggaa | accattttca | gaggactcct | gttgccaacc |
| 2101 | aatcttcaaa | tctgactgca | acacaaatgt | cttttcctgt | acaaggtgtt | catactgtgg |
| 2161 | cacaaactgt | ttcaagaatt | ccacaaaatc | cttcacctca | tacccaccag | caacaaaatg |
| 2221 | ctccagtgac | tgtcattcaa | agtaaagctc | caattccttg | tgaagttgtt | aaggctacag |
| 2281 | ttatccagaa | ttccataccc | cagacaggag | ttcctgttag | tattgctgtt | ggaggaggac |
| 2341 | ctccacagag | ttctgttgtt | cagaatcata | gtacagggcc | acaacctgtt | acagttgtga |
| 2401 | attctcagac | attgcttcac | catccatctg | taattccaca | gcagtctcca | ttacacacag |
| 2461 | tggtaccagg | acagatccct | tcaggcactc | ctgttacagt | aattcaacaa | gctgtcccac |
| 2521 | agagtcatat | gtttggcaga | gtacagaaca | taccagcatg | tacttctaca | gtttcacagg |
| 2581 | gtcaacagtt | aatcaccaca | tcaccccaac | ctgtgcaaac | ttcatctcaa | cagacatcag |
| 2641 | ctggtagcca | gtcacaagat | actgttatca | tagcaccccc | acagtatgta | acaacttctg |
| 2701 | catccaatat | tgtctcagca | acttcagtac | agaattttca | ggtagctaca | ggacaaatgg |
| 2761 | ttactattgc | tggtgtccca | agtccacaag | cctcaagggt | agggtttcag | aacattgcac |
| 2821 | caaaacctct | cccttctcag | caagtttcat | ctacagtggt | acagcagcct | attcaacaac |
| 2881 | cacagcagcc | aacccaacaa | agcgtagtga | ttgtaagcca | gccagctcaa | caaggtcaaa |
| 2941 | cttatgcacc | agccattcac | caaattgttc | ttgctaatcc | agcagctctt | ccagctggtc |
| 3001 | agacagttca | gctaactgga | caacctaaca | taactccatc | ttcttcacca | tcacctgtcc |
| 3061 | cagctactaa | taaccaagtc | cctactgcca | tgtcgtcgtc | ctctacccct | caatcacagg |
| 3121 | gaccacctcc | tactgtcagt | caaatgttat | ctgtgaaaag | gcagcaacag | cagcaacatt |
| 3181 | caccagcacc | cccaccacag | caggtacaag | tacaagttca | gcagccccaa | caagtacaga |
| 3241 | tgcaagttca | acctcaacag | tcgaatgcag | gagttggtca | gcctgcctct | ggtgagtcga |
| 3301 | gtctgattaa | acagcttctg | cttccgaaac | gtggtccttc | aacaccaggt | ggtaagctta |
| 3361 | ttctcccagc | tccacagatt | cctcccccta | ataatgcaag | agctcctagc | cctcaggtgg |
| 3421 | tctatcaggt | ggccagtaac | caagccgcag | gttttggagt | gcaggggcaa | actccagctc |
| 3481 | agcagctatt | ggttgggcag | caaaatgttc | agttggtccc | aagtgcaatg | ccaccctcag |
| 3541 | ggggagtaca | aactgtgccc | atttcgaact | tacaaatatt | gccaggtcca | ctgatctcaa |
| 3601 | atagcccagc | aaccattttc | caagggactt | ctggcaacca | ggtaaccata | acagttgtgc |
| 3661 | caaatacgag | ttttgcacct | gcaactgtga | gtcagggaaa | tgcaactcag | ctcattgctc |
| 3721 | cagcaggaat | taccatgagc | ggaacgcaga | caggagttgg | acttccagta | caaacgcttc |
| 3781 | cagccactca | agcatctcct | gctggacaat | catcatgtac | tactgctact | cccccattca |
| 3841 | aaggtgataa | aataatttgc | caaaaggagg | aggaagcaaa | ggaagcaaca | ggtttacatg |
| 3901 | ttcatgaacg | taaaattgaa | gtcatggaga | acccgtcctg | ccgacgagga | gccacaaaca |
| 3961 | ccagcaatgg | ggatacaaag | gaaaatgaaa | tgcatgtggg | aagtctttta | aatgggagaa |
| 4021 | agtacagtga | ctcaagtcta | cctccttcaa | actcagggaa | aattcaaagt | gagactaatc |
| 4081 | agtgctcact | aatcagtaat | gggccatcat | tggaattagg | tgagaatgga | gcatctggga |
| 4141 | aacagaactc | agaacaaata | gacatgcaag | atatcaaaag | tgatttgaga | aaaccgctag |
| 4201 | ttaatggaat | ctgtgatttt | gataaaggag | atggttctca | tttaagcaaa | aacattccaa |
| 4261 | atcataaaac | ttccaatcat | gtaggaaatg | gtgagatatc | tccaatggaa | ccacaaggga |
| 4321 | ctttagatat | cactcagcaa | gatactgcca | aaggtgatca | actagaaaga | atttctaatg |
| 4381 | gacctgtatt | aactttgggt | ggttcatctg | tgagcagtat | acaggaggct | tcaaatgcgg |
| 4441 | caacacagca | atttagtggt | actgatttgc | ttaatggacc | tctagcttca | agtttgaatt |
| 4501 | cagatgtgcc | tcagcaacgc | ccaagtgtag | ttgtctcacc | acattctaca | acctctgtta |
| 4561 | tacagggaca | tcaaatcata | gcagttcccg | actcaggatc | aaaagtatcc | cattctcctg |
| 4621 | ccctatcatc | tgacgttcgg | tctacaaatg | gcacagcaga | atgcaaaact | gtaaagaggc |
| 4681 | cagcagagga | tactgatagg | gaaacagtcg | caggaattcc | aaataaagta | ggagttagaa |
| 4741 | ttgttacaat | cagtgacccc | aacaatgctg | gctgcagcgc | aacaatggtt | gctgtgccag |
| 4801 | caggagcaga | tccaagcact | gtagctaaag | tagcaataga | aagtgctgtt | cagcaaaagc |
| 4861 | aacagcatcc | accaacatat | gtacagaatg | tggtcccgca | gaacactcct | atgccacctt |
| 4921 | caccagctgt | acaagtgcag | ggccagccta | acagttctca | gccttctcca | ttcagtggat |
| 4981 | ccagtcagcc | tggagatcca | atgagaaaac | ctggacagaa | cttcatgtgt | ctgtggcagt |
| 5041 | cttgtaaaaa | gtggtttcag | acaccctcac | aggttttcta | ccatgcagca | actgaacatg |
| 5101 | gaggaaaaga | tgtatatcca | gggcagtgtc | tttgggaagg | ttgtgagcct | tttcagcgac |
| 5161 | agcggttttc | ttttattacc | cacttgcagg | ataagcactg | ttcaaaggat | gccctacttg |
| 5221 | caggattaaa | acaagatgaa | ccaggacaag | caggaagtca | gaagtcttct | accaagcagc |
| 5281 | caactgtagg | gggcacaagc | tcaactccta | gagcacaaaa | ggccattgtg | aatcatccca |
| 5341 | gtgctgcact | tatggctctg | aggagaggat | caagaaacct | tgtctttcga | gattttacag |
| 5401 | atgaaaaaga | gggaccaata | actaaacaca | tccgactaac | agctgcctta | atattaaaaa |
| 5461 | atattggtaa | atattcagaa | tgtggtcgca | gattgttaaa | gagacatgaa | aataacttat |
| 5521 | cagtgctagc | cattagtaac | atggaagctt | cctccaccct | tgccaaatgc | ctttatgaac |
| 5581 | ttaattttac | agttcagagt | aaggaacaag | aaaaagactc | agaaatgctg | cagtgaaaaa |
| 5641 | taattccact | tacacagtgg | gggactcaaa | gtcagccaca | tttcacatac | tgttactgaa |
| 5701 | gaaagcacca | agtcttaatg | gaacaaagac | catagaatga | attattttat | ctcctcccat |
| 5761 | gatgctgaga | ggaagcttcg | tattctgatc | tctgagtgaa | tccctttgtt | ctctgtttaa |
| 5821 | aaaaatctaa | aaagaaaaag | gaaaaaaaaa | aaagaactgc | tgtgggattg | tcaaccagct |
| 5881 | tatctgcagg | atgtttcaga | tctgataaat | cctgatggaa | actggtatga | tcagaattca |
| 5941 | gtaccatcca | cattggaata | tacatggaat | attgtaaaac | ctacatgagc | agatgaaata |
| 6001 | gaagcattaa | atatttttat | ctatatccaa | aaaggagcac | atttttatat | ttacaaaacc |
| 6061 | gtttaagctg | gtttgaataa | tttaaaaaag | tttcagcaca | cctatacccc | cgatctcaga |
| 6121 | gggggccacc | aatatctagc | tatggatcgt | gtgttttgtt | tagaaatcag | tagcttggtt |
| 6181 | ttcttacttg | agccaatata | ttttcactta | tttattatca | taaaaattta | ccagtctgaa |
| 6241 | tagatcttgt | aaatatttgt | gaatagaatg | aatacctttc | atgccactgc | agccactgga |
| 6301 | aatacattct | gtggtgtcct | agaagcatta | ttggtaggtt | ctaaagtttt | ctagactttc |
| 6361 | ctgtcaattg | taagtaattg | tgatatattc | tatgcagtgg | atgaatgttc | tttaaatttg |

TABLE 1-continued

```
6421 tgtaaatact tctgcaaagg tactgatgct gtaaagtcaa aacagttttg tggaactgtg
6481 attttttttt ctttttctt ttttttttc ttttttttt tgtattatac accttgtaga
6541 actcattttg ctggctgaaa gagtatggaa taatatatct catgtcattt tttagaagaa
6601 aaactatttg aaggtatttt ttggttttcc ttaacatgta tccactgtaa acgtttgtcg
6661 tgtacaagct cagagcttgg acagaatttt ttgtatttgt aaattggttt aaatacatgg
6721 aattttatac aggttttctc ctgtgttata tatgcattat gtgcaggtat gatattttct
6781 tcactacttt ttctatctta atatagtgtg gaattttatt gtattattct tccattctta
6841 atactgtacc acattcctgc tcagaaactg ctcacttcct taaattgtct tttttcccc
6901 agcgtgaaat gtatccattt ataactgcct attgcctgtt ctattagcat ccaaaaatgt
6961 ggaaggcctc ccaaccacca tttctgctgt gtccttagga tgtgcagtaa aaaatataga
7021 cctaacagtt tatgttatag aatggcttta tttactttgg tgactgttta tagtttttaa
7081 ataaaagact gaacattttc ttgagtcctt catttctgag tatgcttaag acatcttaaa
7141 aatatagaga gaattctaaa ttcagctgaa ggcaaggtat aacggtcacc tacctatttg
7201 attatatgtt gattgataac atattaaata gagaacaaat aagagaggtc ctttacatga
7261 caaatttgca tgaaataagc agattaacca agtatttatt tttcatcttg ttataatgca
7321 gagcaaatgt agagaacagc aaatgattga tgcagttaaa gctcaatatg cctttttta
7381 ctggatactg tacatttggc taaaagcttt tattgtttga tgttgtgttt cttgactgtt
7441 tattcagaat cacagtgtat ccaaatcttc agcttgaatt tggaggcaga ttcttagagt
7501 gaaaaagcct cagtttccat attaaaaatg ttttaaatat tttgattgaa ttagtaccaa
7561 tgtaaaatct agtttcttcc tgaaggagga tccctggcgc tgtcctgcca tgtctcaaag
7621 gaatgtttga gaaacttcat ctaatattag ttataaggtt gtggaattta tgcttggccc
7681 accttccaag actggcactg cccaacagac accgctgaaa tcatgtgggt atccctagga
7741 tggccttcag agccctcaaa cttacaagca cctggtagtt gacatcatat ggggaatttt
7801 ctattcaccg tacttatcca aaaatctctt ttaaaaagta aatttgtgca acaacgttta
7861 tttgaaagat aatgtcttct caaaatcaga aactgcagtg gtaattaaat taatagaaaa
7921 gagaacaaac tgcaggttta gaaaaatggt tttcatattc accattcttc cacctcattg
7981 aattgcatgc tgtagttcta gcttttctgc tataatatgt aaatatgact gtagcctttt
8041 aagcttcagt ctcagcagag aatttcctaa atgcgtttga cctaatgaaa ctgatcatgg
8101 cttcccactt aggtttttct tcttatagct ttatagaact atataataat atggacttgc
8161 tgtgtaatgg aattaaagtg cttttgcaca ataagttctg caaaaccctc tcattcatga
8221 aaaggtgctc cttgctagac agaaacttgc tgatttacag tattgttatt tttgtctaaa
8281 gttctgtaaa tacatgcttt aatgttatct ttgagaaatc tatgtaaata atatagtcta
8341 caacatagag actgtataat tctgtgttat atatgtgcct agtgctctgt tggcactcaa
8401 taaattttaa gtaacaaaat tgataatcat atagcgaagg catatttttc ttccaagctc
8461 aagtcaggat tgtgactata tattaatgag actcagtaat ccaacccaca cctgagaact
8521 cgtctcatta ctttatagtc atgtcatgta tgttttttta accatgaaat gacaataaaa
8581 tgatttttaa aatgagaaaa aaaaaaaaaa aaaaaaaaa
```

SEQ ID NO: 8 Human ARID2 Amino Acid Sequence Isoform A (NP_689854.2)

```
   1 manstgkapp derrkglafl delrqfhhsr gspfkkipav ggkeldlhgl ytrvttlggf
  61 akvseknqwg eiveefnfpr scsnaafalk qyylryleky ekvhhfgedd devppgnpkp
 121 qlpigaipss ynyqqhsysd ylrqsyglsm dfnspndynk lvlsllsglp nevdfainvc
 181 tllsneskhv mqlekdpkii tlllanagvf ddtlgsfstv fgeewkektd rdfvkfwkdi
 241 vddnevrdli sdrnkshegt sgewiweslf hpprklgind ieggrvlgia vilrnlsfee
 301 gnvkllaanr tclrflllsa hshfislrql gldtlgniaa elladpvdfk tthlmfhtvt
 361 kclmsrdrfl kmrgmeilgn lckaedngvl iceyvdqdsy reiichltlp dvllvistle
 421 vlymltemgd vactkiakve ksidmlvclv smdiqmfgpd alaavklieh pssshqmlse
 481 irpgaieqvg tqthvasapa sravvaqhva pppgiveids ekfacqwlna hfevnpdcsv
 541 sraemyseyl stcsklargg iltstgfykc lrtvfpnhtv krvedsssng qahihvvgvk
 601 rraiplpiqm yyqqqpvsts vvrvdsvpdv spapspagip hgsgtignhf grtpvangss
 661 nitatqmsfp vqgvhtvaqt vsripqnpsp hthqqqnapv tviqskapip cevvkatviq
 721 nsipqtgvpv siavgggppq ssvvqnhstg pqpvtvvnsq tllhhpsvip qqsplhtvvp
 781 gqipsgtpvt viqqavpqsh mfgrvqnipa ctstvsqgqq littspqpvq tssqqtsags
 841 qsqdtviiap pqyvttsasn ivsatsvgnf qvatgqmvti agvpspqasr vgfqniapkp
 901 lpsqqvsstv vqqpiqqpqq ptqqsvvivs qpaqqgqtya paihqivlan paalpagqtv
 961 qltgqpnitp ssspspvpat nnqvptamss sstpqsqgpp ptvsqmlsvk rqqqqqhspa
1021 pppqqvqvqv qqpqqvqmqv qpqqsnagvg qpasgessli kglllpkrgp stpggklilp
1081 apqipppnna rapspqvvyq vasnqaagfg vqgqtpaqql lvgqqnvqlv psamppsggv
1141 qtvpisnlqi lpgplisnsp atifqgtsgn qvtitvvpnt sfapatvsqg natqliapag
1201 itmsgtqtgv glpvqtlpat gaspaggssc ttatppfkgd kiicqkeeea keatglhvhe
1261 rkievmenps crrgatntsn gdtkenemhv gsllngrkys dsslppsnsg kigsetnqcs
1321 lisngpslel gengasgkqn segidmgdik sdlrkplvng icdfdkgdgs hlsknipnhk
1381 tsnhvgngei spmepqgtld itqqdtakgd qlerisngpv ltlggssyss iqeasnaatq
1441 qfsgtdllng plasslnsdv pqqrpsvvvs phsttsviqg hqiiavpdsg skvshspals
1501 sdvrstngta ecktvkrpae dtdretvagi pnkvgvrivt isdpnnagcs atmvavpaga
1561 dpstvakvai esavqqkqqh pptyvqnvvp qntpmppspa vqvqgqpnss qpspfsgssq
1621 pgdpmrkpgq nfmclwqsck kwfqtpsqvf yhaatehggk dvypgqclwe gcepfqrqrf
1681 sfithlqdkh cskdallagl kgdepggags qkssstkqptv ggtsstpraq kaivnhpsaa
1741 lmalrrgsrn lvfrdftdek egpitkhirl taalilknig kysecgrrll krhennlsvl
1801 aisnmeasst lakclyelnf tvgskeqekd semlq
```

SEQ ID NO: 9 Human ARID2 cDNA Sequence Vairant 2 (NM_001347839.1, CDS: from 129 to 5495)

```
   1 ggcccatgac tgagccccgc cgccgccggc cgaggaatgg gctccgggct ctggtaggaa
  61 gcgctgggag cgggggggcgc ttttaaaaca ccgatctggg ttttttaaaa acctcctttg
 121 aaaaaataat ggcaaactcg acggggaagg cgcctccgga cgagcggaga aagggactcg
 181 ctttcctgga cgagctgcgg cagttccacc acagcagagg gtcgcctttt aaaaaaatcc
 241 ctgcggtggg tgggaaggag ctggatcttc acggtctcta caccagagtc actactttag
 301 gcggattcgc gaaggtttct gagaagaatc agtggggaga aattgttgaa gagttcaact
 361 ttcccagaag ttgttctaac gctgcctttg ctttaaaaca gtattacttg cgttacctag
```

TABLE 1-continued

| | | | | | | |
|---|---|---|---|---|---|---|
| 421 | aaaagtacga | gaaagttcat | cattttgggg | aggatgatga | tgaggtacca | ccaggcaatc |
| 481 | caaagccaca | gcttcctatt | ggtgcaattc | catcttccta | caattaccag | caacacagtg |
| 541 | tgtcggatta | tctgcgtcaa | agttatgggc | tgtccatgga | ctttaattcg | ccaaatgatt |
| 601 | ataataaatt | ggtgctttca | ctgttatctg | gactcccaaa | tgaagtggac | tttgctatta |
| 661 | acgtatgcac | tctcctatca | aatgaaagca | agcacgtcat | gcaacttgaa | aaagatccta |
| 721 | aaatcatcac | tttactactt | gctaatgccg | gggtgtttga | cgacacttta | ggatcctttt |
| 781 | ccactgtatt | tggagaagaa | tggaaagaga | agactgatag | agacttcgtt | aagttttgga |
| 841 | aagacatcgt | tgatgataat | gaagttcgtg | acctcatttc | tgacagaaac | aagtctcatg |
| 901 | aaggtacatc | aggagaatgg | atttgggagt | ctttatttca | tccacctcga | aagctgggca |
| 961 | ttaacgatat | tgaaggacag | cgggtacttc | agattgcagt | gattttgaga | aatctttcct |
| 1021 | ttgaggaggg | caatgttaag | ctcttggcag | ctaatcgtac | ctgtcttcgt | ttcctattac |
| 1081 | tttctgcaca | tagtcatttt | atttctttaa | ggcaattagg | ccttgacaca | ttaggaaata |
| 1141 | ttgcagctga | gcttttactg | gaccctgttg | atttcaaaac | tactcatctg | atgtttcata |
| 1201 | ctgttacaaa | atgtctaatg | tcaagggata | gatttttaaa | gatgagaggc | atggaaattt |
| 1261 | tgggaaatct | ttgcaaagca | gaagataatg | gtgttttaat | ttgtgaatat | gtggatcagg |
| 1321 | attcctacag | agagatcatt | tgtcatctca | ctttacctga | tgtgctgctt | gtaatctcaa |
| 1381 | cactcgaggt | gctatacatg | ctcacggaaa | tgggagatgt | tgcttgcaca | aaaattgcaa |
| 1441 | aagtagaaaa | gagcatagac | atgttagtgt | gtctggtttc | tatggatatt | cagatgtttg |
| 1501 | gccctgatgc | actagctgcg | gtaaaactca | ttgaacaccc | aagttccagt | catcaaatgt |
| 1561 | tatctgaaat | taggccacaa | gctatagagc | aagtccaaac | ccagactcat | gtagcatctg |
| 1621 | ccccagcttc | cagagcagtt | gtagcgcagc | atgttgctcc | acctccagga | atagtggaaa |
| 1681 | tagatagtga | gaagtttgct | tgtcagtggc | taaatgctca | ttttgaagta | aatccagatt |
| 1741 | gttctgtttc | tcgagcagaa | atgtattctg | aatacctctc | gacttgcagt | aaattagctc |
| 1801 | gtggtggaat | cctaacatca | actggatttt | ataaatgtct | tagaacggtc | tttccaaatc |
| 1861 | atacagtgaa | gagagtggag | gattccagta | gcaatgggca | ggcacatatt | catgtggtag |
| 1921 | gagtaaaacg | gagggctata | ccacttccca | ttcagatgta | ctatcagcag | caaccagttt |
| 1981 | ctacttctgt | tgttcgtgtt | gattctgttc | ctgatgtatc | tcctgctcct | tcacctgcag |
| 2041 | gaatccctca | tggatcacaa | accataggaa | accattttca | gaggactcct | gttgccaacc |
| 2101 | aatcttcaaa | tctgactgca | acacaaatgt | cttttcctgt | acaaggtgtt | catactgtgg |
| 2161 | cacaaactgt | ttcaagaatt | ccacaaaatc | cttcacctca | tacccaccag | caacaaaatg |
| 2221 | ctccagtgac | tgtcattcaa | agtaaagctc | caattccttg | tgaagttgtt | aaggctacag |
| 2281 | ttatccagaa | ttccataccc | cagacaggag | ttcctgttag | tattgctgtt | ggaggaggac |
| 2341 | ctccacagag | ttctgttgtt | cagaatcata | gtacagggcc | acaacctgtt | acagttgtga |
| 2401 | attctcagac | attgcttcac | catccatctg | taattccaca | gcagtctcca | ttacacacag |
| 2461 | tggtaccagg | acagatccct | tcaggcactc | ctgttacagt | aattcaacaa | gctgtcccac |
| 2521 | agagtcatat | gtttggcaga | gtacagaaca | taccagcatg | tacttctaca | gtttcacagg |
| 2581 | gtcaacagtt | aatcaccaca | tcaccccaac | ctgtgcaaac | ttcatctcaa | cagacatcag |
| 2641 | ctggtagcca | gtcacaagat | actgttatca | tagcaccccc | acagtatgta | acaacttctg |
| 2701 | catccaatat | tgtctcagca | acttcagtac | agaattttca | ggtagctaca | ggacaaatgg |
| 2761 | ttactattgc | tggtgtccca | agtccacaag | cctcaagggt | agggtttcag | aacattgcac |
| 2821 | caaaacctct | cccttctcag | caagtttcat | ctacagtggt | acagcagcct | attcaacaac |
| 2881 | cacagcagcc | aacccaacaa | agcgtagtga | ttgtaagcca | gccagctcaa | caaggtcaaa |
| 2941 | cttatgcacc | agccattcac | caaattgttc | ttgctaatcc | agcagctctt | ccagctggtc |
| 3001 | agacagttca | gctaactgga | caacctaaca | taactccatc | ttcttcacca | tcacctgtcc |
| 3061 | cagctactaa | taaccaagtc | cctactgcca | tgtcgtcgtc | ctctacccct | caatcacagg |
| 3121 | gaccacctcc | tactgtcagt | caaatgttat | ctgtgaaaag | gcagcaacag | cagcaacatt |
| 3181 | caccagcacc | cccaccacag | caggtacaag | tacaagttca | gcagccccaa | caagtacaga |
| 3241 | tgcaagttca | acctcaacag | tcgaatgcag | gagttggtca | gcctgcctct | ggtgagtcga |
| 3301 | gtctgattaa | acagcttctg | cttccgaaac | gtggtccttc | aacaccaggt | ggtaagctta |
| 3361 | ttctcccagc | tccacagatt | cctcccccta | ataatgcaag | agctcctagc | cctcaggtgg |
| 3421 | tctatcaggt | ggccagtaac | caagccgcag | gttttggagt | gcaggggcaa | actccagctc |
| 3481 | agcagctatt | ggttgggcag | caaaatgttc | agttggtccc | aagtgcaatg | ccaccctcag |
| 3541 | gggagtaca | aactgtgccc | atttcgaact | tacaaatatt | gccaggtcca | ctgatctcaa |
| 3601 | atagcccagc | aaccatttc | caagggactt | ctggcaacca | ggtaaccata | acagttgtgc |
| 3661 | caaatacgag | ttttgcacct | gcaactgtga | gtcagggaaa | tgcaactcag | ctcattgctc |
| 3721 | cagcaggaat | taccatgagc | ggaacgcaga | caggagttgg | acttccagta | caaacgcttc |
| 3781 | cagccactca | agcatctcct | gctggacaat | catcatgtac | tactgctact | cccccattca |
| 3841 | aaggtgataa | aataatttgc | caaaaggagg | aggaagcaaa | ggaagcaaca | ggtttacatg |
| 3901 | ttcatgaacg | taaaattgaa | gtcatggaga | acccgtcctg | ccgacgagga | gccacaaaca |
| 3961 | ccagcaatgg | ggatacaaag | gaaaatgaaa | tgcatgtggg | aagtctttta | aatgggagaa |
| 4021 | agtacagtga | ctcaagtcta | cctccttcaa | actcagggaa | aattcaaagt | gagactaatc |
| 4081 | agtgctcact | aatcagtaat | gggccatcat | tggaattagg | tgagaatgga | gcatctggga |
| 4141 | aacagaactc | agaacaaata | gacatgcaag | atatcaaaag | tgatttgaga | aaaccgctag |
| 4201 | ttaatggaat | ctgtgatttt | gataaaggag | atggttctca | tttaagcaaa | aacattccaa |
| 4261 | atcataaaac | ttccaatcat | gtaggaaatg | gtgagatatc | tccaatggaa | ccacaaggga |
| 4321 | ctttagatat | cactcagcaa | gatactgcca | aaggtgatca | actagaaaga | atttctaatg |
| 4381 | gacctgtatt | aactttgggt | ggttcatctg | tgagcagtat | acaggaggct | tcaaatgcgg |
| 4441 | caacacagca | atttagtggt | actgatttgc | ttaatggacc | tctagcttca | agtttgaatt |
| 4501 | cagatgtgcc | tcagcaacgc | ccaagtgtag | ttgtctcacc | acattctaca | acctctgtta |
| 4561 | tacagggaca | tcaaatcata | gcagttcccg | actcaggatc | aaaagtatcc | cattctcctg |
| 4621 | ccctatcatc | tgacgttcgg | tctacaaatg | gcacagcaga | atgcaaaact | gtaaagaggc |
| 4681 | cagcagagga | tactgatagg | gaaacagtcg | caggaattcc | aaataaagta | ggagttagaa |
| 4741 | ttgttacaat | cagtgacccc | aacaatgctg | gctgcagcgc | aacaatggtt | gctgtgccag |
| 4801 | caggagcaga | tccaagcact | gtagctaaag | tagcaataga | aagtgctgtt | cagcaaaagc |
| 4861 | aacagcatcc | accaacatat | gtacagaatg | tggtcccgca | gaacactcct | atgccacctt |
| 4921 | caccagctgt | acaagtgcag | ggccagccta | acagttctca | gccttctcca | ttcagtggat |
| 4981 | ccagtcagcc | tggagatcca | atgagaaaac | ctggacagaa | cttcatgtgt | ctgtggcagt |
| 5041 | cttgtaaaaa | gtggtttcag | acaccctcac | aggttttcta | ccatgcagca | actgaacatg |
| 5101 | gaggaaaaga | tgtatatcca | gggcagtgtc | tttgggaagg | ttgtgagcct | tttcagcgac |
| 5161 | agcggttttc | ttttattacc | cacttgcagg | ataagcactg | ttcaaaggat | gccctacttg |

TABLE 1-continued

```
5221 caggattaaa acaagatgaa ccaggacaag caggaagtca gaagtcttct accaagcagc
5281 caactgtagg gggcacaagc tcaactccta gagcacaaaa ggccattgtg aatcatccca
5341 gtgctgcact tatggctctg aggagaggat caagaaacct tgtctttcga gattttacag
5401 atgaaaaaga gggaccaata actaaacaca tccgactaac agctgcctta atattaaaaa
5461 atattggtaa atattcagaa tgtggtcgca ggtgagtaat atgttttctg tagccaaagt
5521 gaatttagtt tattttattt ttacatataa gttaataaaa ttagataact gtattttctt
5581 cattgttttt ctcatcaatt ttgcaaatac atccaaaagt ttatgcctag gtcaggccat
5641 gatgagctct taaaagtcaa aaataaatag aagttaaaac aaccaaaaaa aaaaaaaaaa
5701 aaa
```

SEQ ID NO: 10 Human ARID2 Amino Acid Sequence Isoform B (NP_001334768.1)

```
   1 manstgkapp derrkglafl delrqfhhsr gspfkkipav ggkeldlhgl ytrvttlggf
  61 akvseknqwg eiveefnfpr scsnaafalk qyylryleky ekvhhfgedd devppgnpkp
 121 qlpigaipss ynyqqhsysd ylrqsyglsm dfnspndynk lvlsllsglp nevdfainvc
 181 tllsneskhv mqlekdpkii tlllanagvf ddtlgsfstv fgeewkektd rdfvkfwkdi
 241 vddnevrdli sdrnkshegt sgewiweslf hpprklgind iegqrvlgia vilrnlsfee
 301 gnvkllaanr tclrflllsa hshfislrql gldtlgniaa ellldpvdfk tthlmfhtvt
 361 kclmsrdrfl kmrgmeilgn lckaedngvl iceyvdqdsy reiichltlp dvllvistle
 421 vlymltemgd vactkiakve ksidmlvclv smdiqmfgpd alaavklieh pssshqmlse
 481 irpgaieqvg tqthvasapa sravvaqhva pppgiveids ekfacqwlna hfevnpdcsv
 541 sraemyseyl stcsklargg iltstgfykc lrtvfpnhtv krvedsssng qahihvvgvk
 601 rraiplpiqm yyqqqpvsts vvrvdsvpdv spapspagip hgsgtignhf qrtpvanqss
 661 nitatqmsfp vqgvhtvaqt vsripqnpsp hthqqqnapv tvigskapip cevvkatviq
 721 nsipqtgvpv siavgggppq ssvvqnhstg pqpvtvvnsq tllhhpsvip qqsplhtvvp
 781 gqipsgtpvt viqqavpqsh mfgrvqnipa ctstvsqgqq littspqpvg tssqqtsags
 841 qsqdtviiap pqyvttsasn ivsatsvgnf qvatgqmvti agvpspqasr vgfqniapkp
 901 lpsqqvsstv vqqpiqqpqq ptqqsvvivs qpaqqgqtya paihqivlan paalpagqtv
 961 qltgqpnitp ssspspvpat nnqvptamss sstpqsqgpp ptvsqmlsvk rqqqqhspa
1021 pppqqvqvqv qqpqqvqmqv qpqqsnagvg qpasgessli kglllpkrgp stpggklilp
1081 apqipppnna rapspqvvyq vasnqaagfg vqgqtpaqql lvgqqnvqlv psamppsggv
1141 qtvpisnlqi lpgplisnsp atifqgtsgn qvtitvvpnt sfapatvsqg natqliapag
1201 itmsgtqtgv glpvqtlpat gaspaggssc ttatppfkgd kiicqkeeea keatglhvhe
1261 rkievmenps crrgatntsn gdtkenemhv gsllngrkys dsslppsnsg kigsetnqcs
1321 lisngpslel gengasgkqn segidmgdik sdlrkplvng icdfdkgdgs hlsknipnhk
1381 tsnhvgngei spmepqgtld itqqdtakgd qlerisngpv ltlggssyss igeasnaatq
1441 qfsgtdllng plasslnsdv pqqrpsvvvs phsttsviqg hqiiavpdsg skvshspals
1501 sdvrstngta ecktvkrpae dtdretvagi pnkvgvrivt isdpnnagcs atmvavpaga
1561 dpstvakvai esavqqkqqh pptyvqnvvp qntpmppspa vqvqgqpnss qpspfsgssq
1621 pgdpmrkpgq nfmclwqsck kwfqtpsqvf yhaatehggk dvypgqclwe gcepfgrqrf
1681 sfithlqdkh cskdallagl kgdepggags qksstkqptv ggtsstpraq kaivnhpsaa
1741 lmalrrgsrn lvfrdftdek egpitkhirl taalilknig kysecgrr
```

SEQ ID NO: 11 Mouse ARID2 cDNA Sequence (NM_175251.4, CDS: from 129 to 5495)

```
   1 gcgccgccgc cgccgccgcc gccgccgccg ccgccgccac cgccggccca tgactgagcc
  61 ccgccaccgc cggccgagga atgggctccg ggcgctggta gggagcgcgg ggagcggggg
 121 ccgcgtttga accgcgatct gggtttttc gggagacctc ctttggcaaa ataatggcaa
 181 actcgacggg gaaggcgcct ccggacgagc ggaggaaggg actggctttc ctggacgagc
 241 tgcggcagtt ccaccacagc agagggtcgc cgtttaagaa gatccctgcg gtgggtggga
 301 aggagctgga tcttcacggg ctctacacca gagtcactac tttaggcgga ttcgcgaagg
 361 tttctgagaa gaatcagtgg ggagaaattg ttgaagagtt caactttccc agaagttgtt
 421 ccaacgctgc ctttgcttta aaacagtatt acttgcgtta tctagaaaag tacgagaaag
 481 ttcatcattt tggggaagat gatgatgagg taccaccagg caatccaaag ccacagcttc
 541 ctattggtgc aatcccatct tcctacaatt accagcaaca cagcgtgtca gattatctac
 601 gtcaaagtta tgggttatct atggatttta attcgccaaa tgattataat aaactggtgc
 661 tttcactgtt atctggactc ccaaatgaag tggacttcgc tattaatgtg tgcactctcc
 721 tatcaaatga aagcaagcac gtcatgcagc ttgagaagga tcccaaaatc atcactttac
 781 tgctcgctaa tgcgggggtg ttcgatgaca ctttaggatc attctcttct gtctttggag
 841 aagagtggcg agagaagact gatagagact ttgttaagtt ttggaaagac attgttgatg
 901 acaatgaagt gcgagatctc atttctgaca gaaacaaggc tcatgaagat acaccaggag
 961 aatggatttg ggaatcttta tttcatccac ctcgaaagct gggcattaat gacatcgaag
1021 gccagcgggt tctgcagatc gcagtgatct tgcggaacct ctcctttgag gagagcaatg
1081 ttaagctctt ggcagctaat cgcacctgtc tgcgtttcct gttgctctct gcacacagtc
1141 attttatttc attaaggcag ctaggcctgg acaccttagg gaatatcgca gctgagcttt
1201 tactggaccc tgtggatttc agaaccactc atctgatgtt tcacactgtt acaaaatgcc
1261 tgatgtcaag ggataggttt ttaaagatga ggggcatgga aattttggga aatctctgca
1321 aagcagagga taacggtgtt ttgatttgtg aatatgtgga tcaagattcc tatagagaga
1381 taatttgtca cctcactctg cccgatgtgc tgctggtgac ctcaaccctg gaggtgctgt
1441 acatgctcac tgaaatgggg gacgtggcct gcacaaagat cgcgaaagtg gagaagagca
1501 tagacgtgct ggtgtgtctg gtctctatgg acgctcagat gtttggacct gacgcacttg
1561 ctgccgtgaa gctcattgag catccgagct ccagtcacca agtgttatca gagattaggc
1621 cgcaagccat agagcaggtc caaacccaga cccacatagc ctccggtcca gcttccagag
1681 cagttgtagc acagcatgct gcccccctc caggaatcgt ggaaatagac agtgagaagt
1741 tcgcttgtca gtggctaaat gctcattttg aagtaaatcc agactgttcc gtctctcggg
1801 cagaaatgta ttcagagtac ctctcaactt gcagtaaatt agctcgcggt ggcatcctca
1861 catcaactgg gttttataag tgtcttagaa cagtttttcc aaatcataca gtgaagaggg
1921 tagaagattc cactagcagt gggcaggcgc atatccatgt cataggagtg aagcggcggg
1981 ctctcccgct ccccatccag atgtactatc agcagcagcc aatttccact cctgttgtcc
2041 gtgttgatgc tgttgctgat ctatctccaa ctccttcacc tgcaggaatc cctcatggac
2101 cacaggctgc agggaatcat tttcagagga ctcctgtcac caatcaatct tcaaatttga
2161 ctgcaacaca aatgtctttt ccggtacaag gcattcatac tgtggcacag actgtttcca
```

TABLE 1-continued 2221 gaattccacc aaatccttca gttcataccc accagcaaca aaattctcca gtaactgtca
2281 ttcagaataa agctccaatt ccttgtgaag tcgttaaggc aacagtaatc cagaactctg
2341 tgccccagac ggcagttcct gtgagtatct ctgttggagg agcacctgca cagaattctg
2401 tgggtcagaa ccatagtgca gggccacagc ctgttacagt tgtaaattct cagacattac
2461 ttcaccatcc ttctgtgatg ccacagccat ctccactaca cacagtggtg cccggacagg
2521 tcccttcagg cactcctgtc acagtaatcc agcagactgt accgcagagt cgtatgtttg
2581 gacgagtaca gagcatacca gcgtgtacat ctaccgtctc acagggtcag cagttaatca
2641 ccacatcacc acagcctatg cacacttcat ctcaacagac agcagctggt agccagccac
2701 aagacactgt tatcatagca ccccccacagt acgtaacaac ttctgcatcc aatatcgtct
2761 cagcgacttc agtacagaat ttccaggtag ctacaggaca ggtggttacc atagctggtg
2821 tcccgagccc acagccctcc agggtaggat tccagaacat tgcgcccaag ccacttcctt
2881 ctcagcaagt ttcaccatca gtggtccagc agcctattca acaaccacag cagcctgctc
2941 agcagagtgt agtgattgtg agccagccag cacagcaagg ccaggcgtac gcaccagcca
3001 ttcaccagat cgttctcgct aacccggcag ctctccctgc cggtcagacg gttcagctaa
3061 ctggacaacc aaacataact ccatcgtcat caccatcacc tgtcccgcct actaataacc
3121 aagtccctac tgccatgtca tcttcttcca cccttcagtc acagggaccc cctcctactg
3181 tcagtcagat gctctctgtg aagaggcagc agcagcagca gcactcacca gcagcgccag
3241 cacagcaggt ccaggtccag gttcagcagc cgcagcaggt ccaggtgcaa gttcagccgc
3301 agcaaccgag tgctggggtc ggtcagcctg ctcccaacga gtctagtctc atcaagcagc
3361 tgctgctgcc aaagcggggc ccttcaaccc cagggggcaa gcttatcctc ccagcccctc
3421 agattcctcc ccctaacaat gcaagagctc ctagccctca ggtggtctat caggtggcca
3481 ataaccaagc agctggtttt ggagtgcagg ggcaaactcc ggctcagcag ctattggttg
3541 ggcagcaaaa tgttcagttg gtcccaaagtg caatgccacc cgcaggggga gtgcaaaccg
3601 tgcccatttc gaacttacaa atattgccgg gtccgctgat ctcaaacagc ccagcaacca
3661 ttttccaagg gacttctggc aaccaggtaa ctataacagt tgtgccaaat accagttttg
3721 caactgcgac tgtgagtcag ggaaacgctg ctcagctcat tgcgccagcc ggtcttagca
3781 tgagcggagc gcaggcaagc gctggacttc aggtgcagac gcttccagcc ggacaatcag
3841 cgtgtaccac tgctcccctc ccgttcaaag gcgacaagat catttgccaa aaggaggagg
3901 aggcaaagga agcaacaggt ctacatgttc atgaacggaa gattgaggtc atggagaatc
3961 cttcctgtcg gcgaggaacc acaaacacca gcaacgggga tacaagtgag agtgaactcc
4021 aggtgggaag tctttttaaat gggagaaagt atagtgactc aagtctacct ccttcaaact
4081 cagggaaact tcagagtgag acgagccagt gctcactaat cagcaatggg ccatcgttgg
4141 aactaggtga gaatggagcg cctggaaaac agaactcaga accagtagac atgcaggatg
4201 tcaaaggtga tctgaaaaaa gccctcgtca atggaatctg tgattttgat aaaggagatg
4261 gttctcattt aagcaaaaac attccaaatc acaaaacttc taatcatgta ggaaatggtg
4321 agatatctcc agtagaacca caagggactt cgggtgccac tcagcaagat actgccaaag
4381 gtgaccaact agaaagagtt tctaatggac ctgtgttaac tctgggtggg tcaccgtcca
4441 caagcagtat gcaagaagcc ccgagtgtgg cgacaccgcc gttgagtggt actgacctgc
4501 ctaacggacc tctagcttca agtttgaatt cagatgtgcc tcagcaacgc ccaagtgtag
4561 ttgtctcacc acattctaca gcccctgtca tacaggggca tcaagtcata gcagttcccc
4621 actcaggacc tagagtgacc ccttctgctc tatcatctga tgctcggtct acaaacggca
4681 cagccgagtg caaaactgta aagaggccgg cagaggataa tgatagggac actgtcccgg
4741 gaatcccaaa taaagtaggg gttagaattg ttacaatcag cgaccccaac aatgctggct
4801 gcagtgcaac catggttgcg gtcccagctg gagcggaccc aagcactgta gcgaaagtag
4861 caatagaaag tgctgctcag caaaagcagc agcatccacc gacctacatg cagagtgtgg
4921 ccccacagaa cactcctatg ccaccttcac cagctgtaca agtgcagggc cagcctagca
4981 gttctcagcc ttctccagtc agtgcgtcca gtcagcatgc agatccagtg agaaaacctg
5041 ggcagaactt catgtgtctg tggcagtctt gtaaaaagtg gtttcagact ccctcacaag
5101 tgttctatca tgcagctact gaacatggag gaaaagatgt gtatccgggg cagtgtcttt
5161 gggaaggctg tgagcctttc caacggcaga ggttctcttt cattacccac ttacaggata
5221 agcactgttc aaaggatgcc ctgcttgcag gattaaagca agatgaacca ggacaagtgg
5281 caaatcaaaa atcttctacc aagcagccca ccgtgggggg cacaggctct gcgcccagag
5341 cccagaaggc cattgcaagc caccccagtg ctgcactcat ggctctgcgg agaggctcaa
5401 ggaacctcgt cttccgggac ttcacagatg aaaaagaggg accaataact aaacacatcc
5461 gactaacagc tgccttaata ttaaaaaata ttggtaaata ctcagagtgt gggcgcagat
5521 tgttaaagag acatgaaaac aacttatcag tgctcgccat tagtaacatg gaagcttcct
5581 ctacccttgc caaatgcctt tatgaactta attttacagt tcagagtaaa gaacaagaaa
5641 aagactcaga aatgctgtag tgaatcctac cccactgaca cagtggggtc tcaaagtcaa
5701 atacatttca catactgtta ctgaagaaag caccaagtct taatggagca gagaccatag
5761 aatgaattat tttgtgtcct ccatgatgct gagaggaaac ttcgtattct gatctctgaa
5821 cgaatccctt tcttttctgt taaaaaaaaa aaatctaaaa aggaaaaaaa aaaaaaaaaa
5881 aacaaaaact gctgtgggat tgtcaaccag cttatctgca ggatgtctcg gatctggcca
5941 atcctgatgg aaactggtgt gatcagaatt ctgtaccatc cacattggaa tatacatgga
6001 atagtgtaaa acctacgtga gcagatgaaa tagaagcatt aaatattttt atctatatcc
6061 aaaaaggagc acatttttat atttacagaa ccatttaagc tggtttgaat aacgacagag
6121 tttgagcaca cctatccccc agcttcagag gggccaccaa tatctagctg tggattgtgt
6181 gttttgttta gaatcagtag cttggttttc ttacttgagc caatatattt tcacttattt
6241 attatcataa aaatttacca gtctgaatag atcttgtaaa tatttgtgaa tagaatgaac
6301 actgttcata ccactgcagc cactggagat acatcctgtg gtgtcctaga agcattatcg
6361 gtaggctcta aagtttttcta gactttgctg tcaactgtaa gtaattgtga tatattctac
6421 gcagtggatg gatattcttt aaatctgtgt aaatacttct gcaaaggtac tgatgctgta
6481 aagtcaaaca gttttgtgga actgtgattt ttttttttcct cctttttttgg tttccttggc
6541 ccccacttgg gtttggtggg gttttgtttt tgttttgttt tgtattatac accttgtaga
6601 actcattttg ctggctgaaa gagtatggaa taatatatct catatgtcat ttttgtagaa
6661 gagaaactat ttggatttcc tttttgttgg tttggttttc cctaacacgt gtccgctgta
6721 cgcattcgtc acgtgcaagc tcagcttgtg cagggttttt tgtatttgta aattggttta
6781 aatacatgga attttataca ggttttctcc tgtgttatat atgcattatg tgcaggtatg
6841 atattttctt cactactttt tctatcttaa tatagtgtgg aattttattg tattattctt
6901 ccattcttaa tactgtacca cattcctgct cagaaactgc tcacttcctt aaattgtctt
6961 ttcccccaag cgtgaaatgt atccacttat aactgcctat tgcctgttct attagcatcc TABLE 1-continued 7021 aaaaatgtgg aaggcctccc aaccaccatt tctgctgtgt ccttaggatg tgcagtaaaa
7081 aaatatagac ctgacagttt atgttataga atggctttat ttactttggt gactgtttat
7141 agtttttaaa taaaagactg aacattttct tgagtccttt atttctgagt atgcttaaga
7201 cattctaaaa tttaaagtct agctgaaggc aaggtcaaac ggtcacctac ttactttata
7261 ctttgtgatt gtagagaaca gaaaggtgca tcatgtgata ggacaccatg gtcacggtag
7321 gaaggagacc aggagaccaa atgttttgtt tacagtagta tgagtagtag ccccagagag
7381 cgagagacag ttagggctcg gttgccttac tgtgtgtccc gcatctatct gactgagagc
7441 tttgtttacc attcgactct aggtttcagt ttaactaatt caggggcagc ttcttggcaa
7501 tgagcttcag tctggacagt tcaaatatct tgattaattt agtaccaaaa agtaatttct
7561 ccccaggggt ctctgtgctc tcagctctaa ctgtaagaaa tgtgtggcga cacccagaac
7621 ttggtattct caggttggtg gcgtttgact tcttcgcctt agcctggggc tgcccagcag
7681 acaccctgag tccaggtacc ttactgtatc cctcaaatat cgccagacta aaggtttcta
7741 agggcagata gttgtagaaa tttatattca ctgtgtttat ctaaaaaaat tgaggttttt
7801 gaaataattt ttgtaacatc actgtttgct tgtcctcaag gtaccttttt ccttccaaag
7861 caggaaatta ccatggtggt tagcctttag tagcagaaac gacaggctta agaaagtggc
7921 ttccatagtc accatcctgt cacctcactg aattgcatcc tgtagatgta gatttttgtg
7981 ttaaaatgta taaatgtgtc tttagtgctt ttaagcaatg gtctcagcag aattttctaa
8041 atgtatctga cctgacgaaa ccaatttcta gctcccctta ggcttcccct ccggcagctt
8101 tacctgacta atggataaga cttggtgggt aacgcggttg aagtgctctt gcagtccagg
8161 gcctgcagaa ccctcgcagt cacgaaaagg tgctccttgc tagacagaaa cttgctgact
8221 tccagtattg ttatttttgt ctaaagttct gtaaatacaa gctttaatgt tatctttgag
8281 agatctatgt aaataatagt caagaacata gagactgtac aattctgtgt tatatatgtg
8341 cctagtgctc tgttggcact taataaattt taagtaacaa aactgatgat catatagtga
8401 aggcatattt ttcttccgac ttgagacagg atatgactat atattaatga gactcaataa
8461 accaagccac acatgaaaac ttgtctcatt actttatagc catgccatgt atgtttttta
8521 aactataaaa tgacaataaa actgattttt gaaatgagtg ttttggataa gtgacttctg
8581 tcctgatctt ataccataaa taaagtactg aagacgaaat atgaagctct tacccaaagg
8641 agtagctgct tagaaacaag agtgaagctt gaagatcagc cacacaggcc acctcacact
8701 ttgttcctgt ttatcttacg atacagtaag ggaaggcacc atttagagcc agcttgtgtt
8761 agttaaccac tctcatactg cccaactctt gactgaactc tggcactcaa atacttggag
8821 tgagcttcct tccaaggcca cagaacagag accaaccgaa ttaccagctg gttccatcat
8881 agctagtaaa ctttatctag caacaatttc cactccctgc attggtttga aaaaaaaaat
8941 gcaaagagac agtatcaatg tatgtaagtg gattcactaa taatacaacc acactttaag
9001 tattaaagtg gggtgagatg gcttggtct SEQ ID NO: 12 Mouse ARID2 Amino Acid Sequence (NP_780460.3)
1 manstgkapp derrkglafl delrqfhhsr gspfkkipav ggkeldlhgl ytrvttlggf
61 akvseknqwg eiveefnfpr scsnaafalk qyylryleky ekvhhfgedd devppgnpkp
121 qlpigaipss ynyqqhsysd ylrqsyglsm dfnspndynk lvlsllsglp nevdfainvc
181 tllsneskhv mqlekdpkii tlllanagvf ddtlgsfssv fgeewrektd rdfvkfwkdi
241 vddnevrdli sdrnkahedt pgewiweslf hpprklgind ieggrvlgia vilrnlsfee
301 snvkllaanr tclrflllsa hshfislrql gldtlgniaa ellldpvdfr tthlmfhtvt
361 kclmsrdrfl kmrgmeilgn lckaedngvl iceyvdqdsy reiichltlp dvllvtstle
421 vlymltemgd vactkiakve ksidvlvolv smdaqmfgpd alaavklieh pssshqvlse
481 irpgaieqvg tqthiasgpa sravvaqhaa pppgiveids ekfacqwlna hfevnpdcsv
541 sraemyseyl stcsklargg iltstgfykc lrtvfpnhtv krvedstssg qahihvigvk
601 rralplpiqm yyqqqpistp vvrvdavadl sptpspagip hgpqaagnhf qrtpvtnqss
661 nitatqmsfp vggihtvaqt vsrippnpsv hthqqqnspv tvignkapip cevvkatviq
721 nsvpqtavpv sisvggapaq nsvgqnhsag pqpvtvvnsq tllhhpsvmp gpsplhtvvp
781 gqvpsgtpvt viqqtvpqsr mfgrvqsipa ctstvsqgqq littspqpmh tssqqtaags
841 qpqdtviiap pqyvttsasn ivsatsvgnf qvatgqvvti agvpspqpsr vgfqniapkp
901 lpsqqvspsv vqqpiqqpqq paqqsvvivs gpaqqggaya paihqivlan paalpagqtv
961 qltgqpnitp ssspspvppt nnqvptamss sstlqsqgpp ptvsqmlsvk rqqqqqhspa
1021 apaqqvqvqv qqpqqvqvqv qpqqpsagvg qpapnessli kglllpkrgp stpggklilp
1081 apqipppnna rapspqvvyq vannqaagfg vqgqtpaqql lvgqqnvqlv qsamppaggv
1141 qtvpisnlqi lpgplisnsp atifqgtsgn qvtitvvpnt sfatatvsqg naaqliapag
1201 lsmsgaqasa glqvqtlpag qsacttaplp fkgdkiicqk eeeakeatgl hvherkievm
1261 enpscrrgtt ntsngdtses elqvgsllng rkysdsslpp snsgklqset sqcslisngp
1321 slelgengap gkqnsepvdm qdvkgdlkka lvngicdfdk gdgshlskni pnhktsnhvg
1381 ngeispvepq gtsgatqqdt akgdqlervs ngpvltlggs pstssmqeap svatpplsgt
1441 dlpngplass lnsdvpqqrp svvvsphsta pvigghqvia vphsgprvtp salssdarst
1501 ngtaecktvk rpaedndrdt vpgipnkvgv rivtisdpnn agcsatmvav pagadpstva
1561 kvaiesaagq kqqhpptymq svapqntpmp pspavqvqgq psssqpspvs assqhadpvr
1621 kpgqnfmclw qsckkwfqtp sqvfyhaate hggkdvypgq clwegcepfq rqrfsfithl
1681 qdkhcskdal laglkqdepg qvanqksstk qptvggtgsa praqkaiash psaalmalrr
1741 gsrnlvfrdf tdekegpitk hirltaalil knigkysecg rrllkrhenn lsvlaisnme
1801 asstlakcly elnftvqske qekdseml SEQ ID NO: 13 Human BRD7 cDNA Sequence Variant 1 (NM_001173984.2, CDS: from 161 to 2119)
1 gagaggggca tcgcgccgcc cggcgcgcgc cgcccccctg cctcgcggcg cggggtctcg
61 cgggccccgc tcccgccctc cgctcgcctg gcccggaccg gaagcggcgc cgcacggcct
121 gggcctggcg cgggggggcgg gcaccggggc ccggtcggac atgggcaaga agcacaagaa
181 gcacaagtcg gacaaacacc tctacgagga gtatgtagag aagcccttga agctggtcct
241 caaagtagga gggaacgaag tcaccgaact ctccacgggc agctcggggc acgactccag
301 cctcttcgaa gacaaaaacg atcatgacaa acacaaggac agaaagcgga aaaagagaaa
361 gaaaggagag aagcagattc caggggaaga aaaggggaga aaacggagaa gagttaagga
421 ggataaaaag aagcgagatc gagaccgggt ggagaatgag gcagaaaaag atctccagtg
481 tcacgcccct gtgagattag acttgcctcc tgagaagcct ctcacaagct ctttagccaa
541 acaagaagaa gtagaacaga cacccccttca agaagctttg aatcaactga tgagacaatt TABLE 1-continued

```
 601 gcagagaaaa gatccaagtg ctttcttttc atttcctgtg actgatttta ttgctcctgg
 661 ctactccatg atcattaaac acccaatgga ttttagtacc atgaaagaaa agatcaagaa
 721 caatgactat cagtccatag aagaactaaa ggataacttc aaactaatgt gtactaatgc
 781 catgatttac aataaaccag agaccattta ttataaagct gcaaagaagc tgttgcactc
 841 aggaatgaaa attcttagcc aggaaagaat tcagagcctg aagcagagca tagacttcat
 901 ggctgacttg cagaaaactc gaaagcagaa agatggaaca gacacctcac agagtgggga
 961 ggacggaggc tgctggcaga gagagagaga ggactctgga gatgccgaag cacacgcctt
1021 caagagtccc agcaaagaaa ataaaaagaa agacaaagat atgcttgaag ataagtttaa
1081 aagcaataat ttagagagag agcaggagca gcttgaccgc atcgtgaagg aatctggagg
1141 aaagctgacc aggcggcttg tgaacagtca gtgcgaattt gaaagaagaa aaccagatgg
1201 aacaacgacg ttgggacttc tccatcctgt ggatcccatt gtaggagagc caggctactg
1261 ccctgtgaga ctgggaatga caactggaag acttcagtct ggagtgaata ctttgcaggg
1321 gttcaaagag gataaaagga acaaagtcac tccagtgtta tatttgaatt atgggcccta
1381 cagttcttat gcaccgcatt atgactccac atttgcaaat atcagcaagg atgattctga
1441 tttaatctat tcaacctatg gggaagactc tgatcttcca agtgatttca gcatccatga
1501 gtttttggcc acgtgccaag attatccgta tgtcatggca gatagtttac tggatgtttt
1561 aacaaaagga gggcattcca ggaccctaca agagatggag atgtcattgc ctgaagatga
1621 aggccatact aggacacttg acacagcaaa agaaatggag cagattacag aagtagagcc
1681 accagggcgt ttggactcca gtactcaaga caggctcata gcgctgaaag cagtaacaaa
1741 ttttggcgtt ccagttgaag tttttgactc tgaagaagct gaaatattcc agaagaaact
1801 tgatgagacc accagattgc tcagggaact ccaggaagcc cagaatgaac gtttgagcac
1861 cagacccccct ccgaacatga tctgtctctt gggtccctca tacagagaaa tgcatcttgc
1921 tgaacaagtg accaataatc ttaaagaact tgcacagcaa gtaactccag gtgatatcgt
1981 aagcacgtat ggagttcgaa aagcaatggg gatttccatt ccttcccccg tcatggaaaa
2041 caactttgtg gatttgacag aagacactga agaacctaaa aagacggatg ttgctgagtg
2101 tggacctggt ggaagttgag gctgcctggt atttgattat atattatgta catacttttt
2161 cattcttaac ttagaaatgc ttttcagaag atattaaata tttgtaaatt gtgtttttaa
2221 ttaaactttg gaacagcgaa tttggatgtt ccagaggttg gacttgtatt aggtaataaa
2281 gctggacctg ggactcgtga ggaaggaatg tgaaaaaaaa aaaaaaaaaa
```

SEQ ID NO: 14 Human BRD7 Amino Acid Sequence Isoform A (NP_001167455.1)

```
  1 mgkkhkkhks dkhlyeeyve kplklvlkvg gnevtelstg ssghdsslfe dkndhdkhkd
 61 rkrkkrkkge kqipgeekgr krrrvkedkk krdrdrvene aekdlqchap vrldlppekp
121 ltsslakqee vegtplgeal nqlmrqlqrk dpsaffsfpv tdfiapgysm iikhpmdfst
181 mkekiknndy qsieelkdnf klmctnamiy nkpetiyyka akkllhsgmk ilsgeriqsl
241 kgsidfmadl qktrkqkdgt dtsqsgedgg cwqreredsg daeahafksp skenkkkdkd
301 mledkfksnn lereqeqldr ivkesggklt rrlvnsqcef errkpdgttt lgllhpvdpi
361 vgepgycpvr lgmttgrlqs gvntlqgfke dkrnkvtpvl ylnygpyssy aphydstfan
421 iskddsdliy stygedsdlp sdfsihefla tcgdypyvma dslldvltkg ghsrtlqeme
481 mslpedeght rtldtakeme qiteveppgr ldsstqdrli alkavtnfgv pvevfdseea
541 eifqkkldet trllrelgea qnerlstrpp pnmicllgps yremhlaeqv tnnlkelagq
601 vtpgdivsty gvrkamgisi pspvmennfv dltedteepk ktdvaecgpg gs
```

SEQ ID NO: 15 Human BRD7 cDNA Sequence Variant 2 (NM_013263.4, CDS: from 161 to 2116)

```
   1 gagaggggca tcgcgccgcc cggcgcgcgc cgccccccctg cctcgcggcg cggggtctcg
  61 cgggccccgc tcccgccctc cgctcgcctg gcccggaccg gaagcggcgc cgcacggcct
 121 gggcctggcg cggggggcgg gcaccggggc ccggtcggac atgggcaaga agcacaagaa
 181 gcacaagtcg gacaaacacc tctacgagga gtatgtagag aagcccttga agctggtcct
 241 caaagtagga gggaacgaag tcaccgaact ctccacgggc agctcggggc acgactccag
 301 cctcttcgaa gacaaaaacg atcatgacaa acacaaggac agaaagcgga aaaagagaaa
 361 gaaaggagag aagcagattc caggggaaga aaaggggaga aaacggagaa gagttaagga
 421 ggataaaaag aagcgagatc gagaccgggt ggagaatgag gcagaaaaag atctccagtg
 481 tcacgcccct gtgagattag acttgcctcc tgagaagcct ctcacaagct ctttagccaa
 541 acaagaagaa gtagaacaga caccccttca agaagctttg aatcaactga tgagacaatt
 601 gcagagaaaa gatccaagtg ctttcttttc atttcctgtg actgatttta ttgctcctgg
 661 ctactccatg atcattaaac acccaatgga ttttagtacc atgaaagaaa agatcaagaa
 721 caatgactat cagtccatag aagaactaaa ggataacttc aaactaatgt gtactaatgc
 781 catgatttac aataaaccag agaccattta ttataaagct gcaaagaagc tgttgcactc
 841 aggaatgaaa attcttagcc aggaaagaat tcagagcctg aagcagagca tagacttcat
 901 ggctgacttg cagaaaactc gaaagcagaa agatggaaca gacacctcac agagtgggga
 961 ggacggaggc tgctggcaga gagagagaga ggactctgga gatgccgaag cacacgcctt
1021 caagagtccc agcaaagaaa ataaaaagaa agacaaagat atgcttgaag ataagtttaa
1081 aagcaataat ttagagagag agcaggagca gcttgaccgc atcgtgaagg aatctggagg
1141 aaagctgacc aggcggcttg tgaacagtca gtgcgaattt gaaagaagaa aaccagatgg
1201 aacaacgacg ttgggacttc tccatcctgt ggatcccatt gtaggagagc caggctactg
1261 ccctgtgaga ctgggaatga caactggaag acttcagtct ggagtgaata ctttgcaggg
1321 gttcaaagag gataaaagga acaaagtcac tccagtgtta tatttgaatt atgggcccta
1381 cagttcttat gcaccgcatt atgactccac atttgcaaat atcagcaagg atgattctga
1441 tttaatctat tcaacctatg gggaagactc tgatcttcca agtgatttca gcatccatga
1501 gtttttggcc acgtgccaag attatccgta tgtcatggca gatagtttac tggatgtttt
1561 aacaaaagga gggcattcca ggaccctaca agagatggag atgtcattgc ctgaagatga
1621 aggccatact aggacacttg acacagcaaa agaaatggag attacagaag tagagccacc
1681 agggcgtttg gactccagta ctcaagacag gctcatagcg ctgaaagcag taacaaattt
1741 tggcgttcca gttgaagttt ttgactctga agaagctgaa atattccaga agaaacttga
1801 tgagaccacc agattgctca gggaactcca ggaagcccag aatgaacgtt tgagcaccag
1861 accccctccg aacatgatct gtctcttggg tccctcatac agagaaatgc atcttgctga
1921 acaagtgacc aataatctta aagaacttgc acagcaagta actccaggtg atatcgtaag
1981 cacgtatgga gttcgaaaag caatggggat ttccattcct tcccccgtca tggaaaacaa
2041 ctttgtggat ttgacagaag acactgaaga acctaaaaag acggatgttg ctgagtgtgg
```

TABLE 1-continued

```
2101 acctggtgga agttgaggct gcctggtatt tgattatata ttatgtacat actttttcat
2161 tcttaactta gaaatgcttt tcagaagata ttaaatattt gtaaattgtg tttttaatta
2221 aactttggaa cagcgaattt ggatgttcca gaggttggac ttgtattagg taataaagct
2281 ggacctggga ctcgtgagga aggaatgtga aaaaaaaaaa aaaaaaa
```

SEQ ID NO: 16 Human BRD7 Amino Acid Sequence Isoform B (NP_037395.2)

```
  1 mgkkhkkhks dkhlyeeyve kplklvlkvg gnevtelstg ssghdsslfe dkndhdkhkd
 61 rkrkkrkkge kqipgeekgr krrrvkedkk krdrdrvene aekdlqchap vrldlppekp
121 ltsslakqee veqtplqeal nqlmrqlqrk dpsaffsfpv tdfiapgysm iikhpmdfst
181 mkekikknndy qsieelkdnf klmctnamiy nkpetiyyka akkllhsgmk ilsgeriqsl
241 kgsidfmadl qktrkqkdgt dtsqsgedgg cwqreredsg daeahafksp skenkkkdkd
301 mledkfksnn lereqeqldr ivkesggklt rrlvnsqcef errkpdgttt lgllhpvdpi
361 vgepgycpvr lgmttgrlqs gvntlqgfke dkrnkvtpvl ylnygpyssy aphydstfan
421 iskddsdliy stygedsdlp sdfsihefla tcgdypyvma dslldvltkg ghsrtlqeme
481 mslpedeght rtldtakeme iteveppgrl dsstqdrlia lkavtnfgvp vevfdseeae
541 ifqkkldett rllrelgeaq nerlstrppp nmicllgpsy remhlaeqvt nnlkelaqqv
601 tpgdivstyg vrkamgisip spvmennfvd ltedteepkk tdvaecgpgg s
```

SEQ ID NO: 17 Mouse BRD7 cDNA Sequence (NM_012047.2, CDS: from 238 to 2193)

```
   1 ggtttgccgg cctctcgccc tctcgccact ggtgtcgcgc ttcggtcgcg tcccgcgcgt
  61 ggtttttttt ttttctcgtg agggacctcg cgccgccggg cgcgtgccgt ccccctgcct
 121 cgcggcgcgg gctctcgcgg gccccgctcc cgccctccgc tcgcctggcc cggaccggaa
 181 gcggcgccgc acggcctggg cctggcgcgg ggggcggcgct ctggggcccg gtcggacatg
 241 ggcaagaagc acaagaagca caagtcggac cgccacttct acgaggagta cgtggagaag
 301 cccctgaagc tggtcctcaa agtcgggggg agcgaggtca ccgagctctc cacgggcagc
 361 tccgggcacg actccagcct cttcgaagac agaagcgacc atgacaaaca caaggacaga
 421 aaacggaaaa agaggaagaa aggcgagaag caggctccgg gggaagagaa ggggagaaaa
 481 cggagaagag tcaaggagga taaaaagaag cgggatcgag accgtgcaga gaatgaggtg
 541 gacagagatc tccagtgtca tgtccctata agattagact tacctcctga gaagcctctt
 601 acaagctcgt tagccaaaca agaagaagta gaacagacac cccttcagga agctttgaat
 661 cagctcatga gacaattgca aagaaaagac ccaagtgctt tcttttcatt tcctgtgacg
 721 gatttttattg cgcctggcta ctccatgatt attaaacacc caatggattt tagtaccatg
 781 aaagaaaaga tcaagaataa cgactaccag tccatagaag aactaaagga taacttcaag
 841 ctaatgtgta ctaatgcaat gatttacaat aagccagaga ccatttatta taaagctgca
 901 aagaagctgt tgcactcagg gatgaaaatt ctcagtcagg agagaattca gagcctgaag
 961 cagagtatag acttcatgtc agacttgcag aaaactcgga agcagaaaga acgaacagat
1021 gcctgtcaga gtggggagga cagcggctgc tggcagcgcg agagggaaga ctctggagat
1081 gctgaaacac aggccttcag aagccccgct aaggacaata aaaggaaaga caaagatgtg
1141 cttgaagaca aatggagaag cagcaactca gaaagggagc atgagcagat tgagcgcgtt
1201 gtccaggagt caggaggcaa gctaacacgg cggctggcaa acagtcagtg tgaatttgaa
1261 agaagaaaac cagatgggac aacaacactg gggcttctcc atcctgtgga tcccattgtg
1321 ggagagccag gctactgccc tgtgagattg gggatgacaa ctggaagact gcagtctgga
1381 gtgaacactc tgcaggggtt caaagaggat aaaaggaaca gagtaacccc agtattatac
1441 ttgaattatg gaccctacag ttcttatgcc ccacattatg actctacatt tgccaatatt
1501 agcaaagatg attctgattt aatctactca acatatgggg aagactctga ccttccaaac
1561 aatttcagca tctctgagtt tttggccaca tgccaagatt acccgtatgt tatggcagat
1621 agtttactgg atgttctaac aaaaggagga cattccagga gcctgcagga cttggacatg
1681 tcatctcctg aagatgaagg ccagaccaga gcattggaca cagcaaaaga agcagagatt
1741 acacaaatag agccaacagg gcgtttggag tccagcagtc aggacaggct cacagcactg
1801 caagctgtaa caacctttgg tgctccagct gaagtctttg actccgaaga ggctgaggtg
1861 ttccagagga agcttgatga gacgacaaga ttgctcaggg agctccagga ggcacagaat
1921 gagcgactga gcactaggcc tcctcccaat atgatctgtc tcctgggtcc ttcttacaga
1981 gaaatgtacc ttgctgaaca agtgaccaat aacctcaaag aactcacaca gcaagtgact
2041 ccaggtgatg ttgtaagcat acacggagtg cgaaaagcaa tggggatttc tgttccttcc
2101 cccatcgtgg gaaacagctt cgtagatttg acaggagagt gtgaagaacc taaggagacc
2161 agcactgctg agtgtgggcc tgacgcgagc tgaactagcc tggtatttga ttctattatg
2221 tacatagttt ttcattctga acttggaggt gcttttcaga agatattaac tatttgtaaa
2281 ttgtgtttta attaagcttt gggacagttc cttttaatgt tccaaagatt ggccttgtat
2341 taggaaataa agctgaacct gggactgtga
```

SEQ ID NO: 18 Mouse BRD7 Amino Acid Sequence (NP_036177.1)

```
  1 mgkkhkkhks drhfyeeyve kplklvlkvg gsevtelstg ssghdsslfe drsdhdkhkd
 61 rkrkkrkkge kqapgeekgr krrrvkedkk krdrdraene vdrdlqchvp irldlppekp
121 ltsslakqee vegtplqeal nqlmrqlqrk dpsaffsfpv tdfiapgysm iikhpmdfst
181 mkekikknndy qsieelkdnf klmctnamiy nkpetiyyka akkllhsgmk ilsgeriqsl
241 kgsidfmsdl qktrkqkert dacqsgedsg cwqreredsg daetqafrsp akdnkrkdkd
301 vledkwrssn sereheqier vvqesggklt rrlansqcef errkpdgttt lgllhpvdpi
361 vgepgycpvr lgmttgrlqs gvntlqgfke dkrnrvtpvl ylnygpyssy aphydstfan
421 iskddsdliy stygedsdlp nnfsisefla tcgdypyvma dslldvltkg ghsrslqdld
481 msspedegqt raldtakeae itqieptgrl essqdrlta lqavttfgap aevfdseeae
541 vfqrkldett rllrelgeaq nerlstrppp nmicllgpsy remylaeqvt nnlkeltqqv
601 tpgdvvsihg vrkamgisvp spivgnsfvd ltgeceepke tstaecgpda s
```

SEQ ID NO: 19 Human PHF10 cDNA Sequence Variant 1 (NM_018288.3, CDS: from 80 to 1576)

```
  1 ggcggcggcg gcagcggcgg cggcggccgg gacaaggcgg aggcgacggc ggcggcggcg
 61 gcgcggggcg ctcgggctga tggcggcggc ggccgggccc ggggctgcgc tgtccccgcg
121 gccgtgcgac agcgacccag ccaccccccgg agcgcagtcc ccgaaggatg ataatgaaga
181 taattcaaat gatgggaccc agccatccaa aaggaggcga atgggctcag gagatagttc
241 taggagttgt gaaacttcaa gtcaagatct tggttttagt tactatccag cagaaaactt
```

TABLE 1-continued

```
 301 gatagagtac aaatggccac ctgatgaaac aggagaatac tatatgcttc aagaacaagt
 361 cagtgaatat ttgggtgtga cctcctttaa aaggaaatat ccagatttag agcgacgaga
 421 tttgtctcac aaggagaaac tctacctgag agagctaaat gtcattactg aaactcagtg
 481 cactctaggc ttaacagcat tgcgcagtga tgaagtgatt gatttaatga taaaagaata
 541 tccagccaaa catgctgagt attctgttat tctacaagaa aaagaacgtc aacgaattac
 601 agaccattat aaagagtatt cccaaatgca acaacagaat actcagaaag ttgaagccag
 661 taaagtgcct gagtatatta agaaagctgc caaaaaagca gcagaattta atagcaactt
 721 aaaccgggaa cgcatggaag aaagaagagc ttattttgac ttgcagacac atgttatcca
 781 ggtacctcaa gggaagtaca aagttttgcc aacagagcga acaaaggtca gttcttaccc
 841 agtggctctc atccccggac agttccagga atattataag aggtactcac cagatgagct
 901 gcggtatctg ccattaaaca cagccctgta tgagcccccct ctggatcctg agctccctgc
 961 tctagacagt gatggtgatt cagatgatgg cgaagatggt cgaggtgatg agaaacggaa
1021 aaataaaggc acttcggaca gctcctctgg caatgtatct gaagggggaaa gccctcctga
1081 cagccaggag gactctttcc agggaagaca gaaatcaaaa gacaaagctg ccactccaag
1141 aaaagatggt cccaaacgtt ctgtactgtc caagtcagtt cctgggtaca agccaaaggt
1201 cattccaaat gctatatgtg gaatttgtct gaagggtaag gagtccaaca agaaaggaaa
1261 ggctgaatca cttatacact gctcccaatg tgagaatagt ggccatcctt cttgcctgga
1321 tatgacaatg gagcttgttt ctatgattaa gacctaccca tggcagtgta tggaatgtaa
1381 aacatgcatt atatgtggac aaccccacca tgaagaagaa atgatgttct gtgatatgtg
1441 tgacagaggt tatcatactt tttgtgtggg ccttggtgct attccatcag gtcgctggat
1501 ttgtgactgt tgtcagcggg cccccccaac acccaggaaa gtgggcagaa gggggaaaaa
1561 cagcaaagag ggataaaata gtttttgact ctaatactgt atatgcattt aagtggaata
1621 tttggtgcca tttacaacat tattttcatg ccaataaaag attttttttg caaaaaaaaa
1681 aaaaaaaaaa aa
```

SEQ ID NO: 20 Human PHF10 Amino Acid Sequence Isoform A (NP_060758.2)

```
   1 maaaagpgaa lsprpcdsdp atpgaqspkd dnednsndgt gpskrrrmgs gdssrscets
  61 sqdlgfsyyp aenlieykwp pdetgeyyml gegvseylgv tsfkrkypdl errdlshkek
 121 lylrelnvit etqctlglta lrsdevidlm ikeypakhae ysvilqeker qritdhykey
 181 sqmqqqntqk veaskvpeyi kkaakkaaef nsnlnrerme errayfdlqt hviqvpqgky
 241 kvlptertkv ssypvalipg qfqeyykrys pdelrylpin talyeppldp elpaldsdgd
 301 sddgedgrgd ekrknkgtsd sssgnvsege sppdsqedsf qgrqkskdka atprkdgpkr
 361 svlsksvpgy kpkvipnaic giclkgkesn kkgkaeslih csqcensghp scldmtmelv
 421 smiktypwqc meckt ciicg qphheeemmf cdmcdrgyht fcvglgaips grwicdccqr
 481 apptprkvgr rgknskeg
```

SEQ ID NO: 21 Human PHF10 cDNA Sequence Variant 2 (NM_133325.2, CDS: from 80 to 1570)

```
   1 ggcggcggcg gcagcggcgg cggcggccgg gacaaggcgg aggcgacggc ggcggcggcg
  61 gcgcggggcg ctcgggctga tggcggcggc ggccgggccc ggggctgcgc tgtccccgcg
 121 gccgtgcgac agcgacccag ccacccccgg agcgcagtcc ccgaaggatg ataatgaaga
 181 taattcaaat gatgggaccc agccatccaa aaggaggcga atgggctcag gagatagttc
 241 taggagttgt gaaacttcaa gtcaagatct tggttttagt tactatccag cagaaaactt
 301 gatagagtac aaatggccac ctgatgaaac aggagaatac tatatgcttc aagaacaagt
 361 cagtgaatat ttgggtgtga cctcctttaa aaggaaatat ccagagcgac gagatttgtc
 421 tcacaaggag aaactctacc tgagagagct aaatgtcatt actgaaactc agtgcactct
 481 aggcttaaca gcattgcgca gtgatgaagt gattgattta atgataaaag aatatccagc
 541 caaacatgct gagtattctg ttattctaca agaaaaagaa cgtcaacgaa ttacagacca
 601 ttataaagag tattcccaaa tgcaacaaca gaatactcag aaagttgaag ccagtaaagt
 661 gcctgagtat attaagaaag ctgccaaaaa agcagcagaa tttaatagca acttaaaccg
 721 ggaacgcatg gaagaaagaa gagcttattt tgacttgcag acacatgtta tccaggtacc
 781 tcaagggaag tacaaagttt tgccaacaga gcgaacaaag gtcagttctt acccagtggc
 841 tctcatcccc ggacagttcc aggaatatta taagaggtac tcaccagatg agctgcggta
 901 tctgccatta aacacagccc tgtatgagcc ccctctggat cctgagctcc ctgctctaga
 961 cagtgatggt gattcagatg atggcgaaga tggtcgaggt gatgagaaac ggaaaaataa
1021 aggcacttcg gacagctcct ctggcaatgt atctgaaggg gaaagccctc ctgacagcca
1081 ggaggactct ttccagggaa gacagaaatc aaaagacaaa gctgccactc caagaaaaga
1141 tggtcccaaa cgttctgtac tgtccaagtc agttcctggg tacaagccaa aggtcattcc
1201 aaatgctata tgtggaattt gtctgaaggg taaggagtcc aacaagaaag gaaaggctga
1261 atcacttata cactgctccc aatgtgagaa tagtggccat ccttcttgcc tggatatgac
1321 aatggagctt gtttctatga ttaagaccta cccatggcag tgtatggaat gtaaaacatg
1381 cattatatgt ggacaacccc accatgaaga agaaatgatg ttctgtgata tgtgtgacag
1441 aggttatcat actttttgtg tgggccttgg tgctattcca tcaggtcgct ggatttgtga
1501 ctgttgtcag cgggcccccc caacacccag gaaagtgggc agaaggggga aaaacagcaa
1561 agagggataa aatagttttt gactctaata ctgtatatgc atttaagtgg aatatttggt
1621 gccatttaca acattatttt catgccaata aaagattttt tttgcaaaaa aaaaaaaaaa
1681 aaaaaa
```

SEQ ID NO: 22 Human PHF10 Amino Acid Sequence Isoform B (NP_579866.2)

```
   1 maaaagpgaa lsprpcdsdp atpgaqspkd dnednsndgt qpskrrrmgs gdssrscets
  61 sqdlgfsyyp aenlieykwp pdetgeyyml qeqvseylgv tsfkrkyper rdlshkekly
 121 lrelnvitet qctlgltalr sdevidlmik eypakhaeys vilqekerqr itdhykeysq
 181 mqqqntqkve askvpeyikk aakkaaefns nlnrermeer rayfdlqthv iqvpqgkykv
 241 lptertkvss ypvalipgqf qeyykryspd elrylpinta lyeppldpel paldsdgdsd
 301 dgedgrgdek rknkgtsdss sgnvsegesp pdsqedsfqg rqkskdkaat prkdgpkrsv
 361 lsksvpgykp kvipnaicgi clkgkesnkk gkaeslihcs qcensghpsc ldmtmelvsm
 421 iktypwqcme cktciicgqp hheeemmfcd mcdrgyhtfc vglgaipsgr wicdccqrap
 481 ptprkvgrrg knskeg
```

TABLE 1-continued

SEQ ID NO: 23 Mouse PHF10 cDNA Sequence (NM_024250.4, CDS: from 67 to 1560)
```
   1 gcggcggcgg ccgctgggac taggcgaagg cggcgacgac gacggaggcg cggggcgctt
  61 gggctgatgg cagcggccgg gcccggggcg gcgctgtccc cggggcggtg cgacagcgac
 121 ccggcctccc ccggagcgca gtccccaaag gatgataatg aagataactc aaatgatggg
 181 acccatccat gtaaaaggag gcgaatgggc tcaggagaca gctcaagaag ttgtgagact
 241 tcaagtcaag atcttagctt cagttactac ccagcagaaa acttaatcga atacaaatgg
 301 ccacctgatg aaacaggaga atactatatg cttcaggagc aagtcagtga atatctgggt
 361 gtgacctcct tcaagcggaa atatccagat ttagagcgac gagatttatc tcacaaggag
 421 aaactatacc tgagagaatt aaacgtcatc acggaaacac agtgcacact gggtttaaca
 481 gcattgcgca gtgatgaagt gattgactta atgataaaag aatatccagc taaacacgct
 541 gaatattcgg ttatcctaca agaaaaggaa cgtcagagaa ttacagatca ttataaagag
 601 tattctcaaa tgcaacaaca gagtactcag aaagtcgaag ccagcaaagt acctgagtac
 661 attaagaaag cagccaagaa ggcagctgag ttcaacagca acttaaaccg ggagcgcatg
 721 gaagaaagaa gagcctattt tgacttacag acacatgtta tccaagtgcc tcaaggaaag
 781 tacaaagtgt tgccgacaga ccgaacgaag gtcagttcct acccagtggc tctcatcccg
 841 ggacagttcc aggagtatta taagaggtac tcaccagatg agcttcggta cttgccatta
 901 aacacagccc tgtatgagcc gcccctggac ccagagctcc cggcactaga tagtgatgga
 961 gactcagatg atggcgaaga tggcggaggg gatgagaagc ggaagaataa aggcacttcg
1021 gacagctcct caggcaatgt gtctgaagga gacagccccc ctgacagcca ggaggacacc
1081 ttccacggaa gacagaaatc aaaagacaaa atggccactc caagaaaaga cggctccaaa
1141 cgttctgtac tgtccaaatc agctcctggg tacaagccaa aggtcattcc aaatgctcta
1201 tgtggaattt gtctgaaggg taaggagtcc aacaagaaag gaaaggctga atcacttata
1261 cactgctccc agtgtgataa cagtggccac ccttcttgct tggatatgac catggagctt
1321 gtttctatga ttaagaccta cccatggcag tgtatggaat gtaagacatg cattatatgt
1381 ggacagcccc accatgaaga agaaatgatg ttctgtgatg tgtgtgacag aggttatcat
1441 actttttgtg tgggccttgg tgctattcct tcaggtcgct ggatttgtga ctgttgtcag
1501 cgagctcccc caacacccag gaaagtgggc agaagggggga aaaacagcaa agaggggtaa
1561 aataggcttt gaccctcatg tttgggatat ttggtgccaa tttatttaca acactttcat
1621 ttttatgcca ataaaaactt ttttgaaatt aacgatgacc ttaaa
```

SEQ ID NO: 24 Mouse PHF10 Amino Acid Sequence (NP_077212.3)
```
   1 maaagpgaal spgrcdsdpa spgaqspkdd nednsndgth pckrrrmgsg dssrscetss
  61 qdlsfsyypa enlieykwpp detgeyymlq eqvseylgvt sfkrkypdle rrdlshkekl
 121 ylrelnvite tqctlgltal rsdevidlmi keypakhaey svilgekerq ritdhykeys
 181 qmqqqstqkv easkvpeyik kaakkaaefn snlnrermee rrayfdlqth viqvpqgkyk
 241 vlptdrtkvs sypvalipgq fqeyykrysp delrylpint alyeppldpe lpaldsdgds
 301 ddgedgggde krknkgtsds ssgnvsegds ppdsqedtfh grqkskdkma tprkdgskrs
 361 vlsksapgyk pkvipnalcg iclkgkesnk kgkaeslihc sqcdnsghps cldmtmelvs
 421 miktypwqcm ecktciicgq phheeemmfc dvcdrgyhtf cvglgaipsg rwicdccqra
 481 pptprkvgrr gknskeg
```

SEQ ID NO: 25 Human ARID1A cDNA Sequence Variant 1 (NM_006015.4, CDS: from 374 to 7231)
```
   1 cagaaagcgg agagtcacag cggggccagg ccctggggag cggagcctcc accgcccccc
  61 tcattcccag gcaagggctt ggggggaatg agccgggaga gccgggtccc gagcctacag
 121 agccgggagc agctgagccg ccggcgcctc ggccgccgcc gccgcctcct cctcctccgc
 181 cgccgccagc ccggagcctg agccggcggg gcggggggga gaggagcgag cgcagcgcag
 241 cagcggagcc ccgcgaggcc cgcccgggcg ggtggggagg gcagcccggg ggactgggcc
 301 ccggggcggg gtgggagggg gggagaagac gaagacaggg ccgggtctct ccgcggacga
 361 gacagcgggg atcatggccg cgcaggtcgc cccccgccgcc gccagcagcc tgggcaaccc
 421 gccgccgccg ccgccctcgg agctgaagaa agccgagcag cagcagcggg aggaggcggg
 481 gggcgaggcg gcggcggcgg cagcggccga gcgcggggaa atgaaggcag ccgccgggca
 541 ggaaagcgag ggccccgccg tggggccgcc gcagccgctg ggaaaggagc tgcaggacgg
 601 ggccgagagc aatgggggtg gcggcggcgg cggagccggc agcggcggcg ggcccggcgc
 661 ggagccggac ctgaagaact cgaacgggaa cgcgggccct aggcccgccc tgaacaataa
 721 cctcacggag ccgcccggcg gcggcggtgg cggcagcagc gatggggtgg gggcgcctcc
 781 tcactcagcc gcggccgcct tgccgccccc agcctacggc ttcgggcaac cctacggccg
 841 gagcccgtct gccgtcgccg ccgccgcggc cgccgtcttc caccaacaac atggcggaca
 901 acaaagccct ggcctggcag cgctgcagag cggcggcggc gggggcctgg agccctacgc
 961 ggggccccag cagaactctc acgaccacgg cttccccaac caccagtaca actcctacta
1021 ccccaaccgc agcgcctacc ccccgcccgc cccggcctac gcgctgagct ccccgagagg
1081 tggcactccg ggctccggcg cggcggcggc tgccggctcc aagccgcctc cctcctccag
1141 cgcctccgcc tcctcgtcgt cttcgtcctt cgctcagcag cgcttcgggg ccatgggggg
1201 aggcggcccc tccgcggccg gcgggggaac tccccagccc accgccaccc ccaccctcaa
1261 ccaactgctc acgtcgccca gctcggcccg gggctaccag ggctaccccg gggcgacta
1321 cagtggcggg ccccaggacg ggggcgccgg caagggcccg gcggacatgg cctcgcagtg
1381 ttggggggct gcggcggcgg cagctgcggc ggcggccgcc tcgggagggg cccaacaaag
1441 gagccaccac gcgcccatga gccccgggag cagcggcggc ggggggcagc cgctcgcccg
1501 gacccctcag ccatccagtc caatggatca gatgggcaag atgagacctc agccatatgg
1561 cgggactaac ccatactcgc agcaacaggg acctccgtca ggaccgcagc aaggacatgg
1621 gtacccaggg cagccatacg ggtcccagac cccgcagcgg tacccgatga ccatgcaggg
1681 ccgggcgcag agtgccatgg gcggcctctc ttatacacag cagattcctc cttatggaca
1741 acaaggcccc agcgggtatg gtcaacaggg ccagactcca tattacaacc agcaaagtcc
1801 tcaccctcag cagcagcagc caccctactc ccagcaacca ccgtcccaga cccctcatgc
1861 ccaaccttcg tatcagcagc agccacagtc tcaaccacca cagctccagt cctctcagcc
1921 tccatactcc cagcagccat cccagcctcc acatcagcag tccccggctc catacccctc
1981 ccagcagtcg acgacacagc agcaccccca gagccagccc ccctactcac agccacaggc
2041 tcagtctcct taccagcagc agcaacctca gcagccagca ccctcgacgc tctcccagca
2101 ggctgcgtat cctcagcccc agtctcagca gtcccagcaa actgcctatt cccagcagcg
2161 cttccctcca ccgcaggagc tatctcaaga ttcatttggg tctcaggcat cctcagcccc
```

TABLE 1-continued

| | | | | | | |
|---|---|---|---|---|---|---|
| 2221 | ctcaatgacc | tccagtaagg | gagggcaaga | agatatgaac | ctgagccttc | agtcaagacc |
| 2281 | ctccagcttg | cctgatctat | ctggttcaat | agatgacctc | cccatgggga | cagaaggagc |
| 2341 | tctgagtcct | ggagtgagca | catcagggat | ttccagcagc | caaggagagc | agagtaatcc |
| 2401 | agctcagtct | cctttctctc | ctcatacctc | ccctcacctg | cctggcatcc | gaggcccttc |
| 2461 | cccgtcccct | gttggctctc | ccgccagtgt | tgctcagtct | cgctcaggac | cactctcgcc |
| 2521 | tgctgcagtg | ccaggcaacc | agatgccacc | tcggccaccc | agtggccagt | cggacagcat |
| 2581 | catgcatcct | tccatgaacc | aatcaagcat | tgcccaagat | cgaggttata | tgcagaggaa |
| 2641 | cccccagatg | ccccagtaca | gttcccccca | gcccggctca | gccttatctc | cgcgtcagcc |
| 2701 | ttccggagga | cagatacaca | caggcatggg | ctcctaccag | cagaactcca | tggggagcta |
| 2761 | tggtccccag | gggggtcagt | atggcccaca | aggtggctac | cccaggcagc | caaactataa |
| 2821 | tgccttgccc | aatgccaact | accccagtgc | aggcatggct | ggaggcataa | accccatggg |
| 2881 | tgccggaggt | caaatgcatg | gacagcctgg | catcccacct | tatggcacac | tccctccagg |
| 2941 | gaggatgagt | cacgcctcca | tgggcaaccg | gccttatggc | cctaacatgg | ccaatatgcc |
| 3001 | acctcaggtt | gggtcaggga | tgtgtccccc | accagggggc | atgaaccgga | aaacccaaga |
| 3061 | aactgctgtc | gccatgcatg | ttgctgccaa | ctctatccaa | aacaggccgc | caggctaccc |
| 3121 | caatatgaat | caagggggca | tgatgggaac | tggacctcct | tatggacaag | ggattaatag |
| 3181 | tatggctggc | atgatcaacc | ctcagggacc | cccatattcc | atgggtggaa | ccatggccaa |
| 3241 | caattctgca | gggatggcag | ccagcccaga | gatgatgggc | cttggggatg | taaagttaac |
| 3301 | tccagccacc | aaaatgaaca | acaaggcaga | tgggacaccc | aagacagaat | ccaaatccaa |
| 3361 | gaaatccagt | tcttctacta | caaccaatga | gaagatcacc | aagttgtatg | agctgggtgg |
| 3421 | tgagcctgag | aggaagatgt | gggtggaccg | ttatctggcc | ttcactgagg | agaaggccat |
| 3481 | gggcatgaca | aatctgcctg | ctgtgggtag | gaaacctctg | gacctctatc | gcctctatgt |
| 3541 | gtctgtgaag | gagattggtg | gattgactca | ggtcaacaag | aacaaaaaat | ggcgggaact |
| 3601 | tgcaaccaac | ctcaatgtgg | gcacatcaag | cagtgctgcc | agctccttga | aaaagcagta |
| 3661 | tatccagtgt | ctctatgcct | ttgaatgcaa | gattgaacgg | ggagaagacc | ctcccccaga |
| 3721 | catctttgca | gctgctgatt | ccaagaagtc | ccagcccaag | atccagcctc | cctctcctgc |
| 3781 | gggatcagga | tctatgcagg | ggccccagac | tccccagtca | accagcagtt | ccatggcaga |
| 3841 | aggaggagac | ttaaagccac | caactccagc | atccacacca | cacagtcaga | tcccccccatt |
| 3901 | gccaggcatg | agcaggagca | attcagttgg | gatccaggat | gcctttaatg | atggaagtga |
| 3961 | ctccacattc | cagaagcgga | attccatgac | tccaaaccct | gggtatcagc | ccagtatgaa |
| 4021 | tacctctgac | atgatggggc | gcatgtccta | tgagccaaat | aaggatcctt | atggcagcat |
| 4081 | gaggaaagct | ccagggagtg | atcccttcat | gtcctcaggg | cagggcccca | acggcgggat |
| 4141 | gggtgacccc | tacagtcgtg | ctgccggccc | tgggctagga | aatgtggcga | tgggaccacg |
| 4201 | acagcactat | ccctatggag | gtccttatga | cagagtgagg | acggagcctg | gaatagggcc |
| 4261 | tgagggaaac | atgagcactg | gggccccaca | gccgaatctc | atgccttcca | acccagactc |
| 4321 | ggggatgtat | tctcctagcc | gctacccccc | gcagcagcag | cagcagcagc | agcaacgaca |
| 4381 | tgattcctat | ggcaatcagt | tctccaccca | aggcacccct | tctggcagcc | ccttccccag |
| 4441 | ccagcagact | acaatgtatc | aacagcaaca | gcagaattac | aagcggccaa | tggatggcac |
| 4501 | atatggccct | cctgccaagc | ggcacgaagg | ggagatgtac | agcgtgccat | acagcactgg |
| 4561 | gcaggggcag | cctcagcagc | agcagttgcc | cccagcccag | ccccagcctg | ccagccagca |
| 4621 | acaagctgcc | cagccttccc | ctcagcaaga | tgtatacaac | cagtatggca | atgcctatcc |
| 4681 | tgccactgcc | acagctgcta | ctgagcgccg | accagcaggc | ggcccccaga | accaatttcc |
| 4741 | attccagttt | ggccgagacc | gtgtctctgc | acccccctggc | accaatgccc | agcaaaacat |
| 4801 | gccaccacaa | atgatgggcg | gccccataca | ggcatcagct | gaggttgctc | agcaaggcac |
| 4861 | catgtggcag | gggcgtaatg | acatgaccta | taattatgcc | aacaggcaga | gcacgggctc |
| 4921 | tgccccccag | ggccccgcct | atcatggcgt | gaaccgaaca | gatgaaatgc | tgcacacaga |
| 4981 | tcagagggcc | aaccacgaag | gctcgtggcc | ttcccatggc | acacgccagc | cccccatatgg |
| 5041 | tccctctgcc | cctgtgcccc | ccatgacaag | gccccctcca | tctaactacc | agccccccacc |
| 5101 | aagcatgcag | aatcacattc | ctcaggtatc | cagccctgct | cccctgcccc | ggccaatgga |
| 5161 | gaaccgcacc | tctcctagca | agtctccatt | cctgcactct | gggatgaaaa | tgcagaaggc |
| 5221 | aggtccccca | gtacctgcct | cgcacatagc | acctgcccct | gtgcagcccc | ccatgattcg |
| 5281 | gcgggatatc | accttcccac | ctggctctgt | tgaagccaca | cagcctgtgt | tgaagcagag |
| 5341 | gaggcggctc | acaatgaaag | acattggaac | cccggaggca | tggcgggtaa | tgatgtccct |
| 5401 | caagtctggt | ctcctggcag | agagcacatg | ggcattagat | accatcaaca | tcctgctgta |
| 5461 | tgatgacaac | agcatcatga | ccttcaacct | cagtcagctc | ccagggttgc | tagagctcct |
| 5521 | tgtagaatat | ttccgacgat | gcctgattga | gatctttggc | attttaaagg | agtatgaggt |
| 5581 | gggtgaccca | ggacagagaa | cgctactgga | tcctgggagg | ttcagcaagg | tgtctagtcc |
| 5641 | agctcccatg | gagggtgggg | aagaagaaga | agaacttcta | ggtcctaaac | tagaagagga |
| 5701 | agaagaagag | gaagtagttg | aaaatgatga | ggagatagcc | ttttcaggca | aggacaagcc |
| 5761 | agcttcagag | aatagtgagg | agaagctgat | cagtaagttt | gacaagcttc | cagtaaagat |
| 5821 | cgtacagaag | aatgatccat | ttgtggtgga | ctgctcagat | aagcttgggc | gtgtgcagga |
| 5881 | gtttgacagt | ggcctgctgc | actggcggat | tggtgggggg | gacaccactg | agcatatcca |
| 5941 | gacccacttc | gagagcaaga | cagagctgct | gccttcccgg | cctcacgcac | cctgcccacc |
| 6001 | agcccctcgg | aagcatgtga | caacagcaga | gggtacacca | gggacaacag | accaggaggg |
| 6061 | gcccccacct | gatggacctc | cagaaaaacg | gatcacagcc | actatggatg | acatgttgtc |
| 6121 | tactcggtct | agcaccttga | ccgaggatgg | agctaagagt | tcagaggcca | tcaaggagag |
| 6181 | cagcaagttt | ccatttggca | ttagcccagc | acagagccac | cggaacatca | agatcctaga |
| 6241 | ggacgaaccc | cacagtaagg | atgagacccc | actgtgtacc | cttctggact | ggcaggattc |
| 6301 | tcttgccaag | cgctgcgtct | gtgtgtccaa | taccattcga | agcctgtcat | ttgtgccagg |
| 6361 | caatgacttt | gagatgtcca | aacacccagg | gctgctgctc | atcctgggca | agctgatcct |
| 6421 | gctgcaccac | aagcacccag | aacggaagca | ggcaccacta | acttatgaaa | aggaggagga |
| 6481 | acaggaccaa | ggggtgagct | gcaacaaagt | ggagtggtgg | tgggactgct | tggagatgct |
| 6541 | ccgggaaaac | accttggtta | cactcgccaa | catctcgggg | cagttggacc | tatctccata |
| 6601 | ccccgagagc | atttgcctgc | ctgtcctgga | cggactccta | cactgggcag | tttgcccttc |
| 6661 | agctgaagcc | caggacccct | tttccaccct | gggccccaat | gccgtccttt | ccccgcagag |
| 6721 | actggtcttg | gaaaccctca | gcaaactcag | catccaggac | aacaatgtgg | acctgattct |
| 6781 | ggccacaccc | cccttcagcc | gcctggagaa | gttgtatagc | actatggtgc | gcttcctcag |
| 6841 | tgaccgaaag | aacccggtgt | gccgggagat | ggctgtggta | ctgctggcca | acctggctca |
| 6901 | gggggacagc | ctggcagctc | gtgccattgc | agtgcagaag | ggcagtatcg | gcaacctcct |
| 6961 | gggcttccta | gaggacagcc | ttgccgccac | acagttccag | cagagccagg | ccagcctcct |

TABLE 1-continued

```
7021 ccacatgcag aacccaccct ttgagccaac tagtgtggac atgatgcggc gggctgcccg
7081 cgcgctgctt gccttggcca aggtggacga gaaccactca gagtttactc tgtacgaatc
7141 acggctgttg gacatctcgg tatcaccgtt gatgaactca ttggtttcac aagtcatttg
7201 tgatgtactg tttttgattg gccagtcatg acagccgtgg gacacctccc ccccccgtgt
7261 gtgtgtgcgt gtgtggagaa cttagaaact gactgttgcc ctttatttat gcaaaaccac
7321 ctcagaatcc agtttaccct gtgctgtcca gcttctccct tgggaaaaag tctctcctgt
7381 ttctctctcc tccttccacc tcccctccct ccatcacctc acgcctttct gttccttgtc
7441 ctcaccttac tcccctcagg accctacccc accctctttg aaaagacaaa gctctgccta
7501 catagaagac ttttttttatt ttaaccaaag ttactgttgt ttacagtgag tttggggaaa
7561 aaaaataaaa taaaaatggc tttcccagtc cttgcatcaa cgggatgcca catttcataa
7621 ctgtttttaa tggtaaaaaa aaaaaaaaaa aatacaaaaa aaaattctga aggacaaaaa
7681 aggtgactgc tgaactgtgt gtggtttatt gttgtacatt cacaatcttg caggagccaa
7741 gaagttcgca gttgtgaaca gaccctgttc actggagagg cctgtgcagt agagtgtaga
7801 ccctttcatg tactgtactg tacacctgat actgtaaaca tactgtaata ataatgtctc
7861 acatggaaac agaaaacgct gggtcagcag caagctgtag tttttaaaaa tgtttttagt
7921 taaacgttga ggagaaaaaa aaaaaaggct tttcccccaa agtatcatgt gtgaacctac
7981 aacaccctga cctctttctc tcctccttga ttgtatgaat aaccctgaga tcacctctta
8041 gaactggttt taacctttag ctgcagcggc tacgctgcca cgtgtgtata tatatgacgt
8101 tgtacattgc acataccctt ggatccccac agtttggtcc tcctcccagc taccccttta
8161 tagtatgacg agttaacaag ttggtgacct gcacaaagcg agacacagct atttaatctc
8221 ttgccagata tcgcccctct tggtgcgatg ctgtacaggt ctctgtaaaa agtccttgct
8281 gtctcagcag ccaatcaact tatagtttat ttttttctgg gtttttgttt tgttttgttt
8341 tctttctaat cgaggtgtga aaaagttcta ggttcagttg aagttctgat gaagaaacac
8401 aattgagatt ttttcagtga taaaatctgc atatttgtat ttcaacaatg tagctaaaac
8461 ttgatgtaaa ttcctccttt ttttcctttt ttggcttaat gaatatcatt tattcagtat
8521 gaaatcttta tactatatgt tccacgtgtt aagaataaat gtacattaaa tcttggtaag
8581 acttt
```

SEQ ID NO: 26 Human ARID1A Amino Acid Sequence isoform A (NP_006006.3)

```
   1 maaqvapaaa sslgnppppp pselkkaeqq qreeaggeaa aaaaaergem kaaagqeseg
  61 pavgppqplg kelqdgaesn gggggggags gggpgaepdl knsngnagpr palnnnltep
 121 pgggggggssd gvgapphsaa aalpppaygf gqpygrspsa vaaaaaavfh qqhggqqspg
 181 laalqsgggg glepyagpqq nshdhgfpnh qynsyypnrs aypppapaya lssprggtpg
 241 sgaaaaagsk pppsssasas sssssfaqqr fgamggggps aagggtpqpt atptlnqllt
 301 spssargyqg ypggdysggp qdggagkgpa dmasqcwgaa aaaaaaaaas ggaqqrshha
 361 pmspgssggg gqplartpqp sspmdqmgkm rpqpyggtnp ysqqqgppsg pqqghgypgq
 421 pygsqtpqry pmtmggraqs amgglsytqq ippygqqgps gygqqgqtpy ynggsphpqg
 481 qqppysqqpp sqtphaqpsy qqqpqsqppq lqssqppysq qpsqpphqqs papypsqqst
 541 tqqhpqsqpp ysqpqaqspy qqqqpqqpap stlsqqaayp qpqsqqsqqt aysqqrfppp
 601 qelsqdsfgs qassapsmts skggqedmnl slqsrpsslp dlsgsiddlp mgtegalspg
 661 vstsgisssq gegsnpagsp fsphtsphlp girgpspspv gspasvaqsr sgplspaavp
 721 gnqmpprpps gqsdsimhps mngssiaqdr gymqrnpqmp qysspqpgsa lsprqpsggq
 781 ihtgmgsyqq nsmgsygpqg gqygpqggyp rqpnynalpn anypsagmag ginpmgaggq
 841 mhgqpgippy gtlppgrmsh asmgnrpygp nmanmppqvg sgmcpppggm nrktqetava
 901 mhvaansiqn rppgypnmnq ggmmgtgppy gqginsmagm inpqgppysm ggtmannsag
 961 maaspemmgl gdvkltpatk mnnkadgtpk teskskksss stttnekitk lyelggeper
1021 kmwvdrylaf teekamgmtn lpavgrkpld lyrlyvsvke iggltqvnkn kkwrelatnl
1081 nvgtsssaas slkkgyiqcl yafeckierg edpppdifaa adskksqpki qppspagsgs
1141 mqgpqtpqst sssmaeggdl kpptpastph sqipplpgms rsnsvgigda fndgsdstfq
1201 krnsmtpnpg yqpsmntsdm mgrmsyepnk dpygsmrkap gsdpfmssgq gpnggmgdpy
1261 sraagpglgn vamgprqhyp yggpydrvrt epgigpegnm stgapqpnlm psnpdsgmys
1321 psryppqqqq qqqqrhdsyg nqfstqgtps gspfpsqqtt myqqqqqnyk rpmdgtygpp
1381 akrhegemys vpystgqgqp qqqqlppaqp qpasqqqaaq pspqqdvynq ygnaypatat
1441 aaterrpagg pqnqfpfqfg rdrvsappgt naqqnmppqm mggpiqasae vaqqgtmwqg
1501 rndmtynyan rqstgsapqg payhgvnrtd emlhtdqran hegswpshgt rqppygpsap
1561 vppmtrppps nyqpppsmqn hipqvsspap lprpmenrts pskspflhsg mkmqkagppv
1621 pashiapapv qppmirrdit fppgsveatq pvlkgrrrlt mkdigtpeaw rvmmslksgl
1681 laestwaldt inillyddns imtfnlsqlp gllellveyf rrclieifgi lkeyevgdpg
1741 qrtlldpgrf skvsspapme ggeeeeellg pkleeeeeee vvendeeiaf sgkdkpasen
1801 seekliskfd klpvkivqkn dpfvvdcsdk lgrvqefdsg llhwrigggd ttehigthfe
1861 sktellpsrp hapcppaprk hvttaegtpg ttdgegpppd gppekritat mddmlstrss
1921 tltedgakss eaikesskfp fgispaqshr nikiledeph skdetplctl ldwqdslakr
1981 cvcvsntirs lsfvpgndfe mskhpgllli lgklillhhk hperkqaplt yekeeeqdqg
2041 vscnkvewww dclemlrent lvtlanisgq ldlspypesi clpvldgllh wavcpsaeaq
2101 dpfstlgpna vlspqrlvle tlsklsiqdn nvdlilatpp fsrleklyst mvrflsdrkn
2161 pvcremavvl lanlaggdsl aaraiavqkg signllgfle dslaatqfqq sgasllhmqn
2221 ppfeptsvdm mrraaralla lakvdenhse ftlyesrlld isysplmnsl vsqvicdvlf
2281 ligqs
```

SEQ ID NO: 27 Human ARID1A cDNA Sequence Variant 2 (NM_139135.2, CDS: from 374 to 6580)

```
   1 cagaaagcgg agagtcacag cggggccagg ccctggggag cggagcctcc accgcccccc
  61 tcattcccag gcaagggctt ggggggaatg agccgggaga gccgggtccc gagcctacag
 121 agccgggagc agctgagccg ccggcgcctc ggccgccgcc gccgcctcct cctcctccgc
 181 cgccgccagc ccggagcctg agccggcggg gcggggggga gaggagcgag cgcagcgcag
 241 cagcggagcc ccgcgaggcc cgcccgggcg ggtggggagg gcagcccggg ggactgggcc
 301 ccggggcggg gtgggagggg gggagaagac gaagacaggg ccgggtctct ccgcggacga
 361 gacagcgggg atcatggccg cgcaggtcgc cccgccgcc gccagcagcc tgggcaaccc
 481 gggcgaggcg gcggcggcgg cagcggccga gcgcggggaa atgaaggcag ccgccgggca
 541 ggaaagcgag ggccccgccg tggggccgcc gcagccgctg ggaaaggagc tgcaggacgg
```

TABLE 1-continued

| | | | | | | |
|---|---|---|---|---|---|---|
| 601 | ggccgagagc | aatgggggtg | gcggcggcgg | cggagccggc | agcggcggcg | ggcccggcgc |
| 661 | ggagccggac | ctgaagaact | cgaacgggaa | cgcgggccct | aggcccgccc | tgaacaataa |
| 721 | cctcacggag | ccgcccggcg | gcggcggtgg | cggcagcagc | gatggggtgg | gggcgcctcc |
| 781 | tcactcagcc | gcggccgcct | tgccgccccc | agcctacggc | ttcgggcaac | cctacggccg |
| 841 | gagcccgtct | gccgtcgccg | ccgccgcggc | cgccgtcttc | caccaacaac | atggcggaca |
| 901 | acaaagccct | ggcctggcag | cgctgcagag | cggcggcggc | gggggcctgg | agccctacgc |
| 961 | ggggccccag | cagaactctc | acgaccacgg | cttccccaac | caccagtaca | actcctacta |
| 1021 | ccccaaccgc | agcgcctacc | ccccgcccgc | cccggcctac | gcgctgagct | ccccgagagg |
| 1081 | tggcactccg | ggctccggcg | cggcggcggc | tgccggctcc | aagccgcctc | cctcctccag |
| 1141 | cgcctccgcc | tcctcgtcgt | cttcgtcctt | cgctcagcag | cgcttcgggg | ccatgggggg |
| 1201 | aggcggcccc | tccgcggccg | gcgggggaac | tccccagccc | accgccaccc | ccaccctcaa |
| 1261 | ccaactgctc | acgtcgccca | gctcggcccg | gggctaccag | ggctaccccg | gggcgacta |
| 1321 | cagtggcggg | ccccaggacg | gggcgccgg | caagggcccg | gcggacatgg | cctcgcagtg |
| 1381 | ttggggggct | gcggcggcgg | cagctgcggc | ggcggccgcc | tcgggagggg | cccaacaaag |
| 1441 | gagccaccac | gcgcccatga | gccccgggag | cagcggcggc | ggggggcagc | cgctcgcccg |
| 1501 | gacccctcag | ccatccagtc | caatggatca | gatgggcaag | atgagacctc | agccatatgg |
| 1561 | cgggactaac | ccatactcgc | agcaacaggg | acctccgtca | ggaccgcagc | aaggacatgg |
| 1621 | gtacccaggg | cagccatacg | ggtcccagac | cccgcagcgg | tacccgatga | ccatgcaggg |
| 1681 | ccgggcgcag | agtgccatgg | gcggcctctc | ttatacacag | cagattcctc | cttatggaca |
| 1741 | acaaggcccc | agcgggtatg | gtcaacaggg | ccagactcca | tattacaacc | agcaaagtcc |
| 1801 | tcaccctcag | cagcagcagc | caccctactc | ccagcaacca | ccgtcccaga | cccctcatgc |
| 1861 | ccaaccttcg | tatcagcagc | agccacagtc | tcaaccacca | cagctccagt | cctctcagcc |
| 1921 | tccatactcc | cagcagccat | cccagcctcc | acatcagcag | tccccggctc | catacccctc |
| 1981 | ccagcagtcg | acgacacagc | agcaccccca | gagccagccc | ccctactcac | agccacaggc |
| 2041 | tcagtctcct | taccagcagc | agcaacctca | gcagccagca | ccctcgacgc | tctcccagca |
| 2101 | ggctgcgtat | cctcagcccc | agtctcagca | gtcccagcaa | actgcctatt | cccagcagcg |
| 2161 | cttccctcca | ccgcaggagc | tatctcaaga | ttcatttggg | tctcaggcat | cctcagcccc |
| 2221 | ctcaatgacc | tccagtaagg | gagggcaaga | agatatgaac | ctgagccttc | agtcaagacc |
| 2281 | ctccagcttg | cctgatctat | ctggttcaat | agatgacctc | cccatgggga | cagaaggagc |
| 2341 | tctgagtcct | ggagtgagca | catcagggat | ttccagcagc | caaggagagc | agagtaatcc |
| 2401 | agctcagtct | cctttctctc | ctcatacctc | ccctcacctg | cctggcatcc | gaggcccttc |
| 2461 | cccgtcccct | gttggctctc | ccgccagtgt | tgctcagtct | cgctcaggac | cactctcgcc |
| 2521 | tgctgcagtg | ccaggcaacc | agatgccacc | tcggccaccc | agtggccagt | cggacagcat |
| 2581 | catgcatcct | tccatgaacc | aatcaagcat | tgcccaagat | cgaggttata | tgcagaggaa |
| 2641 | cccccagatg | ccccagtaca | gttcccccca | gcccggctca | gccttatctc | cgcgtcagcc |
| 2701 | ttccggagga | cagatacaca | caggcatggg | ctcctaccag | cagaactcca | tggggagcta |
| 2761 | tggtccccag | gggggtcagt | atggcccaca | aggtggctac | cccaggcagc | caaactataa |
| 2821 | tgccttgccc | aatgccaact | accccagtgc | aggcatggct | ggaggcataa | accccatggg |
| 2881 | tgccggaggt | caaatgcatg | gacagcctgg | catcccacct | tatggcacac | tccctccagg |
| 2941 | gaggatgagt | cacgcctcca | tgggcaaccg | gccttatggc | cctaacatgg | ccaatatgcc |
| 3001 | acctcaggtt | gggtcaggga | tgtgtccccc | accagggggc | atgaaccgga | aaacccaaga |
| 3061 | aactgctgtc | gccatgcatg | ttgctgccaa | ctctatccaa | aacaggccgc | caggctaccc |
| 3121 | caatatgaat | caaggggggca | tgatgggaac | tggacctcct | tatggacaag | ggattaatag |
| 3181 | tatggctggc | atgatcaacc | ctcagggacc | cccatattcc | atgggtggaa | ccatggccaa |
| 3241 | caattctgca | gggatggcag | ccagcccaga | gatgatgggc | cttggggatg | taaagttaac |
| 3301 | tccagccacc | aaaatgaaca | acaaggcaga | tgggacaccc | aagacagaat | ccaaatccaa |
| 3361 | gaaatccagt | tcttctacta | caaccaatga | gaagatcacc | aagttgtatg | agctgggtgg |
| 3421 | tgagcctgag | aggaagatgt | gggtggaccg | ttatctggcc | ttcactgagg | agaaggccat |
| 3481 | gggcatgaca | aatctgcctg | ctgtgggtag | gaaacctctg | gacctctatc | gcctctatgt |
| 3541 | gtctgtgaag | gagattggtg | gattgactca | ggtcaacaag | aacaaaaaat | ggcgggaact |
| 3601 | tgcaaccaac | ctcaatgtgg | gcacatcaag | cagtgctgcc | agctccttga | aaaagcagta |
| 3661 | tatccagtgt | ctctatgcct | ttgaatgcaa | gattgaacgg | ggagaagacc | ctcccccaga |
| 3721 | catctttgca | gctgctgatt | ccaagaagtc | ccagcccaag | atccagcctc | cctctcctgc |
| 3781 | gggatcagga | tctatgcagg | ggccccagac | tccccagtca | accagcagtt | ccatggcaga |
| 3841 | aggaggagac | ttaaagccac | caactccagc | atccacacca | cacagtcaga | tcccccccatt |
| 3901 | gccaggcatg | agcaggagca | attcagttgg | gatccaggat | gcctttaatg | atggaagtga |
| 3961 | ctccacattc | cagaagcgga | attccatgac | tccaaaccct | gggtatcagc | ccagtatgaa |
| 4021 | tacctctgac | atgatggggc | gcatgtccta | tgagccaaat | aaggatcctt | atggcagcat |
| 4081 | gaggaaagct | ccagggagtg | atcccttcat | gtcctcaggg | cagggcccca | acggcgggat |
| 4141 | gggtgacccc | tacagtcgtg | ctgccggccc | tgggctagga | aatgtggcga | tgggaccacg |
| 4201 | acagcactat | ccctatggag | gtccttatga | cagagtgagg | acggagcctg | gaatagggcc |
| 4261 | tgagggaaac | atgagcactg | gggccccaca | gccgaatctc | atgccttcca | acccagactc |
| 4321 | ggggatgtat | tctcctagcc | gctacccccc | gcagcagcag | cagcagcagc | agcaacgaca |
| 4381 | tgattcctat | ggcaatcagt | tctccaccca | aggcacccct | tctggcagcc | ccttccccag |
| 4441 | ccagcagact | acaatgtatc | aacagcaaca | gcaggtatcc | agccctgctc | ccctgccccg |
| 4501 | gccaatggag | aaccgcacct | ctcctagcaa | gtctccattc | ctgcactctg | ggatgaaaat |
| 4561 | gcagaaggca | ggtcccccag | tacctgcctc | gcacatagca | cctgcccctg | tgcagccccc |
| 4621 | catgattcgg | cgggatatca | ccttcccacc | tggctctgtt | gaagccacac | agcctgtgtt |
| 4681 | gaagcagagg | aggcggctca | caatgaaaga | cattggaacc | ccggaggcat | ggcgggtaat |
| 4741 | gatgtccctc | aagtctggtc | tcctggcaga | gagcacatgg | gcattagata | ccatcaacat |
| 4801 | cctgctgtat | gatgacaaca | gcatcatgac | cttcaacctc | agtcagctcc | cagggttgct |
| 4861 | agagctcctt | gtagaatatt | tccgacgatg | cctgattgag | atctttggca | ttttaaagga |
| 4921 | gtatgaggtg | ggtgacccag | gacagagaac | gctactggat | cctgggaggt | tcagcaaggt |
| 4981 | gtctagtcca | gctcccatgg | agggtgggga | agaagaagaa | gaacttctag | gtcctaaact |
| 5041 | agaagaggaa | gaagaagagg | aagtagttga | aaatgatgag | gagatagcct | tttcaggcaa |
| 5101 | ggacaagcca | gcttcagaga | atagtgagga | gaagctgatc | agtaagtttg | acaagcttcc |
| 5161 | agtaaagatc | gtacagaaga | atgatccatt | tgtggtggac | tgctcagata | agcttgggcg |
| 5221 | tgtgcaggag | tttgacagtg | gcctgctgca | ctggcggatt | ggtggggggg | acaccactga |
| 5281 | gcatatccag | acccacttcg | agagcaagac | agagctgctg | ccttcccggc | ctcacgcacc |
| 5341 | ctgcccacca | gcccctcgga | agcatgtgac | aacagcagag | ggtacaccag | ggacaacaga |

TABLE 1-continued

```
5401 ccaggagggg cccccacctg atggacctcc agaaaaacgg atcacagcca ctatggatga
5461 catgttgtct actcggtcta gcaccttgac cgaggatgga gctaagagtt cagaggccat
5521 caaggagagc agcaagtttc catttggcat tagcccagca cagagccacc ggaacatcaa
5581 gatcctagag gacgaacccc acagtaagga tgagacccca ctgtgtaccc ttctggactg
5641 gcaggattct cttgccaagc gctgcgtctg tgtgtccaat accattcgaa gcctgtcatt
5701 tgtgccaggc aatgactttg agatgtccaa acacccaggg ctgctgctca tcctgggcaa
5761 gctgatcctg ctgcaccaca agcacccaga acggaagcag gcaccactaa cttatgaaaa
5821 ggaggaggaa caggaccaag gggtgagctg caacaaagtg gagtggtggt gggactgctt
5881 ggagatgctc cgggaaaaca ccttggttac actcgccaac atctcggggc agttggacct
5941 atctccatac cccgagagca tttgcctgcc tgtcctggac ggactcctac actgggcagt
6001 ttgcccttca gctgaagccc aggacccctt ttccaccctg ggccccaatg ccgtcctttc
6061 cccgcagaga ctggtcttgg aaaccctcag caaactcagc atccaggaca acaatgtgga
6121 cctgattctg gccacacccc ccttcagccg cctggagaag ttgtatagca ctatggtgcg
6181 cttcctcagt gaccgaaaga acccggtgtg ccgggagatg gctgtggtac tgctggccaa
6241 cctggctcag ggggacagcc tggcagctcg tgccattgca gtgcagaagg gcagtatcgg
6301 caacctcctg ggcttcctag aggacagcct tgccgccaca cagttccagc agagccaggc
6361 cagcctcctc cacatgcaga acccaccctt tgagccaact agtgtggaca tgatgcggcg
6421 ggctgcccgc gcgctgcttg ccttggccaa ggtggacgag aaccactcag agtttactct
6481 gtacgaatca cggctgttgg acatctcggt atcaccgttg atgaactcat tggtttcaca
6541 agtcatttgt gatgtactgt ttttgattgg ccagtcatga cagccgtggg acacctcccc
6601 cccccgtgtg tgtgtgcgtg tgtggagaac ttagaaactg actgttgccc tttatttatg
6661 caaaaccacc tcagaatcca gtttaccctg tgctgtccag cttctccctt gggaaaaagt
6721 ctctcctgtt tctctctcct ccttccacct cccctccctc catcacctca cgcctttctg
6781 ttccttgtcc tcaccttact cccctcagga ccctacccca ccctctttga aaagacaaag
6841 ctctgcctac atagaagact tttttattt taaccaaagt tactgttgtt tacagtgagt
6901 ttggggaaaa aaaataaaat aaaaatggct ttcccagtcc ttgcatcaac gggatgccac
6961 atttcataac tgtttttaat ggtaaaaaaa aaaaaaaaaa atacaaaaaa aaattctgaa
7021 ggacaaaaaa ggtgactgct gaactgtgtg tggtttattg ttgtacattc acaatcttgc
7081 aggagccaag aagttcgcag ttgtgaacag accctgttca ctggagaggc ctgtgcagta
7141 gagtgtagac cctttcatgt actgtactgt acacctgata ctgtaaacat actgtaataa
7201 taatgtctca catggaaaca gaaaacgctg ggtcagcagc aagctgtagt ttttaaaaat
7261 gtttttagtt aaacgttgag gagaaaaaaa aaaaaggctt ttcccccaaa gtatcatgtg
7321 tgaacctaca acaccctgac ctctttctct cctccttgat tgtatgaata accctgagat
7381 cacctcttag aactggtttt aacctttagc tgcagcggct acgctgccac gtgtgtatat
7441 atatgacgtt gtacattgca catacccttg gatccccaca gtttggtcct cctcccagct
7501 accccttttat agtatgacga gttaacaagt tggtgacctg cacaaagcga gacacagcta
7561 tttaatctct tgccagatat cgcccctctt ggtgcgatgc tgtacaggtc tctgtaaaaa
7621 gtccttgctg tctcagcagc caatcaactt atagtttatt tttttctggg tttttgtttt
7681 gtttgtttt ctttctaatc gaggtgtgaa aaagttctag gttcagttga agttctgatg
7741 aagaaacaca attgagattt tttcagtgat aaaatctgca tatttgtatt tcaacaatgt
7801 agctaaaact tgatgtaaat tcctcctttt tttccttttt tggcttaatg aatatcattt
7861 attcagtatg aaatctttat actatatgtt ccacgtgtta agaataaatg tacattaaat
7921 cttggtaaga cttt
```

SEQ ID NO: 28 Human ARID1A Amino Acid Sequence isoforrn B (NP_624361.1)

```
   1 maaqvapaaa sslgnppppp pselkkaeqq qreeaggeaa aaaaaergem kaaagqeseg
  61 pavgppqplg kelqdgaesn ggggggggags gggpgaepdl knsngnagpr palnnnltep
 121 pgggggggssd gvgapphsaa aalpppayyf gqpygrspsa vaaaaaaavfh qqhggqqspg
 181 laalqsgggg glepyagpqq nshdhgfpnh qynsyypnrs aypppapaya lssprggtpg
 241 sgaaaaagsk pppsssasas sssssfaqqr fgamggggps aagggtpqpt atptlnqllt
 301 spssargyqg ypggdysggp qdggagkgpa dmasqcwgaa aaaaaaaaas ggaqqrshha
 361 pmspgssggg gqplartpqp sspmdqmgkm rpqpyggtnp ysqqqgppsg pqqghgypgq
 421 pygsqtpqry pmtmggraqs amgglsytqq ippygqqgps gygqqgqtpy ynqqsphpqq
 481 qqppysqqpp sqtphaqpsy qqqpqsqppq lqssqppysq qpsqpphqqs papypsqqst
 541 tqqhpqsqpp ysqpqaqspy qqqqpqqpap stlsqqaayp qpqsqqsqqt aysqqrfppp
 601 qelscidsfg qassapsmts skggqedmnl slqsrpsslp dlsgsiddlp mgtegalspg
 661 vstsgisssq gegsnpagsp fsphtsphlp girgpspspv gspasvaqsr sgplspaavp
 721 gnqmpprpps gqsdsimhps mngssiaqdr gymqrnpqmp qysspqpgsa lsprqpsggq
 781 ihtgmgsyqq nsmgsygpqg gqygpqggyp rqpnynalpn anypsagmag ginpmgaggq
 841 mhgqpgippy gtlppgrmsh asmgnrpygp nmanmppqvg sgmcpppggm nrktqetava
 901 mhvaansiqn rppgypnmnq ggmmgtgppy gqginsmagm inpqgppysm ggtmannsag
 961 maaspemmgl gdvkltpatk mnnkadgtpk teskskksss stttnekitk lyelggeper
1021 kmwvdrylaf teekamgmtn lpavgrkpld lyrlyvsvke iggltqvnkn kkwrelatnl
1081 nvgtsssaas slkkgyiqcl yafeckierg edpppdifaa adskksqpki qppspagsgs
1141 mqgpqtpqst sssmaeggdl kpptpastph sqipplpgms rsnsvgigda fndgsdstfq
1201 krnsmtpnpg yqpsmntsdm mgrmsyepnk dpygsmrkap gsdpfmssgq gpnggmgdpy
1261 sraagpglgn vamgprqhyp yggpydrvrt epgigpegnm stgapqpnlm psnpdsgmys
1321 psryppqqqq qqqqrhdsyg nqfstqgtps gspfpsqqtt myqqqqqvss paplprpmen
1381 rtspskspfl hsgmkmqkag ppvpashiap apvqppmirr ditfppgsve atqpvlkgrr
1441 rltmkdigtp eawrvmmslk sgllaestwa ldtinillyd dnsimtfnls qlpgllellv
1501 eyfrrcliei fgilkeyevg dpgqrtlldp grfskvsspa pmeggeeeee llgpkleeee
1561 eeevvendee iafsgkdkpa senseeklis kfdklpvkiv qkndpfvvdc sdklgrvqef
1621 dsgllhwrig ggdttehiqt hfesktellp srphapcppa prkhvttaeg tpgttdgegp
1681 ppdgppekri tatmddmlst rsstltedga ksseaikess kfpfgispaq shrnikiled
1741 ephskdetpl ctlldwgdsl akrcvcvsnt irslsfvpgn dfemskhpgl llilgklill
1801 hhkhperkqa pltyekeeeq dqgvscnkve wwwdclemlr entivtlani sgqldlspyp
1861 esiclpvldg llhwavcpsa eaqdpfstlg pnavlspqrl vletlsklsi qdnnvdlila
1921 tppfsrlekl ystmvrflsd rknpvcrema vvllanlaqg dslaaraiav qkgsignllg
1981 fledslaatq fqqsgasllh mqnppfepts vdmmrraara llalakvden hseftlyesr
2041 lldisysplm nslvsqvicd vlfligqs
```

TABLE 1-continued

SEQ ID NO: 29 Mouse ARID1A cDNA Sequence (NM_001080819.1, CDS: from 1 to 6852)

```
   1 atggccgcgc aggtcgcccc cgccgccgcc agcagcctgg gcaacccgcc gccgccgccc
  61 tcggagctga agaaagccga gcagcaacag cgggaggagg cggggggcga ggcggcggcg
 121 gcagcggccg agcgcgggga aatgaaggca gccgccgggc aggagagcga gggccccgcc
 181 gtggggccgc cgcagccgct gggaaaggag ctgcaggacg gggccgagag caatgggggt
 241 ggcggcggcg gcggagccgg cagcggcggc gggcccggcg cggagccgga cctgaagaac
 301 tcgaacggga acgcgggccc taggcccgcc ctgaacaata acctcccgga gccgcccggc
 361 ggcggcggcg gcggcggcag cagcagcagc gacggggtgg gggcgcctcc tcactcggcc
 421 gcggccgccc tgccgccccc agcctacggc ttcgggcaag cctacggccg gagcccgtct
 481 gccgtcgccg ccgcggcggc cgccgtcttc caccaacaac atggcggaca acaaagccct
 541 ggcctggcag cgctgcagag cggcggcggc gggggcttgg agccctacgc cgggccccag
 601 cagaactcgc acgaccacgg cttccccaac caccagtaca actcctacta ccccaaccgc
 661 agcgcctacc ccccgcctcc ccaggcctac gcgctgagct ccccgagagg tggcactccg
 721 ggctccggcg cggcggcggc cgccggctcc aagccgcctc cctcctccag cgcctctgcc
 781 tcctcgtcgt cttcgtcctt cgcacagcag cgcttcgggg ccatgggggg aggcggcccc
 841 tcagcggccg gcgggggaac tccccagccc accgccaccc ccaccctcaa ccaactgctc
 901 acgtcgccca gctcggcccg tggctaccag ggctaccccg ggggcgacta cggcggcggg
 961 ccccaggacg ggggcgcggg caaaggcccg gcggacatgg cctcgcagtg ctgggggggct
1021 gcggcggcgg cggcggcggc ggcagcggcc gtctcgggag gggcccaaca aaggagccac
1081 cacgcgccca tgagccccgg gagcagcggc ggcggggggc agccgctcgc ccggacccct
1141 cagtcatcca gtccaatgga tcagatggga aagatgagac ctcagccgta tggtgggact
1201 aacccatact cgcaacaaca gggacctcct tcaggaccgc aacaaggaca tgggtaccca
1261 gggcagccat atgggtccca gactccacag cggtacccca tgaccatgca gggccgggct
1321 cagagtgcca tgggcagcct ctcttatgca cagcagattc caccttatgg ccagcaaggc
1381 cccagtgcgt atggccagca gggccagact ccatactata accagcaaag tcctcatccc
1441 cagcagcagc caccttacgc ccagcaacca ccatcccaga cccctcatgc ccagccttcg
1501 tatcagcagc agccgcagac tcagcaacca cagcttcagt cctctcagcc tccatattcc
1561 cagcagccat cccagcctcc acatcagcag tccccaactc catatccctc ccagcagtcc
1621 accacacaac agcatcccca gagccagccc ccctactcac aaccacaggc acagtctccc
1681 taccagcagc agcaacctca gcagccagca tcctcgtcgc tctcccagca ggctgcatat
1741 cctcagcccc agcctcagca gtcccagcaa actgcctatt cccagcagcg cttccctcca
1801 ccacaggagc tttctcaaga ttcatttggg tctcaggcat cctcagcccc ctcaatgacc
1861 tccagtaagg gagggcaaga agatatgaac ctgagtcttc agtcaaggcc ctccagcttg
1921 cctgatctgt ctggttcaat cgatgatctc cccatgggga cagaaggagc tctgagtcct
1981 ggcgtgagca catcagggat ttccagcagc caaggagagc agagcaatcc agctcagtct
2041 ccctttctc ctcacacctc ccctcacctg cctggcatcc gaggcccgtc cccgtcccct
2101 gttggctctc ctgccagtgt cgcgcagtct cgctcaggac cactctcgcc tgctgcagtg
2161 ccaggcaacc agatgccacc tcggccaccc agtggccagt cagacagcat catgcaccct
2221 tccatgaacc aatcaagcat tgcccaagat cgaggttata tgcagaggaa cccccagatg
2281 ccccagtaca cttcccctca gcctggctcg gccttatccc cacgtcagcc gtctggagga
2341 cagatgcact cgggcgtggg ctcctaccag cagaactcca tggggagcta cggcccccag
2401 ggcagtcagt atggcccaca aggaggctat cctaggcagc ctaactataa tgccttgccc
2461 aacgccaact accccaatgc aggcatggcc ggaagtatga accctatggg tgctggaggt
2521 cagatgcatg ggcagcctgg aatcccacct tacggcacac tccctccagg gagaatggct
2581 catgcgtcta tgggcaacag gccctatggc cctaatatgg ccaatatgcc acctcaggtt
2641 gggtcaggga tgtgtcctcc accaggggga atgaacagga aaactcaaga gtctgctgtt
2701 gccatgcatg ttgctgccaa ctctatccaa aacaggccac caggctaccc aaatatgaat
2761 caagggggca tgatgggaac tggacctccc tatggacagg ggatcaatag tatggctggc
2821 atgatcaacc ctcagggacc cccatatcct atgggtggaa ccatggccaa caattcagca
2881 gggatggcag ccagcccaga gatgatgggc cttggggatg ttaagttaac tcccgccaca
2941 aaaatgaaca acaaggcaga tggaacaccc aagacagaat ccaaatctaa gaaatccagt
3001 tcttctacca ccaccaatga gaagatcacc aaattgtatg agttgggtgg tgagcccgag
3061 aggaagatgt gggtggaccg gtacctggcc ttcacagagg agaaggccat gggcatgaca
3121 aatctgcctg ctgtggggag gaagcctctg gacctctatc gcctctatgt gtctgtgaag
3181 gagattggtg ggttgactca ggtcaacaag aacaaaaaat ggcgggaact tgcaaccaac
3241 ctcaatgtgg gtacatcaag cagtgctgcc agctcactga aaaagcagta tatccaatgt
3301 ctctatgcct ttgagtgcaa gatcgagcgt ggagaagacc ctcccccga tatcttcgca
3361 gctgctgact ccaagaagtc ccaacccaag atccagcccc cctctcctgc gggatcaggg
3421 tctatgcagg ggccacaaac tcctcagtca accagcagtt ctatggcaga aggaggagac
3481 ctgaagccac caactccagc atccacacca catagtcaaa ttccccctt accaggcatg
3541 agcaggagca actcagtcgg aatccaggat gcctttcctg atggaagtga ccccacattc
3601 cagaagcgga attccatgac tccaaaccct gggtaccagc ccagtatgaa tacctctgac
3661 atgatggggc gcatgtccta tgagccaaat aaggatcctt atggcagcat gaggaaagcg
3721 ccaggaagtg atcccttcat gtcctcaggg cagggcccca atggcgggat gggtgatccc
3781 tacagccgtg ctgctggccc tgggctggga agtgtggcga tgggaccacg gcagcactat
3841 ccctatggag gtccttacga cagagtgagg acggagcctg gaatcgggcc tgaaggaaat
3901 atgggcactg gagcccctca gccaaatctc atgccttcca ccccagattc ggggatgtat
3961 tctcctagcc gctacccccc gcagcagcag cagcaacagc agcaacaaca tgattcctat
4021 ggcaatcaat tctctaccca aggcacccct tccagcagcc ccttccccag ccagcagacc
4081 acaatgtatc agcagcagca gcagaattat aagaggccaa tggatggcac atatggcccc
4141 cctgccaagc ggcatgaagg ggagatgtac agtgtgccgt acagcgctgg gcaaggccag
4201 cctcaacagc agcagttgcc tgcagctcag tcccagcctg ccagccagcc acaagctgcc
4261 cagccttccc ctcagcagga cgtgtacaac cagtacagca atgcctaccc tgcctccgcc
4321 accgctgcta ctgatcgccg accagcaggc ggcccccaga accaatttcc attccagttt
4381 ggccgagacc gagtctctgc acctcctggt tccagtgccc agcagaacat gccaccacaa
4441 atgatgggtg gccccataca ggcatcagct gaggttgctc agcagggcac catgtggcag
4501 gggcgaaatg acatgaccta caattatgcc aacaggcaga acacaggctc tgccacccag
4561 ggccctgcgt atcatggtgt gaaccgaaca gatgaaatgc tccacacaga tcagagggcc
```

TABLE 1-continued 4621 aaccatgaag gcccatggcc ttcccatggc acacgccagc ctccgtatgg tccttcagcc
4681 cctgttcccc ccatgacaag gccccctcca tctaactacc agcccccacc aagcatgccg
4741 aatcacattc ctcaggtatc cagccccgct cccctccccc ggcccatgga gaaccgtact
4801 tctcctagca agtctccatt cctgcactct gggatgaaaa tgcaaaaggc gggtccaccg
4861 gtgcctgctt cgcacatagc gcctacccct gtgcagccgc ctatgattcg gcgggatatc
4921 accttcccac ctggctctgt agaggccact cagcctgtgt tgaagcagag aaggcggctc
4981 acaatgaaag acattggaac cccggaggca tggcgggtaa tgatgtccct caagtccggg
5041 ctcctggcag agagcacgtg ggcgttagac accattaaca ttctactgta tgatgacaac
5101 agcattatga ccttcaacct cagccagctc ccaggcttgc tagagctcct tgtggaatat
5161 ttccgtagat gcctaattga aatctttggc attttaaagg agtatgaggt aggggaccca
5221 ggacagagaa cattactaga ccctgggaga ttcaccaagg tgtatagtcc agcccataca
5281 gaggaagaag aggaagaaca ccttgatcct aaactggagg aggaagagga agaaggggtt
5341 ggaaatgatg aggagatggc ctttttgggc aaggacaagc catcttcaga gaataatgag
5401 gagaagctag tcagtaagtt tgacaagctt ccggtaaaga tcgtgcagag gaatgaccca
5461 tttgtggtgg actgctcaga taagcttggg cgcgtgcagg agtttgacag tggcctgcta
5521 cactggcgga ttggtggtgg ggataccact gagcatatcc agacccactt tgagagcaag
5581 atagagctgc tgccttcccg gccttatgtg ccctgcccaa cgccccctcg gaaacacctc
5641 acaacagtag agggcacacc agggacaacg gagcaggagg gcccccgcc cgatggcctt
5701 ccagagaaaa ggatcacagc caccatggat gacatgttgt ctacccggtc tagcacattg
5761 actgatgagg gggcaaagag tgcagaggcc accaaggaaa gcagcaagtt tccatttggc
5821 attagcccag cacagagcca ccggaacatc aaaattttag aggatgaacc ccatagtaag
5881 gatgagaccc cactgtgtac ccttctggac tggcaggatt cccttgctaa gcgctgtgtc
5941 tgtgtctcca ataccatccg gagcctgtcg tttgtgccag gcaacgactt tgagatgtcc
6001 aaacacccag ggctgctgct tatcctgggc aagctgatcc tgctgcacca caagcaccca
6061 gagcggaagc aggcaccact aacttatgag aaggaggagg aacaggacca aggggtgagc
6121 tgtgacaaag tggagtggtg gtgggactgc ttggagatgc tccgagaaaa cacgctggtc
6181 accctcgcca acatctcggg gcaattggac ctatccccat atcctgagag catctgcctg
6241 cctgtcctgg acggactcct acactgggca gtttgccctt cagctgaagc ccaggacccc
6301 ttctcaaccc taggccccaa tgccgtcctc tccccccaga gattggtctt ggaaaccctc
6361 agcaaactca gcatccagga caacaatgtg gacctgatcc tggccactcc cccttttagc
6421 cgcctggaga agttgtatag taccatggtg cgcttcctca gtgaccgaaa gaacccagtg
6481 tgccgggaga tggccgtggt actgctggca aatctggccc agggggacag cctggcagcc
6541 cgggccattg cagtgcagaa gggcagcatc ggcaacctcc tgggtttcct ggaggacagc
6601 cttgctgcca cacagttcca gcagagccag gcaagcctcc tgcatatgca gaatccaccc
6661 tttgaaccaa ctagtgtgga catgatgcgg cgggctgccc gagcactgct tgccctggcc
6721 aaggtggatg agaaccactc agagttcact ctgtatgagt cacggctgtt ggacatctcc
6781 gtgtcaccac tgatgaactc attggtttca caagtcattt gtgatgtact gtttttgatt
6841 ggccagtcat gacagccgtg ggacacctcc cctccccgtg tgtgtgtgag tgtgtggaga
6901 acttagaaac tgactgttgc cctttattta tgcaaaacca cctcagaatc cagtttaccc
6961 tgtgctgtcc agcttctccc ttgggaaagc ctctcctgtt ctctctcctc cccaccctca
7021 ctccctcaca cctttctgtt ccccatcctc acctgcttcc ctcaggaccc caccctattt
7081 gaaaagacaa agctctgcct acatagaaga ctttttttatt ttaaccaaag ttactgttgt
7141 ttacagtgag tttggggaaa aaaatggctt tcccagtcct tgcatcaacg ggatgccaca
7201 tttcataact gtttttaatg gttaaaaaaa aaaaaaaaaa aaggaaaaaa aatacaaaaa
7261 aaccctgaag gacaaaggtg actgctgagc tgtgtggttt gtcgctgtcc attcacaatc
7321 tcgcaggagc cgagaagttc gcagttgtga gcagaccctg ttcactggag aggcctgtgc
7381 agtagagtgt agatcctttc atgtactgta ctgtacacct gatactgtaa acatactgta
7441 ataataatgt ctcacatgga aacgagagaa gacgctgggt cagcagcaag ctgtagtttt
7501 taaaaatgtt tttagttaaa tgttgaggag aaaaaaaatg gctttccccc caaagtatcc
7561 tgtgtgaacc tacaacgccc tgacctcttt ctctcctcct tgattgtatg aatagccctg
7621 agatcacctc ttagacctgg ttttaacctt tagctgcagc ggctgcgctg ccacgtgtgt
7681 atatatatga tgttgtacat tgcacatacc cttgaatctc cacagtttgg tccccttccc
7741 agctacccct ttatagtatg gcgagttaac aagttggtga cctgcacaaa gcgagacaca
7801 gctatttaat ctcttgccag acattgcccc tcttggtgca gtgctctaca ggtctctgta
7861 aaaagccctt gctgtctcag cagccaatca acttacagtt tattttttc tgggttttg
7921 ttttgttttg tttcatttct aatcgaggtg tgaaaaagtt ctaggttcag ttgaagttcc
7981 tgatgaagaa acacaattga gatttttca gtgataaaat ctgcatattt gtatttcaac
8041 aatgtagcta aaaacttgat gtaaattcct ccttttttt ccttttttgg cttaatgaat
8101 atcatttatt cagtatgaaa tctttatact atatgttcca cgtgttaaga ataaatgtac
8161 attaaatctt ggtaa SEQ ID NO: 30 Mouse ARID1A Amino Acid Sequence (NP_001074288.1)
1 maaqvapaaa sslgnppppp selkkaeqqg reeaggeaaa aaaergemka aagqesegpa
61 vgppqplgke lqdgaesngg gggggagsgg gpgaepdlkn sngnagprpa lnnnlpeppg
121 gggggsssss dgvgapphsa aaalpppayg fgqaygrsps avaaaaaavf hqqhggqqsp
181 glaalqsggg gglepyagpq qnshdhgfpn hqynsyypnr sayppppqay alssprggtp
241 gsgaaaaags kpppsssasa ssssssfaqq rfgamggggp saagggtpqp tatptlnqll
301 tspssargyq gypggdyggg pgdggagkgp admasqcwga aaaaaaaaaa vsggaqqrsh
361 hapmspgssg gggqplartp gssspmdgmg kmrpqpyggt npysqqqgpp sgpqqghgyp
421 gqpygsqtpq rypmtmqgra qsamgslsya gqippygqqg psaygqqgqt pyynqqsphp
481 qqqppyaqqp psqtphaqps yqqqpqtqqp qlgssqppys qqpsqpphqg sptpypsqqs
541 ttqqhpqsqp pysqpqaqsp yqqqqpqqpa ssslsqqaay pqpqpqqsqq taysqqrfpp
601 pqelsqdsfg sqassapsmt sskggqedmn lslgsrpssl pdlsgsiddl pmgtegalsp
661 gvstsgisss qgeqsnpaqs pfsphtsphl pgirgpspsp vgspasvaqs rsgplspaav
721 pgnqmpprpp sgqsdsimhp smngssiaqd rgymqrnpqm pqytspqpgs alsprqpsgg
781 qmhsgvgsyq qnsmgsygpq gsqygpqggy prqpnynalp nanypnagma gsmnpmgagg
841 qmhgqpgipp ygtlppgrma hasmgnrpyg pnmanmppqv gsgmcpppgg mnrktqesav
901 amhvaansiq nrppgypnmn qggmmgtgpp ygqginsmag minpqgppyp mggtmannsa
961 gmaaspemmg lgdvkltpat kmnnkadgtp kteskskkss ssttnekit klyelggepe
1021 rkmwvdryla fteekamgmt nlpavgrkpl dlyrlyvsvk eiggltqvnk nkkwrelatn TABLE 1-continued 1081 lnvgtsssaa sslkkgyiqc lyafeckier gedpppdifa aadskksqpk iqppspagsg
1141 smqgpqtpqs tsssmaeggd lkpptpastp hsqipplpgm srsnsvgiqd afpdgsdptf
1201 qkrnsmtpnp gygpsmntsd mmgrmsyepn kdpygsmrka pgsdpfmssg qgpnggmgdp
1261 ysraagpglg svamgprqhy pyggpydrvr tepgigpegn mgtgapqpnl mpstpdsgmy
1321 spsryppqqq qqqqqhdsy gnqfstqgtp ssspfpsqqt tmyqqqqqny krpmdgtygp
1381 pakrhegemy svpysagqgq pqqqlpaaq sqpasqpqaa gpspqqdvyn qysnaypasa
1441 taatdrrpag gpqnqfpfqf grdrvsappg ssaqqnmppq mmggpigasa evaqqgtmwq
1501 grndmtynya nrqntgsatq gpayhgvnrt demlhtdqra nhegpwpshg trqppygpsa
1561 pvppmtrppp snyqpppsmp nhipqvsspa plprpmenrt spskspflhs gmkmqkagpp
1621 vpashiaptp vqppmirrdi tfppgsveat qpvlkgrrrl tmkdigtpea wrvmmslksg
1681 llaestwald tinillyddn simtfnlsql pgllellvey frrclieifg ilkeyevgdp
1741 gqrtlldpgr ftkvyspaht eeeeeehldp kleeeeeegv gndeemaflg kdkpssenne
1801 eklvskfdkl pvkivqrndp fvvdcsdklg rvgefdsgll hwrigggdtt ehigthfesk
1861 iellpsrpyv pcptpprkhl ttvegtpgtt egegpppdgl pekritatmd dmlstrsstl
1921 tdegaksaea tkesskfpfg ispaqshrni kiledephsk detplctlld wqdslakrcv
1981 cvsntirsls fvpgndfems khpglllilg klillhhkhp erkqapltye keeeqdqgvs
2041 cdkvewwwdc lemlrentiv tlanisgqld lspypesicl pvldgllhwa vcpsaeaqdp
2101 fstlgpnavl spqrlvletl sklsiqdnnv dlilatppfs rleklystmv rflsdrknpv
2161 cremavvlla nlaqgdslaa raiavqkgsi gnllgfleds laatqfqqsq asllhmqnpp
2221 feptsvdmmr raarallala kvdenhseft lyesrlldis vsplmnslvs qvicdvlfli
2281 gqs SEQ ID NO: 31 Human ARID1B cDNA Sequence Variant 1 (NM_017519.2, CDS: from 1 to 6711)

1 atggcccata acgcgggcgc cgcggccgcc gccggcaccc acagcgccaa gagcggcggc
61 tccgaggcgg ctctcaagga gggtggaagc gccgccgcgc tgtcctcctc ctcctcctcc
121 tccgcggcgg cagcggcggc atcctcttcc tcctcgtcgg gcccgggctc ggccatggag
181 acggggctgc tccccaacca caaactgaaa accgttggcg aagcccccgc cgcgccgccc
241 caccagcagc accaccacca ccaccatgcc caccaccacc accaccatgc ccaccacctc
301 caccaccacc acgcactaca gcagcagcta aaccagttcc agcagcagca gcagcagcag
361 caacagcagc agcagcagca gcagcaacag caacatccca tttccaacaa caacagcttg
421 ggcggcgcgg gcggcggcgc gcctcagccc ggccccgaca tggagcagcc gcaacatgga
481 ggcgccaagg acagtgctgc gggcggccag gccgaccccc cgggcccgcc gctgctgagc
541 aagccgggcg acgaggacga cgcgccgccc aagatggggg agccggcggg cggccgctac
601 gagcacccgg gcttgggcgc cctgggcacg cagcagccgc cggtcgccgt gcccgggggc
661 ggcggcggcc cggcggccgt cccggagttt aataattact atggcagcgc tgcccctgcg
721 agcggcggcc ccggcggccg cgctgggcct tgctttgatc aacatggcgg acaacaaagc
781 cccgggatgg ggatgatgca ctccgcctcc gccgccgccg ccggggcccc cggcagcatg
841 gaccccctgc agaactccca cgaagggtac cccaacagcc agtgcaacca ttatccgggc
901 tacagccggc ccggcgcggg cggcggcggc ggcggcggcg gcggaggagg aggaggcagc
961 ggaggaggag gaggaggagg aggagcagga gcaggaggag caggagcggg agctgtggcg
1021 gcggcggccg cggcggcggc ggcagcagca ggaggcggcg gcggcggcgg ctatgggggc
1081 tcgtccgcgg ggtacggggt gctgagctcc ccccggcagc agggcggcgg catgatgatg
1141 ggcccccgggg gcggcggggc cgcgagcctc agcaaggcgg ccgccggctc ggcggcgggg
1201 ggcttccagc gcttcgccgg ccagaaccag cacccgtcgg gggccacccc gaccctcaat
1261 cagctgctca cctcgcccag ccccatgatg cggagctacg gcggcagcta ccccgagtac
1321 agcagcccca gcgcgccgcc gccgccgccg tcgcagcccc agtcccaggc ggcggcggcg
1381 ggggcggcgg cgggcggcca gcaggcggcc gcgggcatgg gcttgggcaa ggacatgggc
1441 gcccagtacg ccgctgccag cccggcctgg gcggccgcgc aacaaaggag tcacccggcg
1501 atgagccccg gcacccccgg accgaccatg ggcagatccc agggcagccc aatggatcca
1561 atggtgatga agagacctca gttgtatggc atgggcagta accctcattc tcagcctcag
1621 cagagcagtc cgtacccagg aggttcctat ggccctccag gcccacagcg gtatccaatt
1681 ggcatccagg gtcggactcc cggggccatg gccggaatgc agtaccctca gcagcagatg
1741 ccacctcagt atggacagca aggtgtgagt ggttactgcc agcagggcca acagccatat
1801 tacagccagc agccgcagcc cccgcacctc ccaccccagg cgcagtatct gccgtcccag
1861 tcccagcaga ggtaccagcc gcagcaggac atgtctcagg aaggctatgg aactagatct
1921 caacctcctc tggcccccgg aaaacctaac catgaagact tgaacttaat acagcaagaa
1981 agaccatcaa gtttaccaga tctgtctggc tccattgatg acctccccac gggaacggaa
2041 gcaactttga gctcagcagt cagtgcatcc gggtccacga gcagccaagg ggatcagagc
2101 aacccggcgc agtcgccttt ctccccacat gcgtcccctc atctctccag catcccgggg
2161 ggcccatctc cctctcctgt tggctctcct gtaggaagca accagtctcg atctggccca
2221 atctctcctg caagtatccc aggtagtcag atgcctccgc agccacccgg gagccagtca
2281 gaatccagtt cccatcccgc cttgagccag tcaccaatgc cacaggaaag aggttttatg
2341 gcaggcacac aaagaaaccc tcagatggct cagtatggac ctcaacagac aggaccatcc
2401 atgtcgcctc atccttctcc tgggggccag atgcatgctg gaatcagtag ctttcagcag
2461 agtaactcaa gtgggactta cggtccacag atgagccagt atggaccaca aggtaactac
2521 tccagacccc cagcgtatag tggggtgccc agtgcaagct acagcggccc agggcccggt
2581 atgggtatca gtgccaacaa ccagatgcat ggacaagggc caagccagcc atgtggtgct
2641 gtgcccctgg gacgaatgcc atcagctggg atgcagaaca gaccatttcc tggaaatatg
2701 agcagcatga cccccagttc tcctggcatg tctcagcagg gagggccagg aatggggccg
2761 ccaatgccaa ctgtgaaccg taaggcacag gaggcagccg cagcagtgat gcaggctgct
2821 gcgaactcag cacaaagcag gcaaggcagt ttccccggca tgaaccagag tggacttatg
2881 gcttccagct ctccctacag ccagcccatg aacaacagct ctagcctgat gaacacgcag
2941 gcgccgccct acagcatggc gcccgccatg gtgaacagct cggcagcatc tgtgggtctt
3001 gcagatatga tgtctcctgg tgaatccaaa ctgcccctgc ctctcaaagc agacggcaaa
3061 gaagaaggca ctccacagcc cgagagcaag tcaaagaagt ccagctcctc caccactact
3121 ggggagaaga tcacgaaggt gtacgagctg gggaatgagc cagagagaaa gctctgggtc
3181 gaccgatacc tcaccttcat ggaagagaga ggctctcctg tctcaagtct gcctgccgtg
3241 ggcaagaagc cctggacct gttccgactc tacgtctgcg tcaaagagat cgggggtttg
3301 gcccaggtta ataaaaacaa gaagtggcgt gagctggcaa ccaacctaaa cgttggcacc TABLE 1-continued

| | | | | | | |
|---|---|---|---|---|---|---|
| 3361 | tcaagcagtg | cagcgagctc | cctgaaaaag | cagtatattc | agtacctgtt | tgcctttgag |
| 3421 | tgcaagatcg | aacgtgggga | ggagcccccg | ccggaagtct | tcagcaccgg | ggacaccaaa |
| 3481 | aagcagccca | agctccagcc | gccatctcct | gctaactcgg | gatccttgca | aggcccacag |
| 3541 | accccccagt | caactggcag | caattccatg | gcagaggttc | caggtgacct | gaagccacct |
| 3601 | accccagcct | ccacccctca | cggccagatg | actccaatgc | aaggtggaag | aagcagtaca |
| 3661 | atcagtgtgc | acgacccatt | ctcagatgtg | agtgattcat | ccttcccgaa | acggaactcc |
| 3721 | atgactccaa | acgcccccta | ccagcagggc | atgagcatgc | ccgatgtgat | gggcaggatg |
| 3781 | ccctatgagc | ccaacaagga | cccctttggg | ggaatgagaa | aagtgcctgg | aagcagcgag |
| 3841 | ccctttatga | cgcaaggaca | gatgcccaac | agcagcatgc | aggacatgta | caaccaaagt |
| 3901 | ccctccggag | caatgtctaa | cctgggcatg | gggcagcgcc | agcagtttcc | ctatggagcc |
| 3961 | agttacgacc | gaaggcatga | accttatggg | cagcagtatc | caggccaagg | ccctccctcg |
| 4021 | ggacagccgc | cgtatggagg | gcaccagccc | ggcctgtacc | cacagcagcc | gaattacaaa |
| 4081 | cgccatatgg | acggcatgta | cgggccccca | gccaagcgcc | acgagggcga | catgtacaac |
| 4141 | atgcagtaca | gcagccagca | gcaggagatg | tacaaccagt | atggaggctc | ctactcgggc |
| 4201 | ccggaccgca | ggcccatcca | gggccagtac | ccgtatccct | acagcaggga | gaggatgcag |
| 4261 | ggcccggggc | agatccagac | acacggaatc | ccgcctcaga | tgatgggcgg | cccgctgcag |
| 4321 | tcgtcctcca | gtgaggggcc | tcagcagaat | atgtgggcag | cacgcaatga | tatgccttat |
| 4381 | ccctaccaga | acaggcaggg | ccctggcggc | cctacacagg | cgccccctta | cccaggcatg |
| 4441 | aaccgcacag | acgatatgat | ggtacccgat | cagaggataa | atcatgagag | ccagtggcct |
| 4501 | tctcacgtca | gccagcgtca | gccttatatg | tcgtcctcag | cctccatgca | gcccatcaca |
| 4561 | cgcccaccac | agccgtccta | ccagacgcca | ccgtcactgc | caaatcacat | ctccagggcg |
| 4621 | cccagcccag | cgtccttcca | gcgctccctg | gagaaccgca | tgtctccaag | caagtctcct |
| 4681 | tttctgccgt | ctatgaagat | gcagaaggtc | atgcccacgg | tccccacatc | ccaggtcacc |
| 4741 | gggccaccac | cccaaccacc | cccaatcaga | agggagatca | cctttcctcc | tggctcagta |
| 4801 | gaagcatcac | aaccagtctt | gaaacaaagg | cgaaagatta | cctccaaaga | tatcgttact |
| 4861 | cctgaggcgt | ggcgtgtgat | gatgtccctt | aaatcaggtc | ttttggctga | gagtacgtgg |
| 4921 | gctttggaca | ctattaatat | tcttctgtat | gatgacagca | ctgttgctac | tttcaatctc |
| 4981 | tcccagttgt | ctggatttct | cgaactttta | gtcgagtact | ttagaaaatg | cctgattgac |
| 5041 | atttttggaa | ttcttatgga | atatgaagtg | ggagacccca | gccaaaaagc | acttgatcac |
| 5101 | aacgcagcaa | ggaaggatga | cagccagtcc | ttggcagacg | attctgggaa | agaggaggaa |
| 5161 | gatgctgaat | gtattgatga | cgacgaggaa | gacgaggagg | atgaggagga | agacagcgag |
| 5221 | aagacagaaa | gcgatgaaaa | gagcagcatc | gctctgactg | ccccggacgc | cgctgcagac |
| 5281 | ccaaaggaga | agcccaagca | agccagtaag | ttcgacaagc | tgccaataaa | gatagtcaaa |
| 5341 | aagaacaacc | tgtttgttgt | tgaccgatct | gacaagttgg | ggcgtgtgca | ggagttcaat |
| 5401 | agtggccttc | tgcactggca | gctcggcggg | ggtgacacca | ccgagcacat | tcagactcac |
| 5461 | tttgagagca | agatggaaat | tcctcctcgc | aggcgcccac | ctcccccctt | aagctccgca |
| 5521 | ggtagaaaga | aagagcaaga | aggcaaaggc | gactctgaag | agcagcaaga | gaaaagcatc |
| 5581 | atagcaacca | tcgatgacgt | cctctctgct | cggccagggg | cattgcctga | agacgcaaac |
| 5641 | cctgggcccc | agaccgaaag | cagtaagttt | ccctttggta | tccagcaagc | caaaagtcac |
| 5701 | cggaacatca | agctgctgga | ggacgagccc | aggagccgag | acgagactcc | tctgtgtacc |
| 5761 | atcgcgcact | ggcaggactc | gctggctaag | cgatgcatct | gtgtgtccaa | tattgtccgt |
| 5821 | agcttgtcat | tcgtgcctgg | caatgatgcc | gaaatgtcca | aacatccagg | cctggtgctg |
| 5881 | atcctgggga | agctgattct | tcttcaccac | gagcatccag | agagaaagcg | agcaccgcag |
| 5941 | acctatgaga | aagaggagga | tgaggacaag | gggtggcct | gcagcaaaga | tgagtggtgg |
| 6001 | tgggactgcc | tcgaggtctt | gagggataac | acgttggtca | cgttggccaa | catttccggg |
| 6061 | cagctagact | tgtctgctta | cacggaaagc | atctgcttgc | caattttgga | tggcttgctg |
| 6121 | cactggatgg | tgtgcccgtc | tgcagaggca | caagatccct | ttccaactgt | gggacccaac |
| 6181 | tcggtcctgt | cgcctcagag | acttgtgctg | gagaccctct | gtaaactcag | tatccaggac |
| 6241 | aataatgtgg | acctgatctt | ggccactcct | ccatttagtc | gtcaggagaa | attctatgct |
| 6301 | acattagtta | ggtacgttgg | ggatcgcaaa | aacccagtct | gtcgagaaat | gtccatggcg |
| 6361 | cttttatcga | accttgccca | aggggacgca | ctagcagcaa | gggccatagc | tgtgcagaaa |
| 6421 | ggaagcattg | gaaacttgat | aagcttccta | gaggatgggg | tcacgatggc | ccagtaccag |
| 6481 | cagagccagc | acaacctcat | gcacatgcag | cccccgcccc | tggaaccacc | tagcgtagac |
| 6541 | atgatgtgca | gggcggccaa | ggctttgcta | gccatggcca | gagtggacga | aaaccgctcg |
| 6601 | gaattccttt | tgcacgaggg | ccggttgctg | gatatctcga | tatcagctgt | cctgaactct |
| 6661 | ctggttgcat | ctgtcatctg | tgatgtactg | tttcagattg | ggcagttatg | acataagtga |
| 6721 | gaaggcaagc | atgtgtgagt | gaagattaga | gggtcacata | taactggctg | ttttctgttc |
| 6781 | ttgtttatcc | agcgtaggaa | gaaggaaaag | aaaatctttg | ctcctctgcc | ccattcacta |
| 6841 | tttaccaatt | gggaattaaa | gaaataatta | atttgaacag | ttatgaaatt | aatatttgct |
| 6901 | gtctgtgtgt | ataagtacat | cctttggggt | tttttttttc | tctttttttt | aaccaaagtt |
| 6961 | gctgtctagt | gcattcaaag | gtcacttttt | gttcttcaca | gatcttttta | atgttctttc |
| 7021 | ccatgttgta | ttgcattttt | gggggaagca | aattgacttt | aaagaaaaaa | gttgtggcaa |
| 7081 | aagatgctaa | gatgcgaaaa | tttcaccaca | ctgagtcaaa | aaggtgaaaa | attatccatt |
| 7141 | tcctatgcgt | tttactcctc | agagaatgaa | aaaaactgca | tcccatcacc | caaagttctg |
| 7201 | tgcaatagaa | atttctacag | atacaggtat | aggggctcaa | ggaggtatgt | cggtcagtag |
| 7261 | tcaaaactat | gaaatgatac | tggtttctcc | acaggaatat | ggttccatta | ggctgggagc |
| 7321 | aaaaacaatg | tttttaaga | ttgagaatac | atacctgaca | acgatccgga | aactgctcct |
| 7381 | caccactccc | gtcatgcctg | ctgtcggcgt | ttgaccttcc | acgtgacagt | tcttcacaat |
| 7441 | tcctttcatc | atttttaaa | tatttttttt | actgcctatg | ggctgtgatg | tatatagaag |
| 7501 | ttgtacatta | aacataccct | catttttttc | ttttcttttt | tttttttttt | tttagtacaa |
| 7561 | agttttagtt | tctttttcat | gatgtggtaa | ctacgaagtg | atggtagatt | taaataattt |
| 7621 | tttattttta | ttttatatat | tttttcatta | gggccatatc | tccaaaaaaa | gaaagaaaaa |
| 7681 | atacaaaaaa | caaaaacaaa | aaaaaaagag | ggtaatgtac | aagtttctgt | atgtataaag |
| 7741 | tcatgctcga | tttcaggaga | gcagctgatc | acaatttgct | tcatgaatca | aggtgtggaa |
| 7801 | atggttatat | atggattgat | ttagaaaatg | gttaccagta | cagtcaaaaa | agagaaaatg |
| 7861 | aaaaaaatac | aactaaaagg | aagaaacaca | acttcaaaga | tttttcagtg | atgagaatcc |
| 7921 | acatttgtat | ttcaagataa | tgtagtttaa | aaaaaaaaaa | aagaaaaaaa | cttgatgtaa |
| 7981 | attcctcctt | ttcctctggc | ttaatgaata | tcatttattc | agtataaaat | ctttatatgt |
| 8041 | tccacatgtt | aagaataaat | gtacattaaa | tcttgttaag | cactgtgatg | ggtgttcttg |
| 8101 | aatactgttc | tagtttcctt | aaagtggttt | cctagtaatc | aagttattta | caagaaatag |

TABLE 1-continued

```
8161 gggaatgcag cagtgtattc acattataaa accctacatt tggaagagac ctttaggggt
8221 tacctacttt agagtgggga gcaacagttt gattttctca aattacttag ctaattagtc
8281 tttctttgaa gcaattaact ctaacgacat tgaggtatga tcattttcag tatttatggg
8341 aggtggctgc tgacccactt gaggtgagat ctcagaagct taactggcct gaaaatgtaa
8401 cattctgcct tttactaact ccatcttagt ttaatcaaag ttcaatctat tccttgtttc
8461 ttctgtgtgc ctcagagtta ttttgcattt agtttactcc accgtgtata atatttatac
8521 tgtgcaatgt taaaaaagaa tctgttatat tgtatgtggt gtacatagtg caaagtgatg
8581 atttctattt cagggcatat tatggttctc atattccttc ctacctggtg cacagtagct
8641 ttttaatact agtcacttct aatttaaact ttctcttcct gggtcattga ctgttactgt
8701 gtaataatcg atttctttga aactgctgca taattatgct gttagtggac ctctacctct
8761 tctcttccct ctcccaatca cagtatactc agaatcccca gcccctcgca tacattgtgt
8821 cggttcacat tactcacagt aatatatgga agagttagac aagaacatgc agttacagtc
8881 attgtgagac gtgactctcc agtgtcacga ggaaaaaaat catcttttct gcaaacagtc
8941 tctcatctgt caactcccac attactgagt caaacagtct tcttacataa caatgcaacc
9001 aaatatatgt tgaattaaag acccatttat aattctgctt taaatacatc tgcttgctaa
9061 gaacagattt cagtgctcca agcttcaaat atggagattt gtaagaggga attcaatatt
9121 attctaattt ctctcttaca gagtacaaat aaaaggtgta tacaaactcc gaacatatcc
9181 agtattccaa ttcctttgtc aatcagaaga gtaaaataat taacaaaaga ctgttgttat
9241 ggtttgcatt gtaaccgata cgcagagtct gaccgttggg caacaagttt ttctatcctg
9301 atgcgcaaca cagtctctag agactaatcc aggaagactt tagcctcctt tccatattct
9361 cacccccgaa tcaagattta cagaagccca cgaagaattt acagcctgct tgagatcatc
9421 ttgcctataa actgagttat tgctttgtcc taaaaattag tcggtttttt tttttctatg
9481 aggcttttca gaaatttaca ggatgcccag actttacatg tgtaccaaaa aaaaaaaaaa
9541 gataaaaaat aaaggtgcaa agaaagttta gtattttgga atggtgctat aaagttgaaa
9601 aaaaaaaaa
```

SEQ ID NO: 32 Human ARID1B Amino Acid Sequence isoform A (NP_059989.2)

```
   1 mahnagaaaa agthsaksgg seaalkeggs aaalssssss saaaaaasss sssgpgsame
  61 tgllpnhklk tvgeapaapp hqqhhhhhha hhhhhhahhl hhhhalqqql nqfqqqqqqq
 121 qqqqqqqqqq qhpisnnnsl ggagggapqp gpdmeqpqhg gakdsaaggq adppgpplls
 181 kpgdeddapp kmgepaggry ehpglgalgt qqppvavpgg gggpaavpef nnyygsaapa
 241 sggpggragp cfdqhggqqs pgmgmmhsas aaaagapgsm dplqnshegy pnsqcnhypg
 301 ysrpgagggg gggggggggs gggggggag aggagagava aaaaaaaaaa gggggggygg
 361 ssagygvlss prqqgggmmm gpggggaasl skaaagsaag gfgrfaggng hpsgatptln
 421 qlltspspmm rsyggsypey sspsappppp sqpgsgaaaa gaaaggqqaa agmglgkdmg
 481 aqyaaaspaw aaaggrshpa mspgtpgptm grsqgspmdp mvmkrpglyg mgsnphsgpg
 541 qsspypggsy gppgpqrypi giqgrtpgam agmgypqqqm ppgyggggvs gycqqgqqpy
 601 ysggpqpphl ppgagylpsq sggrygpqqd msgegygtrs qpplapgkpn hedlnliqqe
 661 rpsslpdlsg siddlptgte atlssaysas gstssggdgs npaqspfsph asphlssipg
 721 gpspspvgsp vgsnqsrsgp ispasipgsq mppgppgsgs essshpalsq spmpqergfm
 781 agtqrnpqma gygpggtgps msphpspggq mhagissfqg snssgtygpq msqygpqgny
 841 srppaysgvp sasysgpgpg mgisannqmh gggpsgpcga vplgrmpsag mqnrpfpgnm
 901 ssmtpsspgm sqqggpgmgp pmptvnrkaq eaaaavmqaa ansagsrggs fpgmngsglm
 961 assspysgpm nnssslmntq appysmapam vnssaasvgl admmspgesk lplplkadgk
1021 eegtpqpesk skksssstt gekitkvyel gneperklwv dryltfmeer gspvsslpav
1081 gkkpldlfrl yvcvkeiggl aqvnknkkwr elatnlnvgt sssaasslkk qyigylfafe
1141 ckiergeepp pevfstgdtk kgpklgppsp ansgslqgpq tpqstgsnsm aevpgdlkpp
1201 tpastphgqm tpmqggrsst isvhdpfsdv sdssfpkrns mtpnapyggg msmpdvmgrm
1261 pyepnkdpfg gmrkvpgsse pfmtqgqmpn ssmgdmyngs psgamsnlgm gqrqqfpyga
1321 sydrrhepyg qqypgqgpps gqppygghqp glypqqpnyk rhmdgmygpp akrhegdmyn
1381 mgyssqqqem ynqyggsysg pdrrpiqgqy pypysrermq gpggigthgi ppqmmggplq
1441 ssssegpqqn mwaarndmpy pyqnrqgpgg ptqappypgm nrtddmmvpd qrinhesqwp
1501 shvsgrqpym sssasmqpit rppgpsygtp pslpnhisra pspasfqrsl enrmspsksp
1561 flpsmkmqkv mptvptsqvt gpppqpppir reitfppgsv easgpvlkgr rkitskdivt
1621 peawrvmmsl ksgllaestw aldtinilly ddstvatfnl sqlsgflell veyfrkclid
1681 ifgilmeyev gdpsqkaldh naarkddsqs laddsgkeee daecidddee deedeeedse
1741 ktesdekssi altapdaaad pkekpkgask fdklpikivk knnlfvvdrs dklgrvqefn
1801 sgllhwqlgg gdttehigth feskmeippr rrppppipssa grkkeqegkg dseeqqeksi
1861 iatiddvlsa rpgalpedan pgpqtesskf pfgiqqaksh rniklledep rsrdetplct
1921 iahwqdslak rcicvsnivr slsfvpgnda emskhpglvl ilgklillhh ehperkrapq
1981 tyekeededk gvacskdeww wdclevlrdn tivtlanisg gldlsaytes iclpildgll
2041 hwmvcpsaea qdpfptvgpn svlspqrlvl eticklsiqd nnvdlilatp pfsrqekfya
2101 tivryvgdrk npvcremsma llsnlaggda laaraiavqk gsignlisfl edgvtmaqyq
2161 qsqhnlmhmq pppleppsvd mmcraakall amarvdenrs efllhegrll disisavins
2221 lvasvicdvl fqigql
```

SEQ ID NO: 33 Human ARID1B cDNA Sequence Variant 2 (NM_020732.3, CDS: from 1 to 6750)

```
   1 atggcccata acgcgggcgc cgcggccgcc gccggcaccc acagcgccaa gagcggcggc
  61 tccgaggcgg ctctcaagga gggtggaagc gccgccgcgc tgtcctcctc ctcctcctcc
 121 tccgcggcgg cagcggcggc atcctcttcc tcctcgtcgg gcccgggctc ggccatggag
 181 acggggctgc tccccaacca caaactgaaa accgttggcg aagcccccgc cgcgccgccc
 241 caccagcagc accaccacca ccaccatgcc caccaccacc accaccatgc ccaccacctc
 301 caccaccacc acgcactaca gcagcagcta aaccagttcc agcagcagca gcagcagcag
 361 caacagcagc agcagcagca gcagcaacag caacatccca tttccaacaa caacagcttg
 421 ggcggcgcgg gcggcggcgc gcctcagccc ggccccgaca tggagcagcc gcaacatgga
 481 ggcgccaagg acagtgctgc gggcggccag gccgaccccc cgggcccgcc gctgctgagc
 541 aagccgggcg acgaggacga cgcgccgccc aagatggggg agccggcggg cggccgctac
 601 gagcacccgg gcttgggcgc cctgggcacg cagcagccgc cggtcgccgt gcccgggggc
 661 ggcggcggcc cggcggccgt cccggagttt aataattact atggcagcgc tgcccctgcg
```

TABLE 1-continued

| | | | | | | |
|---|---|---|---|---|---|---|
| 721 | agcggcggcc | ccggcggccg | cgctgggcct | tgctttgatc | aacatggcgg | acaacaaagc |
| 781 | cccgggatgg | ggatgatgca | ctccgcctcc | gccgccgccg | ccggggcccc | cggcagcatg |
| 841 | gaccccctgc | agaactccca | cgaagggtac | cccaacagcc | agtgcaacca | ttatccgggc |
| 901 | tacagccggc | ccggcgcggg | cggcggcggc | ggcggcggcg | gcggaggagg | aggaggcagc |
| 961 | ggaggaggag | gaggaggagg | aggagcagga | gcaggaggag | caggagcggg | agctgtggcg |
| 1021 | gcggcggccg | cggcggcggc | ggcagcagca | ggaggcggcg | gcggcggcgg | ctatgggggc |
| 1081 | tcgtccgcgg | ggtacggggt | gctgagctcc | ccccggcagc | agggcggcgg | catgatgatg |
| 1141 | ggcccggggg | gcggcggggc | cgcgagcctc | agcaaggcgg | ccgccggctc | ggcggcgggg |
| 1201 | ggcttccagc | gcttcgccgg | ccagaaccag | cacccgtcgg | gggccacccc | gaccctcaat |
| 1261 | cagctgctca | cctcgcccag | ccccatgatg | cggagctacg | gcggcagcta | ccccgagtac |
| 1321 | agcagcccca | gcgcgccgcc | gccgccgccg | tcgcagcccc | agtcccaggc | ggcggcggcg |
| 1381 | ggggcggcgg | cgggcggcca | gcaggcggcc | gcgggcatgg | gcttgggcaa | ggacatgggc |
| 1441 | gcccagtacg | ccgctgccag | cccggcctgg | gcggccgcgc | aacaaaggag | tcacccggcg |
| 1501 | atgagccccg | gcaccccggg | accgaccatg | ggcagatccc | agggcagccc | aatggatcca |
| 1561 | atggtgatga | agagacctca | gttgtatggc | atgggcagta | accctcattc | tcagcctcag |
| 1621 | cagagcagtc | cgtacccagg | aggttcctat | ggccctccag | gcccacagcg | gtatccaatt |
| 1681 | ggcatccagg | gtcggactcc | cggggccatg | gccggaatgc | agtaccctca | gcagcaggac |
| 1741 | tctggagatg | ccacatggaa | agaaacattc | tggttgatgc | cacctcagta | tggacagcaa |
| 1801 | ggtgtgagtg | gttactgcca | gcagggccaa | cagccatatt | acagccagca | gccgcagccc |
| 1861 | ccgcacctcc | caccccaggc | gcagtatctg | ccgtcccagt | cccagcagag | gtaccagccg |
| 1921 | cagcaggaca | tgtctcagga | aggctatgga | actagatctc | aacctcctct | ggcccccgga |
| 1981 | aaacctaacc | atgaagactt | gaacttaata | cagcaagaaa | gaccatcaag | tttaccagat |
| 2041 | ctgtctggct | ccattgatga | cctccccacg | ggaacggaag | caactttgag | ctcagcagtc |
| 2101 | agtgcatccg | ggtccacgag | cagccaaggg | gatcagagca | acccggcgca | gtcgcctttc |
| 2161 | tccccacatg | cgtcccctca | tctctccagc | atcccggggg | gcccatctcc | ctctcctgtt |
| 2221 | ggctctcctg | taggaagcaa | ccagtctcga | tctggcccaa | tctctcctgc | aagtatccca |
| 2281 | ggtagtcaga | tgcctccgca | gccacccggg | agccagtcag | aatccagttc | ccatcccgcc |
| 2341 | ttgagccagt | caccaatgcc | acaggaaaga | ggttttatgg | caggcacaca | aagaaaccct |
| 2401 | cagatggctc | agtatggacc | tcaacagaca | ggaccatcca | tgtcgcctca | tccttctcct |
| 2461 | gggggccaga | tgcatgctgg | aatcagtagc | tttcagcaga | gtaactcaag | tgggacttac |
| 2521 | ggtccacaga | tgagccagta | tggaccacaa | ggtaactact | ccagaccccc | agcgtatagt |
| 2581 | ggggtgccca | gtgcaagcta | cagcggccca | gggcccggta | tgggtatcag | tgccaacaac |
| 2641 | cagatgcatg | gacaagggcc | aagccagcca | tgtggtgctg | tgcccctggg | acgaatgcca |
| 2701 | tcagctggga | tgcagaacag | accatttcct | ggaaatatga | gcagcatgac | ccccagttct |
| 2761 | cctggcatgt | ctcagcaggg | agggccagga | atggggccgc | caatgccaac | tgtgaaccgt |
| 2821 | aaggcacagg | aggcagccgc | agcagtgatg | caggctgctg | cgaactcagc | acaaagcagg |
| 2881 | caaggcagtt | tccccggcat | gaaccagagt | ggacttatgg | cttccagctc | tccctacagc |
| 2941 | cagcccatga | acaacagctc | tagcctgatg | aacacgcagg | cgccgcccta | cagcatggcg |
| 3001 | cccgccatgg | tgaacagctc | ggcagcatct | gtgggtcttg | cagatatgat | gtctcctggt |
| 3061 | gaatccaaac | tgcccctgcc | tctcaaagca | gacggcaaag | aagaaggcac | tccacagccc |
| 3121 | gagagcaagt | caaagaagtc | cagctcctcc | accactactg | gggagaagat | cacgaaggtg |
| 3181 | tacgagctgg | ggaatgagcc | agagagaaag | ctctgggtcg | accgatacct | caccttcatg |
| 3241 | gaagagagag | gctctcctgt | ctcaagtctg | cctgccgtgg | gcaagaagcc | cctggacctg |
| 3301 | ttccgactct | acgtctgcgt | caaagagatc | gggggtttgg | cccaggttaa | taaaaacaag |
| 3361 | aagtggcgtg | agctggcaac | caacctaaac | gttggcacct | caagcagtgc | agcgagctcc |
| 3421 | ctgaaaaagc | agtatattca | gtacctgttt | gcctttgagt | gcaagatcga | acgtggggag |
| 3481 | gagcccccgc | cggaagtctt | cagcaccggg | gacaccaaaa | agcagcccaa | gctccagccg |
| 3541 | ccatctcctg | ctaactcggg | atccttgcaa | ggcccacaga | ccccccagtc | aactggcagc |
| 3601 | aattccatgg | cagaggttcc | aggtgacctg | aagccaccta | ccccagcctc | cacccctcac |
| 3661 | ggccagatga | ctccaatgca | aggtggaaga | agcagtacaa | tcagtgtgca | cgacccattc |
| 3721 | tcagatgtga | gtgattcatc | cttcccgaaa | cggaactcca | tgactccaaa | cgccccctac |
| 3781 | cagcagggca | tgagcatgcc | cgatgtgatg | ggcaggatgc | cctatgagcc | caacaaggac |
| 3841 | ccctttgggg | gaatgagaaa | agtgcctgga | agcagcgagc | cctttatgac | gcaaggacag |
| 3901 | atgcccaaca | gcagcatgca | ggacatgtac | aaccaaagtc | cctccggagc | aatgtctaac |
| 3961 | ctgggcatgg | ggcagcgcca | gcagtttccc | tatggagcca | gttacgaccg | aaggcatgaa |
| 4021 | ccttatgggc | agcagtatcc | aggccaaggc | cctccctcgg | gacagccgcc | gtatggaggg |
| 4081 | caccagcccg | gcctgtaccc | acagcagccg | aattacaaac | gccatatgga | cggcatgtac |
| 4141 | gggccccag | ccaagcgcca | cgagggcgac | atgtacaaca | tgcagtacag | cagccagcag |
| 4201 | caggagatgt | acaaccagta | tggaggctcc | tactcgggcc | cggaccgcag | gcccatccag |
| 4261 | ggccagtacc | cgtatcccta | cagcagggag | aggatgcagg | gcccggggca | gatccagaca |
| 4321 | cacggaatcc | cgcctcagat | gatgggcggc | ccgctgcagt | cgtcctccag | tgaggggcct |
| 4381 | cagcagaata | tgtgggcagc | acgcaatgat | atgccttatc | cctaccagaa | caggcagggc |
| 4441 | cctggcggcc | ctacacaggc | gccccttac | ccaggcatga | accgcacaga | cgatatgatg |
| 4501 | gtacccgatc | agaggataaa | tcatgagagc | cagtggcctt | ctcacgtcag | ccagcgtcag |
| 4561 | ccttatatgt | cgtcctcagc | ctccatgcag | cccatcacac | gcccaccaca | gccgtcctac |
| 4621 | cagacgccac | cgtcactgcc | aaatcacatc | tccagggcgc | ccagcccagc | gtccttccag |
| 4681 | cgctccctgg | agaaccgcat | gtctccaagc | aagtctcctt | ttctgccgtc | tatgaagatg |
| 4741 | cagaaggtca | tgcccacggt | ccccacatcc | caggtcaccg | ggccaccacc | ccaaccaccc |
| 4801 | ccaatcagaa | gggagatcac | ctttcctcct | ggctcagtag | aagcatcaca | accagtcttg |
| 4861 | aaacaaaggc | gaaagattac | ctccaaagat | atcgttactc | ctgaggcgtg | gcgtgtgatg |
| 4921 | atgtccctta | aatcaggtct | tttggctgag | agtacgtggg | ctttggacac | tattaatatt |
| 4981 | cttctgtatg | atgacagcac | tgttgctact | ttcaatctct | cccagttgtc | tggatttctc |
| 5041 | gaacttttag | tcgagtactt | tagaaaatgc | ctgattgaca | tttttggaat | tcttatggaa |
| 5101 | tatgaagtgg | gagaccccag | ccaaaaagca | cttgatcaca | acgcagcaag | gaaggatgac |
| 5161 | agccagtcct | tggcagacga | ttctgggaaa | gaggaggaag | atgctgaatg | tattgatgac |
| 5221 | gacgaggaag | acgaggagga | tgaggaggaa | gacagcgaga | agacagaaag | cgatgaaaag |
| 5281 | agcagcatcg | ctctgactgc | cccggacgcc | gctgcagacc | caaaggagaa | gcccaagcaa |
| 5341 | gccagtaagt | tcgacaagct | gccaataaag | atagtcaaaa | agaacaacct | gtttgttgtt |
| 5401 | gaccgatctg | acaagttggg | gcgtgtgcag | gagttcaata | gtggccttct | gcactggcag |
| 5461 | ctcggcgggg | gtgacaccac | cgagcacatt | cagactcact | ttgagagcaa | gatggaaatt |

TABLE 1-continued

```
5521 cctcctcgca ggcgcccacc tcccccctta agctccgcag gtagaaagaa agagcaagaa
5581 ggcaaaggcg actctgaaga gcagcaagag aaaagcatca tagcaaccat cgatgacgtc
5641 ctctctgctc ggccaggggc attgcctgaa gacgcaaacc ctgggcccca gaccgaaagc
5701 agtaagtttc cctttggtat ccagcaagcc aaaagtcacc ggaacatcaa gctgctggag
5761 gacgagccca ggagccgaga cgagactcct ctgtgtacca tcgcgcactg gcaggactcg
5821 ctggctaagc gatgcatctg tgtgtccaat attgtccgta gcttgtcatt cgtgcctggc
5881 aatgatgccg aaatgtccaa acatccaggc ctggtgctga tcctggggaa gctgattctt
5941 cttcaccacg agcatccaga gagaaagcga gcaccgcaga cctatgagaa agaggaggat
6001 gaggacaagg gggtggcctg cagcaaagat gagtggtggt gggactgcct cgaggtcttg
6061 agggataaca cgttggtcac gttggccaac atttccgggc agctagactt gtctgcttac
6121 acggaaagca tctgcttgcc aattttggat ggcttgctgc actggatggt gtgcccgtct
6181 gcagaggcac aagatccctt tccaactgtg ggacccaact cggtcctgtc gcctcagaga
6241 cttgtgctgg agaccctctg taaactcagt atccaggaca ataatgtgga cctgatcttg
6301 gccactcctc catttagtcg tcaggagaaa ttctatgcta cattagttag gtacgttggg
6361 gatcgcaaaa acccagtctg tcgagaaatg tccatggcgc ttttatcgaa ccttgcccaa
6421 ggggacgcac tagcagcaag ggccatagct gtgcagaaag gaagcattgg aaacttgata
6481 agcttcctag aggatggggt cacgatggcc cagtaccagc agagccagca caacctcatg
6541 cacatgcagc ccccgcccct ggaaccacct agcgtagaca tgatgtgcag ggcggccaag
6601 gctttgctag ccatggccag agtggacgaa aaccgctcgg aattcctttt gcacgagggc
6661 cggttgctgg atatctcgat atcagctgtc ctgaactctc tggttgcatc tgtcatctgt
6721 gatgtactgt ttcagattgg gcagttatga cataagtgag aaggcaagca tgtgtgagtg
6781 aagattagag ggtcacatat aactggctgt tttctgttct tgtttatcca gcgtaggaag
6841 aaggaaaaga aaatctttgc tcctctgccc cattcactat ttaccaattg ggaattaaag
6901 aaataattaa tttgaacagt tatgaaatta atatttgctg tctgtgtgta taagtacatc
6961 ctttggggtt tttttttct ctttttttta accaaagttg ctgtctagtg cattcaaagg
7021 tcactttttg ttcttcacag atctttttaa tgttctttcc catgttgtat tgcatttttg
7081 ggggaagcaa attgacttta aagaaaaaag ttgtggcaaa agatgctaag atgcgaaaat
7141 ttcaccacac tgagtcaaaa aggtgaaaaa ttatccattt cctatgcgtt ttactcctca
7201 gagaatgaaa aaaactgcat cccatcaccc aaagttctgt gcaatagaaa tttctacaga
7261 tacaggtata ggggctcaag gaggtatgtc ggtcagtagt caaaactatg aaatgatact
7321 ggtttctcca caggaatatg gttccattag gctgggagca aaaacaatgt tttttaagat
7381 tgagaataca tacctgacaa cgatccggaa actgctcctc accactcccg tcatgcctgc
7441 tgtcggcgtt tgaccttcca cgtgacagtt cttcacaatt cctttcatca ttttttaaat
7501 attttttta ctgcctatgg gctgtgatgt atatagaagt tgtacattaa acatacccctc
7561 atttttttct tttcttttt tttttttttt ttagtacaaa gttttagttt ctttttcatg
7621 atgtggtaac tacgaagtga tggtagattt aaataatttt ttattttat tttatatatt
7681 ttttcattag ggccatatct ccaaaaaaag aaagaaaaaa tacaaaaaac aaaaacaaaa
7741 aaaaaagagg gtaatgtaca agtttctgta tgtataaagt catgctcgat ttcaggagag
7801 cagctgatca caatttgctt catgaatcaa ggtgtggaaa tggttatata tggattgatt
7861 tagaaaatgg ttaccagtac agtcaaaaaa gagaaaatga aaaaaataca actaaaagga
7921 agaaacacaa cttcaaagat ttttcagtga tgagaatcca catttgtatt tcaagataat
7981 gtagtttaaa aaaaaaaaaa agaaaaaaac ttgatgtaaa ttcctccttt tcctctggct
8041 taatgaatat catttattca gtataaaatc tttatatgtt ccacatgtta agaataaatg
8101 tacattaaat cttgttaagc actgtgatgg gtgttcttga atactgttct agtttcctta
8161 aagtggtttc ctagtaatca agttatttac aagaaatagg ggaatgcagc agtgtattca
8221 cattataaaa ccctacattt ggaagagacc tttaggggtt acctacttta gagtggggag
8281 caacagtttg attttctcaa attacttagc taattagtct ttctttgaag caattaactc
8341 taacgacatt gaggtatgat cattttcagt atttatggga ggtggctgct gacccacttg
8401 aggtgagatc tcagaagctt aactggcctg aaaatgtaac attctgcctt ttactaactc
8461 catcttagtt taatcaaagt tcaatctatt ccttgtttct tctgtgtgcc tcagagttat
8521 tttgcattta gtttactcca ccgtgtataa tatttatact gtgcaatgtt aaaaaagaat
8581 ctgttatatt gtatgtggtg tacatagtgc aaagtgatga tttctatttc agggcatatt
8641 atggttctca tattccttcc tacctggtgc acagtagctt tttaatacta gtcacttcta
8701 atttaaactt tctcttcctg ggtcattgac tgttactgtg taataatcga tttctttgaa
8761 actgctgcat aattatgctg ttagtggacc tctacctctt ctcttccctc tcccaatcac
8821 agtatactca gaatccccag cccctcgcat acattgtgtc ggttcacatt actcacagta
8881 atatatggaa gagttagaca agaacatgca gttacagtca ttgtgagacg tgactctcca
8941 gtgtcacgag gaaaaaaatc atctttctg caaacagtct ctcatctgtc aactccccaca
9001 ttactgagtc aaacagtctt cttacataac aatgcaacca aatatatgtt gaattaaaga
9061 cccatttata attctgcttt aaatacatct gcttgctaag aacagatttc agtgctccaa
9121 gcttcaaata tggagatttg taagagggaa ttcaatatta ttctaatttc tctcttacag
9181 agtacaaata aaaggtgtat acaaactccg aacatatcca gtattccaat tcctttgtca
9241 atcagaagag taaaataatt aacaaaagac tgttgttatg gtttgcattg taaccgatac
9301 gcagagtctg accgttgggc aacaagtttt tctatcctga tgcgcaacac agtctctaga
9361 gactaatcca ggaagacttt agcctccttt ccatattctc acccccgaat caagatttac
9421 agaagcccac gaagaattta cagcctgctt gagatcatct tgcctataaa ctgagttatt
9481 gctttgtcct aaaaattagt cggttttttt ttttctatga ggcttttcag aaatttacag
9541 gatgcccaga ctttacatgt gtaccaaaaa aaaaaaaaag ataaaaaata aaggtgcaaa
9601 gaaagtttag tattttggaa tggtgctata aagttgaaaa aaaaaaaa
```

SEQ ID NO: 34 Human ARID1B Amino Acid Sequence isoform B (NP_065783.3)

```
  1 mahnagaaaa agthsaksgg seaalkeggs aaalssssss saaaaaasss sssgpgsame
 61 tgllpnhklk tvgeapaapp hqqhhhhhha hhhhhhahhl hhhhalqqql nqfqqqqqqq
121 qqqqqqqqqq qhpisnnnsl ggagggapqp gpdmeqpqhg gakdsaaggq adppgppll s
181 kpgdeddapp kmgepaggry ehpglgalgt qqppvavpgg gggpaavpef nnyygsaapa
241 sggpggragp cfdqhgggqs pgmgmmhsas aaaagapgsm dplqnshegy pnsqcnhypg
301 ysrpgagggg gggggggggs gggggggag aggagagava aaaaaaaaaa gggggggygg
361 ssagygvlss prqqgggmmm gpggggaasl skaaagsaag gfqrfagqnq hpsgatptln
421 qlltspspmm rsyggsypey sspsappppp sqpgsgaaaa gaaaggqqaa agmglgkdmg
481 aqyaaaspaw aaaqqrshpa mspgtpgptm grsqgspmdp mvmkrpglyg mgsnphsqpq
```

TABLE 1-continued 541 qsspypggsy gppgpqrypi giqgrtpgam agmqypqqqd sgdatwketf wlmppqyggq
601 gvsgycqqgq qpyysqqpqp phlppgagyl psqsqqryqp qqdmsgegyg trsqpplapg
661 kpnhedlnli ggerpsslpd lsgsiddlpt gteatlssav sasgstssqg dqsnpaqspf
721 sphasphlss ipggpspspv gspvgsnqsr sgpispasip gsqmppqppg sqsessshpa
781 lsqspmpqer gfmagtqrnp qmagygpqqt gpsmsphpsp ggqmhagiss fqqsnssgty
841 gpqmsqygpq gnysrppays gvpsasysgp gpgmgisann qmhgqgpsqp cgavplgrmp
901 sagmqnrpfp gnmssmtpss pgmsqqggpg mgppmptvnr kaqeaaaavm qaaansagsr
961 qgsfpgmnqs glmassspys qpmnnssslm ntqappysma pamvnssaas vgladmmspg
1021 esklplplka dgkeegtpqp eskskkssss tttgekitkv yelgneperk lwvdryltfm
1081 eergspvssl pavgkkpldl frlyvcvkei gglaqvnknk kwrelatnln vgtsssaass
1141 lkkqyiqylf afeckierge eppevfstg dtkkqpklqp pspansgslq gpqtpqstgs
1201 nsmaevpgdl kpptpastph gqmtpmqggr sstisvhdpf sdvsdssfpk rnsmtpnapy
1261 qqgmsmpdvm grmpyepnkd pfggmrkvpg ssepfmtqgq mpnssmqdmy nqspsgamsn
1321 lgmgqrqqfp ygasydrrhe pygqqypgqg ppsgqppygg hqpglypqqp nykrhmdgmy
1381 gppakrhegd mynmqyssqq qemynqyggs ysgpdrrpiq gqypypysre rmqgpgqiqt
1441 hgippqmmgg plqsssegp qqnmwaarnd mpypyqnrqg pggptqappy pgmnrtddmm
1501 vpdqrinhes qwpshvsqrq pymsssasmq pitrppgpsy qtppslpnhi srapspasfq
1561 rslenrmsps kspflpsmkm qkvmptvpts qvtgpppqpp pirreitfpp gsveasqpvl
1621 kqrrkitskd ivtpeawrvm mslksgllae stwaldtini llyddstvat fnlsqlsgfl
1681 ellveyfrkc lidifgilme yevgdpsqka ldhnaarkdd sqsladdsgk eeedaecidd
1741 deedeedeee dsektesdek ssialtapda aadpkekpkq askfdklpik ivkknnlfvv
1801 drsdklgrvq efnsgllhwq lgggdttehi qthfeskmei pprrrppppl ssagrkkeqe
1861 gkgdseeqqe ksiiatiddv lsarpgalpe danpgpqtes skfpfgiqqa kshrniklle
1921 deprsrdetp lctiahwqds lakrcicvsn ivrslsfvpg ndaemskhpg lvlilgklil
1981 lhhehperkr apqtyekeed edkgvacskd ewwwdclevl rdntivtlan isgqldlsay
2041 tesiclpild gllhwmvcps aeaqdpfptv gpnsvlspqr lvleticks iqdnnvdlil
2101 atppfsrqek fyativryvg drknpvcrem smallsnlaq gdalaaraia vqkgsignli
2161 sfledgvtma qyqqsqhnlm hmqppplepp svdmmcraak allamarvde nrsefllheg
2221 rlldisisav lnslvasvic dvlfgigql SEQ ID NO: 35 Human ARID1B cDNA Sequence Variant 3 (NM_001346813.1, CDS: from 76 to 6945)

1 gggggcggcg gcgacggcgg cggcggcctg aacagtgtgc accaccaccc cctgctcccc
61 cgtcacgaac tcaacatggc ccataacgcg ggcgccgcgg ccgccgccgg cacccacagc
121 gccaagagcg gcggctccga ggcggctctc aaggagggtg gaagcgccgc cgcgctgtcc
181 tcctcctcct cctcctccgc ggcggcagcg gcggcatcct cttcctcctc gtcgggcccg
241 ggctcggcca tggagacggg gctgctcccc aaccacaaac tgaaaaccgt tggcgaagcc
301 cccgccgcgc cgccccacca gcagcaccac caccaccacc atgcccacca ccaccaccac
361 catgcccacc acctccacca ccaccacgca ctacagcagc agctaaacca gttccagcag
421 cagcagcagc agcagcaaca gcagcagcag cagcagcagc aacagcaaca tcccatttcc
481 aacaacaaca gcttgggcgg cgcgggcggc ggcgcgcctc agcccggccc cgacatggag
541 cagccgcaac atggaggcgc caaggacagt gctgcgggcg gccaggccga ccccccgggc
601 ccgccgctgc tgagcaagcc gggcgacgag gacgacgcgc cgcccaagat gggggagccg
661 gcgggcggcc gctacgagca cccgggcttg ggcgccctgg gcacgcagca gccgccggtc
721 gccgtgcccg ggggcggcgg cggcccggcg gccgtcccgg agtttaataa ttactatggc
781 agcgctgccc ctgcgagcgg cggccccggc ggccgcgctg ggccttgctt tgatcaacat
841 ggcggacaac aaagccccgg gatggggatg atgcactccg cctccgccgc cgccgccggg
901 gcccccggca gcatggaccc cctgcagaac tcccacgaag ggtaccccaa cagccagtgc
961 aaccattatc cgggctacag ccggcccggc gcgggcggcg gcggcggcgg cggcggcgga
1021 ggaggaggag gcagcggagg aggaggagga ggaggaggag caggagcagg aggagcagga
1081 gcgggagctg tggcggcggc ggccgcggcg gcggcggcag cagcaggagg cggcggcggc
1141 ggcggctatg gggctcgtc cgcggggtac ggggtgctga gctccccccg gcagcagggc
1201 ggcggcatga tgatgggccc cgggggcggc ggggccgcga gcctcagcaa ggcggccgcc
1261 ggctcggcgg cgggggcctt ccagcgcttc gccggccaga accagcaccc gtcgggggcc
1321 accccgaccc tcaatcagct gctcacctcg cccagcccca tgatgcggag ctacggcggc
1381 agctaccccg agtacagcag ccccagcgcg ccgccgccgc cgccgtcgca gccccagtcc
1441 caggcggcgg cggcgggggc ggcggcgggc ggccagcagg cggccgcggg catgggcttg
1501 ggcaaggaca tgggcgccca gtacgccgct gccagcccgg cctgggcggc cgcgcaacaa
1561 aggagtcacc cggcgatgag ccccggcacc cccggaccga ccatgggcag atcccagggc
1621 agcccaatgg atccaatggt gatgaagaga cctcagttgt atggcatggg cagtaaccct
1681 cattctcagc ctcagcagag cagtccgtac ccaggaggtt cctatggccc tccaggccca
1741 cagcggtatc caattggcat ccagggtcgg actcccgggg ccatggccgg aatgcagtac
1801 cctcagcagc agatgccacc tcagtatgga cagcaaggtg tgagtggtta ctgccagcag
1861 ggccaacagc catattacag ccagcagccg cagccccgc acctcccacc ccaggcgcag
1921 tatctgccgt cccagtccca gcagaggtac cagccgcagc aggacatgtc tcaggaaggc
1981 tatggaacta gatctcaacc tcctctggcc cccggaaaac ctaaccatga agacttgaac
2041 ttaatacagc aagaaagacc atcaagttta ccagatctgt ctggctccat tgatgacctc
2101 cccacgggaa cggaagcaac tttgagctca gcagtcagtg catccgggtc cacgagcagc
2161 caaggggatc agagcaaccc ggcgcagtcg cctttctccc cacatgcgtc ccctcatctc
2221 tccagcatcc cggggggccc atctccctct cctgttggct ctcctgtagg aagcaaccag
2281 tctcgatctg gcccaatctc tcctgcaagt atcccaggta gtcagatgcc tccgcagcca
2341 cccgggagcc agtcagaatc cagttcccat cccgccttga gccagtcacc aatgccacag
2401 gaaagaggtt ttatggcagg cacacaaaga aaccctcaga tggctcagta tggacctcaa
2461 cagacaggac catccatgtc gcctcatcct tctcctgggg gccagatgca tgctggaatc
2521 agtagctttc agcagagtaa ctcaagtggg acttacggtc cacagatgag ccagtatgga
2581 ccacaaggta actactccag acccccagcg tatagtgggg tgcccagtgc aagctacagc
2641 ggcccagggc ccggtatggg tatcagtgcc aacaaccaga tgcatggaca agggccaagc
2701 cagccatgtg gtgctgtgcc cctgggacga atgccatcag ctgggatgca gaacagacca
2761 tttcctggaa atatgagcag catgaccccc agttctcctg gcatgtctca gcagggaggg
2821 ccaggaatgg ggccgccaat gccaactgtg aaccgtaagg cacaggaggc agccgcagca TABLE 1-continued

| | | | | | | |
|---|---|---|---|---|---|---|
| 2881 | gtgatgcagg | ctgctgcgaa | ctcagcacaa | agcaggcaag | gcagtttccc | cggcatgaac |
| 2941 | cagagtggac | ttatggcttc | cagctctccc | tacagccagc | ccatgaacaa | cagctctagc |
| 3001 | ctgatgaaca | cgcaggcgcc | gccctacagc | atggcgcccg | ccatggtgaa | cagctcggca |
| 3061 | gcatctgtgg | gtcttgcaga | tatgatgtct | cctggtgaat | ccaaactgcc | cctgcctctc |
| 3121 | aaagcagacg | gcaaagaaga | aggcactcca | cagcccgaga | gcaagtcaaa | ggatagctac |
| 3181 | agctctcagg | gtatttctca | gcccccaacc | ccaggcaacc | tgccagtccc | ttccccaatg |
| 3241 | tcccccagct | ctgctagcat | ctcctcattt | catggagatg | aaagtgatag | cattagcagc |
| 3301 | ccaggctggc | caaagactcc | atcaagccct | aagtccagct | cctccaccac | tactggggag |
| 3361 | aagatcacga | aggtgtacga | gctggggaat | gagccagaga | gaaagctctg | ggtcgaccga |
| 3421 | tacctcacct | tcatggaaga | gagaggctct | cctgtctcaa | gtctgcctgc | cgtgggcaag |
| 3481 | aagcccctgg | acctgttccg | actctacgtc | tgcgtcaaag | agatcggggg | tttggcccag |
| 3541 | gttaataaaa | acaagaagtg | gcgtgagctg | gcaaccaacc | taaacgttgg | cacctcaagc |
| 3601 | agtgcagcga | gctccctgaa | aaagcagtat | attcagtacc | tgtttgcctt | tgagtgcaag |
| 3661 | atcgaacgtg | gggaggagcc | cccgccggaa | gtcttcagca | ccggggacac | caaaaagcag |
| 3721 | cccaagctcc | agccgccatc | tcctgctaac | tcgggatcct | tgcaaggccc | acagaccccc |
| 3781 | cagtcaactg | gcagcaattc | catggcagag | gttccaggtg | acctgaagcc | acctacccca |
| 3841 | gcctccaccc | ctcacggcca | gatgactcca | atgcaaggtg | gaagaagcag | tacaatcagt |
| 3901 | gtgcacgacc | cattctcaga | tgtgagtgat | tcatccttcc | cgaaacggaa | ctccatgact |
| 3961 | ccaaacgccc | cctaccagca | gggcatgagc | atgcccgatg | tgatgggcag | gatgccctat |
| 4021 | gagcccaaca | aggacccctt | tgggggaatg | agaaaagtgc | ctggaagcag | cgagcccttt |
| 4081 | atgacgcaag | gacagatgcc | caacagcagc | atgcaggaca | tgtacaacca | aagtccctcc |
| 4141 | ggagcaatgt | ctaacctggg | catggggcag | cgccagcagt | ttccctatgg | agccagttac |
| 4201 | gaccgaaggc | atgaacctta | tgggcagcag | tatccaggcc | aaggccctcc | ctcgggacag |
| 4261 | ccgccgtatg | gagggcacca | gcccggcctg | tacccacagc | agccgaatta | caaacgccat |
| 4321 | atggacggca | tgtacgggcc | cccagccaag | cgccacgagg | gcgacatgta | caacatgcag |
| 4381 | tacagcagcc | agcagcagga | gatgtacaac | cagtatggag | gctcctactc | gggcccggac |
| 4441 | cgcaggccca | tccagggcca | gtacccgtat | ccctacagca | gggagaggat | gcagggcccg |
| 4501 | gggcagatcc | agacacacgg | aatcccgcct | cagatgatgg | gcggcccgct | gcagtcgtcc |
| 4561 | tccagtgagg | ggcctcagca | gaatatgtgg | gcagcacgca | atgatatgcc | ttatccctac |
| 4621 | cagaacaggc | agggccctgg | cggccctaca | caggcgcccc | cttacccagg | catgaaccgc |
| 4681 | acagacgata | tgatggtacc | cgatcagagg | ataaatcatg | agagccagtg | gccttctcac |
| 4741 | gtcagccagc | gtcagcctta | tatgtcgtcc | tcagcctcca | tgcagcccat | cacacgccca |
| 4801 | ccacagccgt | cctaccagac | gccaccgtca | ctgccaaatc | acatctccag | ggcgcccagc |
| 4861 | ccagcgtcct | tccagcgctc | cctggagaac | cgcatgtctc | caagcaagtc | tccttttctg |
| 4921 | ccgtctatga | agatgcagaa | ggtcatgccc | acggtcccca | catcccaggt | caccgggcca |
| 4981 | ccaccccaac | cacccccaat | cagaagggag | atcacctttc | ctcctggctc | agtagaagca |
| 5041 | tcacaaccag | tcttgaaaca | aaggcgaaag | attacctcca | aagatatcgt | tactcctgag |
| 5101 | gcgtggcgtg | tgatgatgtc | ccttaaatca | ggtcttttgg | ctgagagtac | gtgggctttg |
| 5161 | gacactatta | atattcttct | gtatgatgac | agcactgttg | ctactttcaa | tctctcccag |
| 5221 | ttgtctggat | ttctcgaact | tttagtcgag | tactttagaa | aatgcctgat | tgacattttt |
| 5281 | ggaattctta | tggaatatga | agtgggagac | cccagccaaa | aagcacttga | tcacaacgca |
| 5341 | gcaaggaagg | atgacagcca | gtccttggca | gacgattctg | ggaaagagga | ggaagatgct |
| 5401 | gaatgtattg | atgacgacga | ggaagacgag | gaggatgagg | aggaagacag | cgagaagaca |
| 5461 | gaaagcgatg | aaaagagcag | catcgctctg | actgccccgg | acgccgctgc | agacccaaag |
| 5521 | gagaagccca | agcaagccag | taagttcgac | aagctgccaa | taaagatagt | caaaaagaac |
| 5581 | aacctgtttg | ttgttgaccg | atctgacaag | ttggggcgtg | tgcaggagtt | caatagtggc |
| 5641 | cttctgcact | ggcagctcgg | cgggggtgac | accaccgagc | acattcagac | tcactttgag |
| 5701 | agcaagatgg | aaattcctcc | tcgcaggcgc | ccacctcccc | ccttaagctc | cgcaggtaga |
| 5761 | aagaaagagc | aagaaggcaa | aggcgactct | gaagagcagc | aagagaaaag | catcatagca |
| 5821 | accatcgatg | acgtcctctc | tgctcggcca | ggggcattgc | ctgaagacgc | aaaccctggg |
| 5881 | ccccagaccg | aaagcagtaa | gtttcccttt | ggtatccagc | aagccaaaag | tcaccggaac |
| 5941 | atcaagctgc | tggaggacga | gcccaggagc | cgagacgaga | ctcctctgtg | taccatcgcg |
| 6001 | cactggcagg | actcgctggc | taagcgatgc | atctgtgtgt | ccaatattgt | ccgtagcttg |
| 6061 | tcattcgtgc | ctggcaatga | tgccgaaatg | tccaaacatc | caggcctggt | gctgatcctg |
| 6121 | gggaagctga | ttcttcttca | ccacgagcat | ccagagagaa | agcgagcacc | gcagacctat |
| 6181 | gagaaagagg | aggatgagga | caagggggtg | gcctgcagca | aagatgagtg | gtggtgggac |
| 6241 | tgcctcgagg | tcttgaggga | taacacgttg | gtcacgttgg | ccaacatttc | cgggcagcta |
| 6301 | gacttgtctg | cttacacgga | aagcatctgc | ttgccaattt | tggatggctt | gctgcactgg |
| 6361 | atggtgtgcc | cgtctgcaga | ggcacaagat | ccctttccaa | ctgtgggacc | caactcggtc |
| 6421 | ctgtcgcctc | agagacttgt | gctggagacc | ctctgtaaac | tcagtatcca | ggacaataat |
| 6481 | gtggacctga | tcttggccac | tcctccattt | agtcgtcagg | agaaattcta | tgctacatta |
| 6541 | gttaggtacg | ttggggatcg | caaaaaccca | gtctgtcgag | aaatgtccat | ggcgctttta |
| 6601 | tcgaaccttg | cccaagggga | cgcactagca | gcaagggcca | tagctgtgca | gaaaggaagc |
| 6661 | attggaaact | tgataagctt | cctagaggat | ggggtcacga | tggcccagta | ccagcagagc |
| 6721 | cagcacaacc | tcatgcacat | gcagcccccg | cccctggaac | cacctagcgt | agacatgatg |
| 6781 | tgcagggcgg | ccaaggcttt | gctagccatg | gccagagtgg | acgaaaaccg | ctcggaattc |
| 6841 | cttttgcacg | agggccggtt | gctggatatc | tcgatatcag | ctgtcctgaa | ctctctggtt |
| 6901 | gcatctgtca | tctgtgatgt | actgtttcag | attgggcagt | tatgacataa | gtgagaaggc |
| 6961 | aagcatgtgt | gagtgaagat | tagagggtca | catataactg | gctgttttct | gttcttgttt |
| 7021 | atccagcgta | ggaagaagga | aaagaaaatc | tttgctcctc | tgccccattc | actatttacc |
| 7081 | aattgggaat | taaagaaata | attaatttga | acagttatga | aattaatatt | tgctgtctgt |
| 7141 | gtgtataagt | acatcctttg | gggttttttt | tttctctttt | ttttaaccaa | agttgctgtc |
| 7201 | tagtgcattc | aaaggtcact | ttttgttctt | cacagatctt | tttaatgttc | tttcccatgt |
| 7261 | tgtattgcat | ttttgggggga | agcaaattga | ctttaaagaa | aaaagttgtg | gcaaaagatg |
| 7321 | ctaagatgcg | aaaatttcac | cacactgagt | caaaaaggtg | aaaaattatc | catttcctat |
| 7381 | gcgttttact | cctcagagaa | tgaaaaaaac | tgcatcccat | cacccaaagt | tctgtgcaat |
| 7441 | agaaatttct | acagatacag | gtataggggc | tcaaggaggt | atgtcggtca | gtagtcaaaa |
| 7501 | ctatgaaatg | atactggttt | ctccacagga | atatggttcc | attaggctgg | gagcaaaaac |
| 7561 | aatgtttttt | aagattgaga | atacatacct | gacaacgatc | cggaaactgc | tcctcaccac |
| 7621 | tcccgtcatg | cctgctgtcg | gcgtttgacc | ttccacgtga | cagttcttca | caattccttt |

TABLE 1-continued

```
7681 catcatttt taaatatttt ttttactgcc tatgggctgt gatgtatata gaagttgtac
7741 attaaacata ccctcatttt tttcttttct tttttttttt ttttttagt acaaagtttt
7801 agtttctttt tcatgatgtg gtaactacga agtgatggta gatttaaata atttttttatt
7861 tttattttat atattttttc attagggcca tatctccaaa aaaagaaaga aaaaatacaa
7921 aaaacaaaaa caaaaaaaaa agagggtaat gtacaagttt ctgtatgtat aaagtcatgc
7981 tcgatttcag gagagcagct gatcacaatt tgcttcatga atcaaggtgt ggaaatggtt
8041 atatatggat tgatttagaa aatggttacc agtacagtca aaaaagagaa aatgaaaaaa
8101 atacaactaa aaggaagaaa cacaacttca aagatttttc agtgatgaga atccacattt
8161 gtatttcaag ataatgtagt ttaaaaaaaa aaaaaagaaa aaaacttgat gtaaattcct
8221 ccttttcctc tggcttaatg aatatcattt attcagtata aaatctttat atgttccaca
8281 tgttaagaat aaatgtacat taaatcttgt taagcactgt gatgggtgtt cttgaatact
8341 gttctagttt ccttaaagtg gtttcctagt aatcaagtta tttacaagaa ataggggaat
8401 gcagcagtgt attcacatta taaaacccta catttggaag agacctttag gggttaccta
8461 ctttagagtg gggagcaaca gtttgatttt ctcaaattac ttagctaatt agtctttctt
8521 tgaagcaatt aactctaacg acattgaggt atgatcattt tcagtattta tgggaggtgg
8581 ctgctgaccc acttgaggtg agatctcaga agcttaactg gcctgaaaat gtaacattct
8641 gccttttact aactccatct tagtttaatc aaagttcaat ctattccttg tttcttctgt
8701 gtgcctcaga gttattttgc atttagttta ctccaccgtg tataatattt atactgtgca
8761 atgttaaaaa agaatctgtt atattgtatg tggtgtacat agtgcaaagt gatgatttct
8821 atttcagggc atattatggt tctcatattc cttcctacct ggtgcacagt agctttttaa
8881 tactagtcac ttctaattta aactttctct tcctgggtca ttgactgtta ctgtgtaata
8941 atcgatttct ttgaaactgc tgcataatta tgctgttagt ggacctctac ctcttctctt
9001 ccctctccca atcacagtat actcagaatc cccagcccct cgcatacatt gtgtcggttc
9061 acattactca cagtaatata tggaagagtt agacaagaac atgcagttac agtcattgtg
9121 agacgtgact ctccagtgtc acgaggaaaa aaatcatctt ttctgcaaac agtctctcat
9181 ctgtcaactc ccacattact gagtcaaaca gtcttcttac ataacaatgc aaccaaatat
9241 atgttgaatt aaagacccat ttataattct gctttaaata catctgcttg ctaagaacag
9301 atttcagtgc tccaagcttc aaatatggag atttgtaaga gggaattcaa tattattcta
9361 atttctctct tacagagtac aaataaaagg tgtatacaaa ctccgaacat atccagtatt
9421 ccaattcctt tgtcaatcag aagagtaaaa taattaacaa aagactgttg ttatggtttg
9481 cattgtaacc gatacgcaga gtctgaccgt tgggcaacaa gtttttctat cctgatgcgc
9541 aacacagtct ctagagacta atccaggaag actttagcct cctttccata ttctcacccc
9601 cgaatcaaga tttacagaag cccacgaaga atttacagcc tgcttgagat catcttgcct
9661 ataaactgag ttattgcttt gtcctaaaaa ttagtcggtt tttttttttc tatgaggctt
9721 ttcagaaatt tacaggatgc ccagacttta catgtgtacc aaaaaaaaaa aaaagataaa
9781 aaataaaggt gcaaagaaag tttagtattt tggaatggtg ctataaagtt gaa
```

SEQ ID NO: 36 Human ARID1B Amino Acid Sequence isoform C NP_001333742.1)

```
   1 mahnagaaaa agthsaksgg seaalkeggs aaalssssss saaaaaasss sssgpgsame
  61 tgllpnhklk tvgeapaapp hqqhhhhhha hhhhhhahhl hhhhalggql ngfqqqqqqg
 121 ggqqqqqqqg ghpisnnnsl ggagggapqp gpdmegpqhg gakdsaaggq adppgpplls
 181 kpgdeddapp kmgepaggry ehpglgalgt qqppvavpgg gggpaavpef nnyygsaapa
 241 sggpggragp cfdqhggqqs pgmgmmhsas aaaagapgsm dplqnshegy pnsqcnhypg
 301 ysrpgagggg gggggggggs gggggggggag aggagagava aaaaaaaaaa gggggggygg
 361 ssagygvlss prqqgggmmm gpggggaasl skaaagsaag gfgrfagqnq hpsgatptln
 421 qlltspspmm rsyggsypey sspsappppp sgpqsqaaaa gaaaggqqaa agmglgkdmg
 481 aqyaaaspaw aaaqqrshpa mspgtpgptm grsqgspmdp mvmkrpqlyg mgsnphsqpq
 541 qsspypggsy gppgpqrypi giqgrtpgam agmgypqqqm ppqygqqgvs gycqqgqqpy
 601 ysqqpqpphl ppgaqylpsq sqqrygpqqd msqegygtrs qpplapgkpn hedlnliqqe
 661 rpsslpdlsg siddlptgte atlssavsas gstssqgdqs npaqspfsph asphlssipg
 721 gpspspvgsp vgsnqsrsgp ispasipgsq mppgppgsgs essshpalsq spmpqergfm
 781 agtqrnpqma qygpqqtgps msphpspggq mhagissfqq snssgtygpq msqygpqgny
 841 srppaysgvp sasysgpgpg mgisannqmh gqgpsqpcga vplgrmpsag mqnrpfpgnm
 901 ssmtpsspgm sqqggpgmgp pmptvnrkaq eaaaavmqaa ansaqsrqgs fpgmnqsglm
 961 assspysgpm nnssslmntq appysmapam vnssaasvgl admmspgesk lplplkadgk
1021 eegtpqpesk skdsyssqgi sqpptpgnlp vpspmspssa sissfhgdes dsisspgwpk
1081 tpsspkssss tttgekitkv yelgneperk lwvdryltfm eergspvssl pavgkkpldl
1141 frlyvcvkei gglaqvnknk kwrelatnln vgtsssaass lkkgyigylf afeckierge
1201 epppevfstg dtkkqpklqp pspansgslq gpqtpqstgs nsmaevpgdl kpptpastph
1261 gqmtpmqggr sstisvhdpf sdvsdssfpk rnsmtpnapy qqgmsmpdvm grmpyepnkd
1321 pfggmrkvpg ssepfmtqgq mpnssmqdmy nqspsgamsn lgmgqrqqfp ygasydrrhe
1381 pygqqypgqg ppsgqppygg hqpglypqqp nykrhmdgmy gppakrhegd mynmgyssqg
1441 qemynqyggs ysgpdrrpiq gqypypysre rmqgpgqiqt hgippqmmgg plqssssegp
1501 qqnmwaarnd mpypyqnrqg pggptqappy pgmnrtddmm vpdqrinhes qwpshvsqrq
1561 pymsssasmq pitrppgpsy qtppslpnhi srapspasfq rslenrmsps kspflpsmkm
1621 qkvmptvpts qvtgpppqpp pirreitfpp gsveasqpvl kqrrkitskd ivtpeawrvm
1681 mslksgllae stwaldtini llyddstvat fnlsqlsgfl ellveyfrkc lidifgilme
1741 yevgdpsqka ldhnaarkdd sqsladdsgk eeedaecidd deedeedeee dsektesdek
1801 ssialtapda aadpkekpkq askfdklpik ivkknnlfvv drsdklgrvq efnsgllhwq
1861 lgggdttehi qthfeskmei pprrrppppl ssagrkkeqe gkgdseeqqe ksiiatiddv
1921 lsarpgalpe danpgpqtes skfpfgiqqa kshrniklle deprsrdetp lctiahwqds
1981 lakrcicvsn ivrslsfvpg ndaemskhpg lvlilgklil lhhehperkr apqtyekeed
2041 edkgvacskd ewwwdclevl rdntivtlan isgqldlsay tesiclpild gllhwmvcps
2101 aeaqdpfptv gpnsvlspqr lvletickls iqdnnvdlil atppfsrqek fyativryvg
2161 drknpvcrem smallsnlaq gdalaararaia vqkgsignli sfledgvtma qyqqsqhnlm
2221 hmqppplepp svdmmcraak allamarvde nrsefllheg rlldisisav lnslvasvic
2281 dvlfqigql
```

TABLE 1-continued

SEQ ID NO: 37 Mouse ARID1B cDNA Sequence (NM_001085355.1, CDS: from 22 to 6756)

```
   1 tcggcgggcc ccggctcgac catggagacc gggctgctcc ccaaccacaa actgaaagcc
  61 gttggcgagg cccccgctgc accgccccat cagcagcacc accaccacca tgcccaccac
 121 caccaccacc accatgccca ccacctccac cacctccacc accaccacgc actacagcag
 181 cagctaaacc agttccagca gccgcagccg ccgcagccac agcagcagca gccgccgcca
 241 ccgccgcagc agcagcatcc cactgccaac aacagcctgg gcggtgcggg cggcggcgcg
 301 cctcagcccg gcccggacat ggagcagccg caacatggag gcgccaagga cagtgtcgcg
 361 ggcaatcagg ctgacccgca gggccagcct ctgctgagca aaccgggcga cgaggacgac
 421 gcgccgccca agatggggga gccggcgggc agccgctatg agcacccggg cctgggcgcg
 481 cagcagcagc ccgcgccggt cgccgtgccc gggggcggcg gcggcccagc ggccgtctcg
 541 gagtttaata attactatgg cagcgctgcc cctgctagcg gcggccccgg cggccgcgct
 601 gggccttgct ttgatcaaca tggcggacaa caaagccccg ggatggggat gatgcactcc
 661 gcctctgccg ccgccggggc ccccagcagc atggaccccc tgcagaactc ccacgaaggg
 721 taccccaaca gccagtacaa ccattatccg ggctacagcc ggcccggcgc gggcggcggc
 781 ggcggcggcg gcggaggagg aggaggcagc ggaggaggtg gaggaggagg aggagcagga
 841 ggagcaggag gagcagcggc agcggcagca ggagccggag ctgtggcggc ggcggccgcg
 901 gcggcggcgg cagcagcagc agcagcagga ggaggcggtg gcggcggcta tgggagctcg
 961 tcctcggggt acggggtgct gagctccccg cggcagcagg gcggcggcat gatgatgggc
1021 cccgggggcg gcggggccgc gagcctcagc aaggcggccg ccggcgcggc ggcggcggcg
1081 gggggcttcc agcgcttcgc cggccagaac cagcacccgt cgggggctac accgaccctc
1141 aaccagctgc tcacctcacc cagccccatg atgaggagct acggcggtag ctaccccgac
1201 tacagcagct ccagcgcgcc gccgccgccg tcgcagcccc agtcccaggc ggcggcgggg
1261 gcggcggcgg gtggccagca ggcggccgcg ggcatgggct tgggcaagga cctaggcgcc
1321 cagtacgccg ctgccagccc ggcctgggcg gccgcgcaac aaaggagtca cccggcgatg
1381 agccccggca cccccggacc gaccatgggc agatcccagg gcagcccgat ggacccaatg
1441 gtgatgaaga gacctcagtt gtatgggatg ggtactcacc cccactccca gccacagcag
1501 agcagcccat acccaggagg ctcctacggt cccccaggtg cacagcggta tccccttggc
1561 atgcagggcc gggctccagg ggccctggga ggcttgcagt acccgcagca gcagatgcca
1621 ccgcagtacg gacagcaagc tgtgagtggc tactgccagc aaggccagca gccatactac
1681 aaccagcagc cgcagccctc gcacctcccg ccccaggcac agtacctgca gccggcggcg
1741 gcgcagtccc agcagaggta ccagccacag caggacatgt ctcaagaagg ctatggaact
1801 agatctcagc ctcctctggc ccctggaaaa tccaaccatg aagacttgaa tttaattcaa
1861 caggaaagac catcgagtct accagacctg tctggctcca tcgatgacct ccccacggga
1921 acagaagcaa ctctgagctc agcagtcagt gcatccgggt ctacaagcag ccagggagat
1981 cagagcaacc cagcgcagtc tcctttctcc ccacatgcat cacctcacct ctccagcatc
2041 cctggagggc cgtcaccttc tcctgttggc tctcctgtgg gaagcaacca atcgaggtct
2101 ggtccgatct cccctgcgag tattccaggt agccagatgc ctccgcaacc acctggaagc
2161 cagtcagaat ccagttccca tcctgccttg agccagtcac caatgccaca ggaaagaggt
2221 tttatgacag gcactcagag aaaccctcag atgtctcagt acggacctca gcagacagga
2281 ccatccatgt cgcctcaccc atctcctggg ggccagatgc atcctgggat cagtaacttt
2341 cagcagagta actcaagtgg cacgtacggc ccacagatga gccagtatgg accccaaggc
2401 aactactcca gaaccccaac atatagcggg gtacccagtg caagctacag cggcccaggg
2461 cccggtatgg gcatcaatgc caacaaccag atgcatggac aagggccagc ccagccatgt
2521 ggtgctatgc ccctgggacg aatgccttca gctgggatgc agaacagacc atttcctgga
2581 accatgagca gcgtcacccc cagttctcct ggcatgtctc aacagggagg gccaggaatg
2641 ggcccaccaa tgcccactgt gaaccggaag gcccaggaag ctgccgcagc tgtgatgcag
2701 gctgctgcaa actcagcaca aagcaggcaa ggcagttttc ctggcatgaa ccagagtggc
2761 ctggtggcct ccagctctcc ctacagccag tccatgaaca acaactccag cctgatgagc
2821 acccaggccc agccctacag catgacgccc acaatggtga acagctccac agcatctatg
2881 ggtcttgcag atatgatgtc tcccagtgag tccaaattgt ctgtgcctct taaagcagat
2941 ggtaaagaag aaggcgtgtc ccagcctgag agcaagtcaa aggacagcta tggctctcag
3001 ggcatttccc agcctccaac cccaggcaac ctgcctgtcc cttccccaat gtctcccagc
3061 tctgccagca tctcctcctt tcatggagat gagagtgaca gcattagcag cccaggctgg
3121 cccaagacac catcaagccc taagtccagc tcttcctcca ccactgggga gaagatcacg
3181 aaggtctatg agctggggaa tgagccggag aggaagctgt gggtcgaccg ttacctaacg
3241 ttcatggaag agaggggctc cccggtgtcc agtctgccag cagtgggcaa gaagcccctg
3301 gacctgttcc gactgtatgt ctgcgtcaag gagattggag gtttggcgca ggttaataaa
3361 aacaagaagt ggcgtgagct ggcaaccaac ctgaacgttg gcacttccag cagcgcagcc
3421 agctctctga aaaagcagta tattcagtac ctgttcgcct ttgagtgcaa aactgagcgc
3481 ggggaggagc ccccacctga agtcttcagc accggggatt cgaagaagca gccaaagctc
3541 cagccgccat ctcctgctaa ctcaggatcc ttacaaggcc cacagactcc acagtcaact
3601 gggagcaatt cgatggcaga ggttccaggt gacctgaagc caccaacccc agcctctacc
3661 cctcatggac agatgactcc catgcaaagc ggaagaagca gtacagtcag tgtgcatgac
3721 ccgttctcag acgtgagtga ctcagcgtac ccaaaacgga actccatgac tccaaacgcc
3781 ccataccagc agggcatggg catgccagac atgatgggca ggatgcccta tgaacccaac
3841 aaggaccctt tcagtggaat gagaaaagtg cctggaagta gtgagccctt tatgacacaa
3901 ggacaggtgc ccaacagcgg catgcaggac atgtacaacc agagcccctc aggggccatg
3961 tccaatctgg gcatgggaca gcggcagcag tttccctatg gaaccagtta tgaccgaagg
4021 catgaggctt acggacagca gtacccaggc caaggccctc ccacaggaca gccaccgtat
4081 ggaggacacc agcctggcct gtacccacag cagccgaatt acaaacgtca tatggatggc
4141 atgtacgggc ctccagccaa gcggcacgag ggagacatgt acaacatgca gtatggcagc
4201 cagcagcagg agatgtataa ccagtatgga ggctcctact ctggcccgga cagaaggccc
4261 atccagggac aatatcccta cccctacaac agagaaagga tgcagggccc aggccagatg
4321 cagccacacg gaatcccacc tcagatgatg gggggcccca tgcagtcatc ctccagcgag
4381 gggcctcagc agaacatgtg ggctacacgc aacgatatgc cttatcccta ccagagcagg
4441 caaggcccgg gcggccctgc acaggccccc ccttacccag gcatgaaccg cacagatgat
4501 atgatggtac ctgagcagag gatcaatcac gagagccagt ggccttctca cgtcagccag
4561 cgccagcctt acatgtcatc ttcggcctcc atgcagccca tcacgcgccc acctcagtca
4621 tcctaccaga cgccgccgtc actgccaaac cacatctcca gggcacccag ccccgcctcc
```

TABLE 1-continued

| | | | | | | |
|---|---|---|---|---|---|---|
| 4681 | ttccagcgct | ccctggagag | tcgcatgtct | ccaagcaagt | ctcccttcct | gcccaccatg |
| 4741 | aagatgcaga | aggtcatgcc | cacagtcccc | acatcccagg | tcaccgggcc | ccccccacag |
| 4801 | cctccaccaa | tcagaaggga | gattaccttt | cctcctggct | ccgtagaagc | atcacagcca |
| 4861 | atcctgaaac | aaaggcgaaa | gattacctca | aaagatattg | ttactcccga | ggcgtggcgt |
| 4921 | gtgatgatgt | cccttaaatc | gggtctgttg | gctgagagca | cgtgggctct | ggacaccatc |
| 4981 | aatattctcc | tctatgatga | cagcaccgtc | gccaccttca | atctttccca | gctgtctgga |
| 5041 | ttcctggaac | tattagtaga | gtactttcga | aaatgcctaa | ttgacatttt | cggaattctt |
| 5101 | atggaatatg | aagtgggtga | ccccagccaa | aaggctcttg | atcaccgttc | agggaagaaa |
| 5161 | gatgacagcc | agtccctgga | agatgattct | gggaaggaag | acgatgatgc | tgagtgtctt |
| 5221 | gtggaagagg | aggaggagga | agaggaggag | gaggaagaca | gtgaaaagat | agagtcagag |
| 5281 | gggaagagca | gccctgccct | agctgctcca | gatgcctccg | tggaccccaa | ggagacgcca |
| 5341 | aagcaggcca | gtaagtttga | caagctgccc | ataaagattg | tcaaaaagaa | caagctgttt |
| 5401 | gtggtggacc | ggtccgacaa | gctgggccga | gtgcaggagt | tcagcagcgg | gctcctccac |
| 5461 | tggcagctgg | gtggtggcga | cactaccgag | cacatccaga | ctcacttcga | gagcaagatg |
| 5521 | gagatccctc | ctcgcaggcg | tccacctccg | cctctaagct | ccacgggtaa | gaagaaagag |
| 5581 | ctggaaggca | aaggtgattc | tgaagagcag | ccagagaaaa | gtatcatagc | caccatcgat |
| 5641 | gacgtcttgt | ctgcccggcc | aggggctctg | cctgaagaca | ccaacccagg | accccagacc |
| 5701 | gacagcggca | agtttccctt | tggaatccag | caggccaaaa | gccaccggaa | catcaggctc |
| 5761 | ctggaagacg | agcccaggag | ccgagacgag | acgccgctgt | gcaccatcgc | gcactggcag |
| 5821 | gactcactgg | ccaagcgctg | catctgtgtg | tcgaacatcg | tgcggagctt | gtctttcgtg |
| 5881 | cctggcaacg | acgcagagat | gtccaaacac | ccgggcttgg | tgctgatcct | gggaaagctg |
| 5941 | attctgctgc | atcacgagca | tccggagaga | aagcgggcgc | cacagaccta | tgagaaggag |
| 6001 | gaggacgagg | acaagggggt | ggcctgcagc | aaagatgagt | ggtggtggga | ctgcctcgag |
| 6061 | gtcttgcggg | ataacaccct | ggtcacgttg | gcgaacattt | ccgggcagct | agacttgtct |
| 6121 | gcttacacag | agagcatctg | cttgccgatc | ctggacggct | tgctacactg | gatggtgtgc |
| 6181 | ccgtccgcag | aggctcagga | ccccttcccc | actgtggggc | ccaactcagt | cctgtcgccg |
| 6241 | cagagacttg | tgctggagac | cctgtgtaaa | ctcagtatcc | aggacaacaa | cgtggacctg |
| 6301 | atcttggcca | cgcctccatt | tagtcgtcag | gagaaatttt | atgctacatt | agttaggtac |
| 6361 | gttggggatc | gcaaaaatcc | agtctgtcga | gaaatgtcca | tggcgctttt | atcgaacctt |
| 6421 | gcccaggggg | acacactggc | ggcgagggca | atagctgtgc | agaaaggaag | cattggtaac |
| 6481 | ttgataagct | tcctagagga | cgggggtgacg | atggcgcagt | accagcagag | ccagcataac |
| 6541 | cttatgcaca | tgcagccccc | acctctggaa | cccccctagtg | tagacatgat | gtgccgggcg |
| 6601 | gccaaagctc | tgctggccat | ggccagagtg | gacgagaacc | gctcggagtt | ccttttgcac |
| 6661 | gagggtcggt | tgctggatat | ctcaatatca | gctgtcctga | actctctggt | tgcatctgtc |
| 6721 | atctgtgatg | tactgtttca | gattgggcag | ttatgacatc | cgtgaaggca | cacatgtgtg |
| 6781 | agtgaacatt | agagggtcac | atataactgg | ctgttttctg | ttctcgttta | tccagtgtaa |
| 6841 | gaagaaggaa | aagaaaaatc | tttgctcctc | tgccccgttt | actatttacc | aattgggaat |
| 6901 | taaatcatta | atttgaacag | ttataaaatt | aatatttgct | gtctgtgtgt | ataagtacat |
| 6961 | cctctggcgg | ttttctgttt | ctttttttt | taaccaaagt | tgccgtctag | tgcattcaaa |
| 7021 | ggtcacaatt | tttgtttgtt | tgtttgtttg | tttgtttttt | cataattttt | ttcatgttgt |
| 7081 | attgcagtct | ttgggaagtg | aattgacttt | ataaagaaaa | acgttttggc | aaaaagtgct |
| 7141 | aagatagaaa | aatgtcacca | cactgggtca | aaaacgtgaa | aggaaaaatt | gattcttaaa |
| 7201 | ttgatttcct | atgaatttta | ttcttcacag | aatgataaaa | gctaaactgc | accccgtcac |
| 7261 | ccaaagctct | gtgcaataga | aacttctaga | gatatagtgt | aggggctgaa | ggaggtatgg |
| 7321 | cagcagtagt | cagggtcaat | gatactgctt | tctccaccgg | aaagtggtta | cgttaggcct |
| 7381 | cgagcaaaaa | acagcgctct | cagataggtg | caaaaatcca | ctcctagcag | ccaacagcag |
| 7441 | gatcgcttcc | tcaccacgac | cgccatgtct | gctgtggctc | agcctccacg | ggacaaagct |
| 7501 | tcaagatttc | tttcatcatt | tttttaaata | ttttttttac | tgcctatggg | ctgtgatgta |
| 7561 | tatagaagtt | gtacattaaa | cataccctca | tttttttctt | cttttctttt | tttctttttt |
| 7621 | tctttttctt | tttttttttt | tttagtacaa | agtttttagt | ttctttttca | tgatgtggta |
| 7681 | actacgaagt | gatggtagat | ttaaataatt | ttttattttt | attttatata | tttttttcatt |
| 7741 | aggaccatat | ctccaaaaaa | caagaaaaag | aaacaaaaaa | tacaaaaaat | aaaaacaaac |
| 7801 | aaaaaaagag | ggtaatgtac | aagtttctgt | atgtataaag | tcatgctctg | ttgggagagc |
| 7861 | ggctgatccc | agtttgcttc | atgaatcaaa | gtgtggaaat | ggttgcatac | agattgattt |
| 7921 | agaaaatgga | caccagtaca | tacaaaaaaa | gaaaaaagaa | agaaaaccaa | ctaaatggaa |
| 7981 | gaaacacaac | ttcaaagatt | tttctgtgac | aagaatccac | atttgtattt | caagataatg |
| 8041 | tagtttaaga | aaagaaaaaa | aagaaaaaaa | aagaaaaaaa | cttgatgtaa | attcctcctt |
| 8101 | ttcctctggc | ttaatgaata | tcatttattc | agtataaaat | ctttatatgt | cccacatgtt |
| 8161 | aagaataaat | gtacattaaa | tcttgttacg | cactgtgatg | ggtgttcttg | aatgctgttc |
| 8221 | tagtttgcct | agcatggttg | ccatagtaac | caagttattt | acaggaaata | gggaagatgt |
| 8281 | aacaactgct | tcctggtaat | gatgcccaaa | ggccagaagg | gactttcagg | gtttcctact |
| 8341 | tgagagtggg | agcaacaatt | tgattttctc | agattgttta | gctaattagg | tcttctttga |
| 8401 | agcaattaac | tctggtgaca | ttgagaagtg | gtaattccct | catggatggg | tggtggctgc |
| 8461 | caacccactg | tgacatgggg | ccctgcaagc | taactggcct | gaaaccacga | ccttctgcct |
| 8521 | ctcactactg | atttaaccca | agtctgcacc | cgtcatgttt | cttctgtgtg | cctccaagtt |
| 8581 | actctgcgtt | agtttgctcc | agcgtgtata | atatttatat | tgtgcaatgt | taaagagaac |
| 8641 | gtgtcatatt | gtatgccgtg | tgtatagtgc | caagtgatga | ttctgtttca | gagcatacct |
| 8701 | tccttcctgc | ccagtccctg | gctctctaat | accccaccct | gatggaaagt | gcttcttcct |
| 8761 | gggtaattga | ctgttactgt | gtaacgctca | gtctcattga | aacttacata | accatgctgc |
| 8821 | tggtgcccct | tcctacccta | cctctctcag | cactcttcag | ttgacacttc | ccacacctgt |
| 8881 | cactgtggcc | caccttgctc | acgctgacat | ctggaagagt | tagacaggag | cacacactta |
| 8941 | caacactagg | agatgttatt | ctggtgtcac | gagaaagaaa | ttggtttttc | ctgcaaacag |
| 9001 | tcccatcacc | aagcagcccc | cacatcaggt | cagcaaaaag | atctgtgttg | aatcaaaact |
| 9061 | ccatttataa | ttctactaga | tgggaataca | tctgcttaca | aaggacagat | tttagtgttc |
| 9121 | tgtgatgaaa | atatggagag | tgcaagagag | agttcaatgg | aatcctaatc | ttgctcttgc |
| 9181 | agacaatgaa | tgaaaggtat | agacaggctc | agttccctgt | cagaagagtg | gtctcaaaga |
| 9241 | caagtggctg | tatagcagcc | aggcccagaa | cagcctcgca | gcacacacta | acaccaagcg |
| 9301 | ggtgtctgag | ctctcctagg | aagccttgtg | cctgccctcc | ctccattcac | ccagatccga |
| 9361 | ctcctggaag | cccacgaaag | agtcaccctt | tgcttcacat | ttcctgacga | taccgagttg |
| 9421 | ctgctctgtc | ctaaaaatat | tagttctttt | ccagggcttt | cagaaatttg | caggatgccc |

TABLE 1-continued 9481 atactctaaa tgtgtaccaa aaagagagag aaataaaggt gcgaagaaag tttagtattt
9541 tggaatggtg cgataaaatg gaatctgttg gtttttaatg taacataaga tactattggc
9601 tggcactggc taaaaaaaat atctaagtgt tggagttgga tgcacaatca acttttactt
9661 agctattcaa agagtactta tgttttccaa gttaaaacag acttgttttt gacaggggcc
9721 gtgggtggtc ttatacaatg ccagctccta actgcagctt ctgagaactg gatatcgttt
9781 gccctgagag ctgcccgtct ccaactatgt gctgctgctg ccctgtgtgc tcagcccaca
9841 aggatgtgga gactggatag acaacccctt gcttcttgct gggttgtgct gagttctttg
9901 cagtccagtc aagtgcccag agctaccagc ctacgtccct catgcatcca agagaaatga
9961 tcttgactat catgatcaaa acagctgtag taatatttct agtaaatatt tctgatgact
10021 ctgtgtaatc tcctacaaca ggacactatt cattaacttg acagagacat gtgggcatgt
10081 ggtcctgctt tagtttaaca gacaagtcaa ccagttctca ttacttagga agagtgaggc
10141 tatgtctgtt acaatcccaa tgtggtgctt gcccttatcc aaagacagtc cgggggccct
10201 gtctgcctga actatgtctc gctccctctt gggcttccca ctgggatgtg aaaagataac
10261 caatggctcc caggttccca gtgcccccca aaccagtaat caggtctggg actacagaac
10321 ccgcaaaatc atacacaggc tgtttcaaag ccagtactct ctttatactc ctgcttcctc
10381 cagcccccat ttcacacccc acccaaatca caaggtcctc tgaagtctca gaactccaaa
10441 ttaacgttgg gatttacgat gtgaatgctg aggagaaaat tgggagttgg tgggagatca
10501 ccaaattgtc aaaactatga aactcatctg tcttcccaaa tctgacctca gggacttggg
10561 gggttcactc tggcttctgc cacagtattt tctggggaac caaaggcctc gggaatagag
10621 aaacaggttg ccggatatcc tggaagtcta agccatactg accagtttgt cttgagtgtt
10681 ttctttgtga gcctggaact gtccccggac ccctttcttt taaacatggt tcaggacttt
10741 aaaaaaaagc actgtatttt ttttatgtaa gccaagatgc cctccctagc agagatagcg
10801 ttgaactgtc tctagttctg tagcctgaga gacttaaatc gtttaacttc agtgtctttg
10861 tccactctgt tgaactgcta aggattctat tgaatgtgtt ctttgcggct ttggaggagt
10921 tgctgggtgt gtaagtcctg catccctttg cctggtatgt gtatattatt cctttgcctg
10981 gctgtgtatc gttcttcagt gtaagtacac ccacactctg tattcctttg cctgctcccc
11041 gcccccccac acacacacat cctgcatagt tttaaaataa ggcctgagag actgtttcta
11101 tttcctgtca tagctggtga cttttaacag ttgaggcgaa tggcctgtca cttgcctggg
11161 ttcccgtcag ggtgatcca tggaactcct cagtggaaca gaatttagga cagaagatcc
11221 caccttcctt ccaggcctgg ggagaatcag actgtgagat aaaccatgat gctgcccaat
11281 cccactgccc caccttgctt ttaaaataaa gtgcctccta acgtc SEQ ID NO: 38 Mouse ARID1B Amino Acid Sequence (NP_001078824.1)
1 metgllpnhk lkavgeapaa pphqqhhhhh ahhhhhhhah hlhhlhhhha lqqqlnqfqg
61 pqppqpqqqq pppppqqqhp tannslggag ggapqpgpdm eqpqhggakd svagnqadpq
121 gqpllskpgd eddappkmge pagsryehpg lgaqqqpapv avpgggggpa aysefnnyyg
181 saapasggpg gragpcfdqh ggqqspgmgm mhsasaaaga pssmdplqns hegypnsqyn
241 hypgysrpga gggggggggg ggsggggggg gaggaggaaa aaagagavaa aaaaaaaaaa
301 aagggggggy gssssgygvl ssprqqgggm mmgpggggaa slskaaagaa aaaggfqrfa
361 gqnqhpsgat ptlnqlltsp spmmrsyggs ypdyssssap pppsqpqsqa aagaaaggqq
421 aaagmglgkd lgaqyaaasp awaaaqqrsh pamspgtpgp tmgrsqgspm dpmvmkrpql
481 ygmgthphsq pqqsspypgg sygppgaqry plgmqgrapg algglqypqq qmppqygqqa
541 vsgycqqgqq pyynqqpqps hlppgagylq paaaqsqqry qpqqdmsqeg ygtrsqppla
601 pgksnhedln liqqerpssl pdlsgsiddl ptgteatlss aysasgstss qgdqsnpaqs
661 pfsphasphl ssipggpsps pvgspvgsnq srsgpispas ipgsqmppqp pgsqsesssh
721 palsqspmpq ergfmtgtqr npqmsqygpq qtgpsmsphp spggqmhpgi snfqqsnssg
781 tygpqmsqyg pqgnysrtpt ysgvpsasys gpgpgmgina nnqmhgqgpa qpcgamplgr
841 mpsagmqnrp fpgtmssvtp sspgmsqqgg pgmgppmptv nrkaqeaaaa vmqaaansaq
901 srqgsfpgmn qsglvasssp ysqsmnnnss lmstqaqpys mtptmvnsst asmgladmms
961 psesklsvpl kadgkeegvs qpeskskdsy gsqgisqppt pgnlpvpspm spssasissf
1021 hgdesdsiss pgwpktpssp ksssssttge kitkvyelgn eperklwvdr yltfmeergs
1081 pvsslpavgk kpldlfrlyv cvkeigglaq vnknkkwrel atnlnvgtss saasslkkqy
1141 iqylfafeck tergeepppe vfstgdskkq pklqppspan sgslqgpqtp qstgsnsmae
1201 vpgdlkpptp astphgqmtp mqsgrsstvs vhdpfsdvsd saypkrnsmt pnapyqqgmg
1261 mpdmmgrmpy epnkdpfsgm rkvpgssepf mtqgqvpnsg mgdmyngsps gamsnlgmgq
1321 rqqfpygtsy drrheaygqq ypgqgpptgq ppygghqpgl ypqqpnykrh mdgmygppak
1381 rhegdmynmq ygsqqqemyn qyggsysgpd rrpiqgqypy pynrermqgp gqmqphgipp
1441 qmmggpmqss ssegpqqnmw atrndmpypy qsrqgpggpa qappypgmnr tddmmvpeqr
1501 inhesqwpsh vsqrqpymss sasmqpitrp pqssyqtpps lpnhisraps pasfqrsles
1561 rmspskspfl ptmkmqkvmp tvptsqvtgp ppqpppirre itfppgsvea sqpilkqrrk
1621 itskdivtpe awrvmmslks gllaestwal dtinillydd stvatfnlsq lsgflellve
1681 yfrkclidif gilmeyevgd psqkaldhrs gkkddsgsle ddsgkeddda eclveeeeee
1741 eeeeedseki esegksspal aapdasvdpk etpkqaskfd klpikivkkn klfvvdrsdk
1801 lgrvqefssg llhwqlgggd ttehigthfe skmeipprrr ppppl sstgk kkelegkgds
1861 eeqpeksiia tiddvlsarp galpedtnpg pqtdsgkfpf giqqakshrn irlledeprs
1921 rdetplctia hwqdslakrc icvsnivrsl sfvpgndaem skhpglvlil gklillhheh
1981 perkrapqty ekeededkgv acskdewwwd clevlrdntl vtlanisgql dlsaytesic
2041 1pildgllhw mvcpsaeaqd pfptvgpnsv lspqrlvlet lcklsiqdnn vdlilatppf
2101 srgekfyatl vryvgdrknp vcremsmall snlaqgdtla araiavqkgs ignlisfled
2161 gvtmagyqqs qhnlmhmqpp pleppsvdmm craakallam arvdenrsef llhegrlldi
2221 sisavinslv asvicdvlfq igql SEQ ID NO: 39 Human SMARCC1 cDNA Sequence (NM_003074.3, CDS: 119-3436)
1 ctgggcgggg ccgggaagcg gcagtggcgg ctacgcgcgc gggggtgcgc gcgggaacga
61 ccgggaaaca ccgcgagggc cggggtgggc caggctgtgg ggacgacggg ctgcgacgat
121 ggccgcagcg gcgggcggcg gcgggccggg gacagcggta ggcgccacgg gctcggggat
181 tgcggcggca gccgcaggcc tagctgttta tcgacggaag gatgggggcc cggccaccaa
241 gttttgggag agcccggaga cggtgtccca gctggattcg gtgcgggtct ggctgggcaa
301 gcactacaag aagtatgttc atgcggatgc tcctaccaat aaaacactgg ctgggctggt
361 ggtgcagctt cttcagttcc aggaagatgc ctttgggaag catgtcacca acccggcctt TABLE 1-continued

| | | | | | | |
|---|---|---|---|---|---|---|
| 421 | caccaaactc | cctgcaaagt | gtttcatgga | tttcaaagct | ggaggcgcct | tatgtcacat |
| 481 | tcttggggct | gcttacaagt | ataaaaatga | acagggatgg | cggaggtttg | acctacagaa |
| 541 | cccatctcga | atggatcgta | atgtggaaat | gtttatgaac | attgaaaaaa | cattggtgca |
| 601 | gaacaattgt | ttgaccagac | ccaacatcta | cctcattcca | gacattgatc | tgaagttggc |
| 661 | taacaaattg | aaagatatca | tcaaacgaca | tcagggaaca | tttacggatg | agaagtcaaa |
| 721 | agcttcccac | cacatttacc | catattcttc | ctcacaagac | gatgaagaat | ggttgagacc |
| 781 | ggtgatgaga | aaagagaagc | aagtgttagt | gcattggggc | ttttacccag | acagctatga |
| 841 | tacttgggtc | catagtaatg | atgttgatgc | tgaaattgaa | gatccaccaa | ttccagaaaa |
| 901 | accatggaag | gttcatgtga | aatggatttt | ggacactgat | attttcaatg | aatggatgaa |
| 961 | tgaggaggat | tatgaggtgg | atgaaaatag | gaagcctgtg | agttttcgtc | agcggatttc |
| 1021 | aaccaagaat | gaagagccag | tcagaagtcc | agaaagaaga | gatagaaaag | catcagctaa |
| 1081 | tgctcgaaag | aggaaacatt | cgccttcgcc | tccccctccg | acaccaacag | aatcacggaa |
| 1141 | gaagagtggg | aagaaaggcc | aagctagcct | ttatgggaag | cgcagaagtc | agaaagagga |
| 1201 | agatgagcaa | gaagatctaa | ccaaggatat | ggaagaccca | acacctgtac | ccaatataga |
| 1261 | agaagtagta | cttcccaaaa | atgtgaacct | aaagaaagat | agtgaaaata | cacctgttaa |
| 1321 | aggaggaact | gtagcggatc | tagatgagca | ggatgaagaa | acagtcacag | caggaggaaa |
| 1381 | ggaagatgaa | gatcctgcca | aaggtgatca | gagtcgatca | gttgaccttg | ggaagataa |
| 1441 | tgtgacagag | cagaccaatc | acattattat | tcctagttat | gcatcatggt | ttgattataa |
| 1501 | ctgtattcat | gtgattgaac | ggcgtgctct | tcctgagttc | ttcaatggaa | aaaacaaatc |
| 1561 | caagactcca | gaaatatact | tggcatatcg | aaattttatg | attgacacgt | atcgtctaaa |
| 1621 | cccccaagag | tatttaacta | gcactgcttg | tcggaggaac | ttgactggag | atgtgtgtgc |
| 1681 | tgtgatgagg | gtccatgcct | ttttagagca | gtggggactc | gttaattacc | aagttgaccc |
| 1741 | ggaaagtaga | cccatggcaa | tgggacctcc | tcctactcct | cattttaatg | tattagctga |
| 1801 | taccccctct | gggcttgtgc | ctctgcatct | tcgatcacct | caggttcctg | ctgctcaaca |
| 1861 | gatgctaaat | tttcctgaga | aaaacaagga | aaaaccagtt | gatttgcaga | actttggtct |
| 1921 | ccgtactgac | atttactcca | agaaaacatt | agcaaagagt | aaaggtgcta | gtgctggaag |
| 1981 | agaatggact | gaacaggaga | cccttctact | cctggaggcc | ctggagatgt | acaaggatga |
| 2041 | ttggaacaaa | gtgtcggaac | atgttggaag | tcgtactcag | gatgaatgca | tcctccactt |
| 2101 | tttgagactt | cccattgagg | acccatacct | tgagaattca | gatgcttccc | ttgggccttt |
| 2161 | ggcctaccag | cctgtcccct | tcagtcagtc | aggaaatcca | gttatgagta | ctgttgcttt |
| 2221 | tttggcatct | gtggtggacc | ctcgcgtggc | atctgctgca | gcaaaagcgg | ctttggagga |
| 2281 | gttttctcgg | gtccgggagg | aggtaccact | ggaattggtt | gaagctcatg | tcaagaaagt |
| 2341 | acaagaagca | gcacgagcct | ctgggaaagt | ggatcccacc | tacggtctgg | agagcagctg |
| 2401 | cattgcaggc | acagggcccg | atgagccaga | gaagcttgaa | ggagctgaag | aggaaaaaat |
| 2461 | ggaagccgac | cctgatggtc | agcagcctga | aaaggcagaa | aataaagtgg | aaaatgaaac |
| 2521 | ggatgaaggt | gataaagcac | aagatggaga | aaatgaaaaa | aatagtgaaa | aggaacagga |
| 2581 | tagtgaagtg | agtgaggata | ccaaatcaga | agaaaaggag | actgaagaga | acaaagaact |
| 2641 | cactgataca | tgtaaagaaa | gagaaagtga | tactgggaag | aagaaagtag | aacatgaaat |
| 2701 | ttccgaagga | aatgttgcca | cagccgcagc | agctgctctt | gcctcagcgg | ctaccaaagc |
| 2761 | caagcacctg | gctgcagtgg | aagaaagaaa | gatcaagtcc | ctggtagctc | tcttggttga |
| 2821 | gacacaaatg | aagaaactag | agatcaaact | tcgacatttt | gaagagctgg | aaactatcat |
| 2881 | ggacagagag | aaagaagctc | tagaacaaca | gaggcagcag | ttgcttactg | aacgccaaaa |
| 2941 | cttccacatg | gaacagctga | agtatgctga | attacgagca | cgacagcaaa | tggaacagca |
| 3001 | gcagcatggc | cagaaccctc | aacaggcaca | ccagcactca | ggaggacctg | gcctggcccc |
| 3061 | acttggagca | gcagggcacc | ctggcatgat | gcctcatcaa | cagcccccctc | cctaccctct |
| 3121 | gatgcaccac | cagatgccac | cacctcatcc | accccagcca | ggtcagatac | caggcccagg |
| 3181 | ttccatgatg | cccgggcagc | acatgccagg | ccgcatgatt | cccactgttg | cagccaacat |
| 3241 | ccacccctct | gggagtggcc | ctacccctcc | tggcatgcca | ccaatgccag | gaaacatctt |
| 3301 | aggaccccgg | gtacccctga | cagcacctaa | cggcatgtat | ccccctccac | cacagcagca |
| 3361 | gccaccgcca | ccaccacctg | cagatggggt | ccctccgcct | cctgctcctg | gcccgccagc |
| 3421 | ctcagctgct | ccttagcctg | gaagatgcag | ggaacctcca | cgcccaccac | catgagctgg |
| 3481 | agtggggatg | acaagacttg | tgttcctcaa | ctttcttggg | tttctttcag | gatttttctt |
| 3541 | ctcacagctc | caagcacgtg | tcccgtgcct | ccccactcct | cttaccaccc | ctctctctga |
| 3601 | cactttttgt | gttgggtcct | cagccaacac | tcaaggggaa | acctgtagtg | acagtgtgcc |
| 3661 | ctggtcatcc | ttaaaataac | ctgcatctcc | cctgtcctgg | tgtgggagta | agctgacagt |
| 3721 | ttctctgcag | gtcctgtcaa | ctttagcatg | ctatgtcttt | accattttttg | ctctcttgca |
| 3781 | gtttttttgct | ttgtcttatg | cttctatgga | taatgctata | taatcattat | ctttttatct |
| 3841 | ttctgttatt | attgttttaa | aggagagcat | cctaagttaa | taggaaccaa | aaaataatga |
| 3901 | tgggcagaag | gggggaata | gccacagggg | acaaacctta | aggcattata | agtgacctta |
| 3961 | tttctgcttt | tctgagctaa | gaatggtgct | gatggtaaag | tttgagactt | ttgccacaca |
| 4021 | caaatttgtg | aaaattaaac | gagatgtgga | aggagaacct | cagtgatttt | attccctagt |
| 4081 | gaggcctctg | agggcctcca | cactgcctgg | cagaacatac | cactgaacta | gtatgtgcta |
| 4141 | gaggagggca | caaacatccg | ctccttccct | aggcctgctg | gctctggttt | tctatgcaga |
| 4201 | tgattcattg | gattgggggt | gagtgttttg | tttttctggg | ggcagtgtga | gctttgaggg |
| 4261 | ttggaatatt | gggaggcatt | ccttagtttc | ctcaactagc | ctggaaagtt | aggagtctag |
| 4321 | ggtaattacc | cccaatgagt | ctagcctact | attcactgct | ttgtgtgcat | ttttttctcc |
| 4381 | ctctttaaaa | aaccctttaa | aagaaaaaaa | aaagtagata | gtgctaaata | ttttagctca |
| 4441 | tgaaacttgg | ttaggatggc | tgggggtaca | agtccccaaa | ctacctcttg | ttacagtagc |
| 4501 | cagggagtgg | aatttcgtca | accggtactt | ttaaggttag | gatgggacgg | gaaaagtgaa |
| 4561 | gcaggatatt | agctccttat | accttctccc | ttccatttct | gagatctcac | attccatcta |
| 4621 | tcacagggtt | ttcaaagaga | tgctgagggt | aacaaggaac | tcacttggca | gtcagagcat |
| 4681 | catgctttga | ggtttggggt | gctcaggctg | ggagggtaga | atgccattcc | agaggacaag |
| 4741 | ccacaaaaat | gccttaattt | gagctcgtat | ttacccctgc | tgataagtga | cttgagagtt |
| 4801 | cccggttttt | tcctcttgtc | cttccctccc | ttctgtcctt | ccatgtgtgg | ggaaagggtg |
| 4861 | tttttggtag | agcttggttt | ccaaagcgcc | tggctttctc | acttcacatt | ctcaagtggc |
| 4921 | agtttcatta | tttagaatgc | aaggtggaca | tcttttggat | atctttttct | atatattttc |
| 4981 | taaagcttta | catatgagag | ggtataggga | ggtgtttata | aaacacttga | gaactttttt |
| 5041 | ccttaatatc | agaaagcaaa | aaaataaaac | cacaattgag | atttgccttt | caaaccctca |
| 5101 | ggtttgcctc | taaccaggtg | tccctggtca | ccatcagagt | actggaatac | gggaaccgag |
| 5161 | gagaccttgg | tccttttgtt | tttgttctgg | actcttggga | gtggaaatga | gaatgagttt |

TABLE 1-continued 5221 attcctactg gagcttagtt ccaatgcatt tggctccaga aagaccccag tgccttttga
5281 caatggccag ggttttacct acttcctgcc agtctttccc aaaggaaact cattccaaat
5341 acttcttttt tcccctggag tccgagaagg aaaatggaat tctggttcat actgtggtcc
5401 cttgtaacct caggtcttta atgtgatcac tttcaaattt aaaagatcca ggtggaaata
5461 tttttactat agtaataatt ctacaaaata cctgaattct taacactgtt atatttcagt
5521 ataagtggtg gctttttctt ttcatgtctt tgatctggtt ttattcctgt aattcagcca
5581 cctgatttttg tgagggggggg gaataatatg tggtttttgt acaaacatgt ttctcagtgt
5641 gttgttattt tggaaaaaat gaggggaggg agtttggcaa gaatggagaa aatgaatgaa
5701 gaaggcctaa tctctctctt tttcagtgaa taaatggaac accatttctg gattctaaaa
5761 aaaaaaaaaa aaaaaaaaaa SEQ ID NO: 40 Human SMARCC1 Amino Acid Sequence (NP_003065.3)
1 maaaaggggp gtavgatgsg iaaaaaglav yrrkdggpat kfwespetvs qldsvrvwlg
61 khykkyvhad aptnktlagl vvqllqfqed afgkhvtnpa ftklpakcfm dfkaggalch
121 ilgaaykykn eqgwrrfdlq npsrmdrnve mfmniektiv qnncltrpni ylipdidlkl
181 anklkdiikr hqgtftdeks kashhiypys ssqddeewlr pvmrkekqvl vhwgfypdsy
241 dtwvhsndvd aeiedppipe kpwkvhvkwi ldtdifnewm needyevden rkpvsfrqri
301 stkneepvrs perrdrkasa narkrkhsps pppptptesr kksgkkgqas lygkrrsqke
361 edeqedltkd medptpvpni eevvlpknvn lkkdsentpv kggtvadlde qdeetvtagg
421 kededpakgd qsrsvdlged nvteqtnhii ipsyaswfdy ncihvierra lpeffngknk
481 sktpeiylay rnfmidtyrl npqeyltsta crrnitgdvc avmrvhafle qwglvnyqvd
541 pesrpmamgp pptphfnvla dtpsglvplh lrspqvpaaq qmlnfpeknk ekpvdlqnfg
601 lrtdiyskkt lakskgasag rewtegetll llealemykd dwnkvsehvg srtqdecilh
661 flrlpiedpy lensdaslgp layqpvpfsq sgnpvmstva flasvvdpry asaaakaale
721 efsrvreevp lelveahvkk vqeaarasgk vdptygless ciagtgpdep eklegaeeek
781 meadpdgqqp ekaenkvene tdegdkagdg eneknsekeq dsevsedtks eeketeenke
841 ltdtckeres dtgkkkvehe isegnvataa aaalasaatk akhlaaveer kikslvallv
901 etqmkkleik lrhfeeleti mdrekealeq grqqllterq nfhmeqlkya elrarqqmeq
961 qqhgqnpqqa hqhsggpgla plgaaghpgm mphqqpppyp lmhhqmppph ppqpgqipgp
1021 gsmmpgqhmp grmiptvaan ihpsgsgptp pgmppmpgni lgprvpltap ngmyppppqg
1081 qppppppadg vppppapgpp asap SEQ ID NO: 41 Mouse SMARCC1 cDNA Sequence (NM_009211.2, CDS: 94-3408)
1 ggaggtggca tctgcgcgcg cgcgcgcggg tgcgaacggg aaacgccgcg agggccaggc
61 taggccgggc ggtagacacg acggacggtg actatggccg cgacagcggg tggcggtccg
121 ggagcagcag caggcgccgt gggtgcaggg ggtgcggcgg cggcctccgg gctggccgtg
181 taccggagga aggacggggg cccggccagc aagttttggg agagcccgga cacggtgtcc
241 cagctagatt cggtgcgagt ctggctgggc aagcactaca agaagtatgt tcatgcagat
301 gctcctacca ataaaacact agctggactg gtggtgcagc ttctacagtt ccaagaagat
361 gcctttggga agcatgtcac caacccagct ttcaccaaac tacctgcaaa atgtttcatg
421 gatttcaaag ctggaggcac cttgtgtcac attcttgggg cagcttacaa gtacaaaaat
481 gaacagggct ggcggagatt tgatcttcag aacccatccc gaatggatcg taacgttgaa
541 atgttcatga acattgagaa aacattggta cagaacaact gtctgactag accaaacatc
601 tacctcattc cagacattga tttgaagttg gctaacaagt tgaaagatat catcaaacgg
661 catcagggga catttactga tgagaagtca aaagcttccc accatattta tccatatcct
721 tcctcacaag aggatgagga gtggctgaga ccagtgatga ggagagacaa gcaggtgctg
781 gtgcactggg gtttctaccc agacagctat gacacttggg tccacagtaa tgatgttgat
841 gctgaaattg aagatgcacc aatcccagaa aagccctgga aggttcatgt aaaatggatt
901 ttggacactg acgttttcaa tgaatggatg aatgaagagg attatgaagt ggatgagaac
961 agaaagccag tgagctttcg tcaacgaatt tcaacaaaga atgaagagcc agtcagaagt
1021 ccagaaagga gagacagaaa agcctctgcc aactctagga agaggaaacc ttccccttct
1081 cctcctcctc ccacagccac agagtcccgc aagaagagcg ggaagaaagg acaagctagc
1141 ctttatggga aacgtagaag tcagaaggaa gaagatgagc aagaagatct taccaaggac
1201 atggaagacc ccacacctgt acctaacata gaggaagtgg ttctccctaa gaatgtaaac
1261 ccaaagaagg acagtgaaaa cacacccgtt aaaggaggca cggtggcaga tctagatgag
1321 caggatgaag aagcagttac aacaggagga aaggaagatg aagatcccag caaaggtgat
1381 ccaagtcgct cagttgaccc aggtgaagac aacgtgacag aacagaccaa tcacatcatt
1441 attcccagct acgcatcctg gtttgattat aattgtattc atgtcattga acggcgtgcg
1501 cttcctgagt tctttaatgg aaaaaacaaa tccaagaccc ctgaaatata cttggcatat
1561 cgaaatttta tgattgacac ataccgtcta aaccctcaag aatatttaac cagcactgct
1621 tgccggcgaa acctgactgg agatgtgtgt gctgtgatga gggttcatgc cttcttagag
1681 cagtggggtc ttgttaacta ccaagttgac ccagagagtc gacccatggc aatgggacct
1741 cctcccactc ctcacttcaa tgtgttagct gacacaccct ctgggcttgt gcccctgcat
1801 cttcgatcac ctcaggtccc tgccgctcaa cagatgttaa attttcctga gaagaacaag
1861 gaaaaaccaa ttgatttgca gaactttggt cttcgaactg acatttactc caagaaaaca
1921 ctggcaaaga gtaaaggtgc tagtgctgga agggagtgga cagaacagga gacccttctt
1981 ctcctagagg ctctggagat gtacaaggac gattggaata aagtgtcaga acatgttgga
2041 agccgtactc aggacgaatg catcctccac tttctgaggc ttcccattga ggaccccttac
2101 cttgaaaatt cagatgcttc tcttgggcca ctggcttacc agcctgtccc tttcagccag
2161 tcgggaaacc cggtgatgag cactgttgcc tttttagcat ctgtcgttga cccccgtgta
2221 gcatctgctg cagcaaaagc agcgttggag gagttttctc gtgtccgaga agaagtaccc
2281 ctggaattgg ttgaagcaca tgtcaagaaa gtacaggaag ctgcaagagc ctctgggaag
2341 gtggaccccca cctatggctt ggagagcagc tgtattgctg gcacagggcc tgacgagcca
2401 gagaagcttg aaggatctga agaagagaag atggaaacag atcctgatgg tcagcagcct
2461 gaaaaggcag aaaacaaagt ggaaaatgaa tcggatgaag gtgataaaat acaagatcga
2521 gagaatgaaa aaaacactga gaaggaacaa gatagtgacg tcagtgagga tgtcaagcca
2581 gaagaaaagg agaatgaaga gaacaaagag ctcactgata catgtaaaga aagagaaagc
2641 gatgccggga agaagaaagt ggaacacgag atttcggaag gaaacgttgc cacagccgca
2701 gcagctgctc tggcctcagc tgctactaaa gccaagcacc tggcggctgt tgaagaaaga
2761 aaaatcaagt ccttggtagc tctcttggtt gaaacacaaa tgaagaaact agagatcaaa TABLE 1-continued

```
2821 cttcgacatt ttgaagagct ggagactata atggacagag agaaagaggc tctagaacaa
2881 cagagacagc agttgcttac tgagcgtcag aacttccaca tggaacagtt gaaatatgct
2941 gaactacgtg cccggcagca aatggagcag cagcagcagc atggccagac acctcagcag
3001 gcgcaccagc acacgggagg gccggggatg gccccacttg gagccacagg ccaccctggc
3061 atgatgccgc atcagcagcc ccctccctac ccactgatgc accatcagat gccgccaccc
3121 catcctcccc aaccaggtca aataccaggc cctggctcca tgatgcctgg ccagcccatg
3181 ccaggtcgca tgatccccgc tgtggcagcc aacattcacc ctactgggag tggccctacc
3241 cctcctggta tgcctccaat gcccggaaac atcttaggac cccgggtacc cctcacagca
3301 ccaaacggca tgtatcctcc tccaccacag cagcagcagc cgcctcctcc tgcagatggg
3361 gtccctccac ctcctgctcc aggcccaccc gcctcggcca ctccctagcc tggaagatac
3421 aagagcctcc acagccacca caagcaggaa tggggatggc aggacttgtg tctcggcttc
3481 cttggttttc ttgcaggatt tttttttcac aaccccaagc acaagcccca tgtctctcca
3541 ctccttgata cttcttgtgt caggtcctta gttgacactc attgggaagc ctgtggtgac
3601 tgatgtgctc tggtcattta aaaagtacca tgtgtctccc ctgtccccgt gtgacagatg
3661 ttggcaggtg gtctgcaggt cctgttgtgt tgacattagt attctttgtg tgtatctctc
3721 tctgtctctc tctctctgct ttgtctaagg cttcaatgta taatcctcta taattattgt
3781 cctttcttcc tttgtaatgg ttgttttttt aaggaaagta tcctaagtta atagaaacca
3841 aaaaaaatgg taatgggcag aaagagatag ccacagaggg acacacctta aggcattata
3901 agtgacctta tttctgctta tctgagctag agtggtgcta ctgatagagt ccctgagact
3961 tgtcacacat aagtgcacca agatgagaag agctggggaa agggggtatc ctttcgattt
4021 gatttcctgg tgaggaccat gaaggacttc cctgtgcctg gaagaacatg ccactgtacc
4081 tagtacacga tagatagcaa agagcacagc tttacaacaa gcccttccta ccttctcccg
4141 ccattctggt tgtctgtgca gaagatttgc aggattggaa catggtggtt gttttcccaa
4201 gggcagcgtg agctttcaga gttggggttt tcccagtcta acaaagataa agggtctggg
4261 gccctaccta caaaccttta ggaacccttc caaacctccc aaccttcccc aaacacatag
4321 ggcctaccct cgccacccca ataaacatta catgtttttt aaaccttcct ataagaaagg
4381 aaaaaaatgt aaaatgggtt atagattatg ttgaacattt tatctcatgc ggcttggtgg
4441 gggtggggt acagatccct aaactacctc ttgctgtagc cagggtgagc ggggttctta
4501 agcggtactg aggtgcagaa cgggagtggg aatgctcaca tgtgatgagc agcctcctgt
4561 acctcacatt ctgagacctc acattccatc tgttgtcaca gggttatgga gactgtgcta
4621 atggcacaag gacctcactt ggctccagag tgcgaggctg taaggtttaa gtgccatccc
4681 agaggaattg ccaccaaaaa aaaaaaaaaa agccttaatc tgagcctgta tctaccctg
4741 ctgatgaaca actagatggg ttttggtttt gccagcttct ttcctccctc cctccctccc
4801 tccctccctc cctccctcct ttctgtcttt ccattagtag caaaagggtg tttttagcag
4861 aactttaagt ggcagtttca ttcttgagag tgcaaggtag agcaccttac gggtgtattt
4921 ttatgtgtat tttaaagctt tatgtatgag agctataggt aggcatttct taataacaca
4981 aaaacctaca gttgagattt gcctttaaga ctcttggttt tcctctaacc aggagcccac
5041 gtcaccgcca gagtcctgga gctagagcta atgactccag agccttgggg tggaaatgga
5101 gattcgctta ttccctgggt gcttgttttt cctccaggaa aaccccggtg tcttctgacc
5161 gcagccaggg ttgccctcct tccctccatt ctctcccaaa gtaaattgac tccagcactt
5221 gccttctccc cggagtccta ggggaggtat aggactctgc ttgtctgtaa cctgaggtct
5281 gtaatgtgat tgctttccag ttttgagaga tgcaagtggg aatagttttt acattgttga
5341 taatctatag aacctaagtt caacacttca acacagctct ttccatgact gtcagttagg
5401 tatcattcct gtaataacac ccatccagtt ttgtgagggg cgggcttgga tactgtgtgg
5461 tttttgtaca aatgtgtttc tcagtgtggg tttttgtttt ttgttgggtt tttttttttt
5521 ttttggtgtt tttttgtttg tttatttgtt ttttttcttt aggttttgtt ctaatgaggt
5581 aaaggagctt tgagagtttg ggagaaaatg aatgaaagtg gcttaatgtc cctcgtttgc
5641 attgaataaa tgaaatacca tttatgaatt ctaaaaaaaa aaaa
```

SEQ ID NO: 42 Mouse SMARCC1 Amino Acid Sequence (NP_033237.2)

```
   1 maatagggpg aaagavgagg aaaasglavy rrkdggpask fwespdtvsq ldsvrvwlgk
  61 hykkyvhada ptnktlaglv vqllqfgeda fgkhvtnpaf tklpakcfmd fkaggtichi
 121 lgaaykykne qgwrrfdlqn psrmdrnvem fmniektivq nncltrpniy lipdidlkla
 181 nklkdiikrh qgtftdeksk ashhiypyps sqedeewlrp vmrrdkqvlv hwgfypdsyd
 241 twvhsndvda eiedapipek pwkvhvkwil dtdvfnewmn eedyevdenr kpvsfrqris
 301 tkneepvrsp errdrkasan srkrkpspsp ppptatesrk ksgkkggasl ygkrrsqkee
 361 deqedltkdm edptpvpnie evvlpknvnp kkdsentpvk ggtvadldeq deeavttggk
 421 ededpskgdp srsvdpgedn vteqtnhiii psyaswfdyn cihvierral peffngknks
 481 ktpeiylayr nfmidtyrin pqeyltstac rrnitgdvca vmrvhafleq wglvnyqvdp
 541 esrpmamgpp ptphfnvlad tpsglvplhl rspqvpaagq mlnfpeknke kpidlqnfgl
 601 rtdiyskktl akskgasagr ewtegetlll lealemykdd wnkvsehvgs rtqdecilhf
 661 lrlpiedpyl ensdaslgpl aygpvpfsgs gnpvmstvaf lasvvdprva saaakaalee
 721 fsrvreevpl elveahvkkv qeaarasgkv dptyglessc iagtgpdepe klegseeekm
 781 etdpdgqqpe kaenkvenes degdkiqdre nekntekeqd sdvsedvkpe ekeneenkel
 841 tdtckeresd agkkkvehei segnvataaa aalasaatka khlaaveerk ikslvallve
 901 tqmkkleikl rhfeeletim drekealegq rqqllterqn fhmeqlkyae lrarqqmeqq
 961 qqhgqtpqqa hqhtggpgma plgatghpgm mphqqpppyp lmhhqmppph ppqpgqipgp
1021 gsmmpgqpmp grmipavaan ihptgsgptp pgmppmpgni lgprvpltap ngmyppppqq
1081 qqppppadgv ppppapgppa satp
```

SEQ ID NO: 43 Human SMARCC2 cDNA Sequence Variant 1 (NM_003075.4, CDS: 114-3758)

```
   1 ggaggcggcg gccgcggcgg cgggaggcgg cgggaggcgg gcggaggagg aggcggagga
  61 ggcgggagct gagctgagtg gggcggcgg cggcggggcc cgagccggag aagatggcgg
 121 tgcggaagaa ggacggcggc cccaacgtga agtactacga ggccgcggac accgtgaccc
 181 agttcgacaa cgtgcggctg tggctcggca agaactacaa gaagtatata caagctgaac
 241 cacccaccaa caagtccctg tctagcctgg ttgtacagtt gctacaattt caggaagaag
 301 tttttggcaa acatgtcagc aatgcaccgc tcactaaact gccgatcaaa tgtttcctag
 361 atttcaaagc gggaggctcc ttgtgccaca ttcttgcagc tgcctacaaa ttcaagagtg
 421 accagggatg gcggcgttac gatttccaga atccatcacg catggaccgc aatgtggaaa
```

TABLE 1-continued 481 tgtttatgac cattgagaag tccttggtgc agaataattg cctgtctcga cctaacattt
541 ttctgtgccc agaaattgag cccaaactac tagggaaatt aaaggacatt atcaagagac
601 accagggaac agtcactgag gataagaaca atgcctccca tgttgtgtat cctgtcccgg
661 ggaatctaga agaagaggaa tgggtacgac cagtcatgaa gagggataag caggttcttc
721 tgcactgggg ctactatcct gacagttacg acacgtggat cccagcgagt gaaattgagg
781 catctgtgga agatgctcca actcctgaga aacctaggaa ggttcatgca aagtggatcc
841 tggacaccga caccttcaat gaatggatga atgaggaaga ctatgaagta aatgatgaca
901 aaaaccctgt ctcccgccga aagaagattt cagccaagac actgacagat gaggtgaaca
961 gcccagattc agatcgacgg gacaagaagg ggggaaacta taagaagagg aagcgctccc
1021 cctctccttc accaacccca gaagcaaaga agaaaaatgc taagaaaggt ccctcaacac
1081 cttacactaa gtcaaagcgt ggccacagag aagaggagca agaagacctg acaaaggaca
1141 tggacgagcc ctcaccagtc cccaatgtag aagaggtgac acttcccaaa acagtcaaca
1201 caaagaaaga ctcagagtcg gccccagtca aaggcggcac catgaccgac ctggatgaac
1261 aggaagatga aagcatggag acgacgggca aggatgagga tgagaacagt acggggaaca
1321 agggagagca gaccaagaat ccagacctgc atgaggacaa tgtgactgaa cagacccacc
1381 acatcatcat tcccagctac gctgcctggt ttgactacaa tagtgttcat gccattgagc
1441 ggagggctct ccccgagttc ttcaacggca agaacaagtc caagactcca gagatctacc
1501 tggcctatcg aaactttatg attgacactt accgactgaa cccccaagag tatcttacct
1561 ctaccgcctg ccgccgaaac ctagcgggtg atgtctgtgc catcatgagg gtccatgcct
1621 tcctagaaca gtggggtctt attaactacc aggtggatgc tgagagtcga ccaaccccaa
1681 tggggcctcc gcctacctct cacttccatg tcttggctga cacaccatca gggctggtgc
1741 ctctgcagcc caagacacct cagcagacct ctgcttccca acaaatgctc aactttcctg
1801 acaaaggcaa agagaaacca acagacatgc aaaactttgg gctgcgcaca gacatgtaca
1861 caaaaaagaa tgttccctcc aagagcaagg ctgcagccag tgccactcgt gagtggacag
1921 aacaggaaac cctgcttctc ctggaggcac tggaaatgta caaagatgac tggaacaaag
1981 tgtccgagca tgtgggaagc cgcacacagg acgagtgcat cttgcatttt cttcgtcttc
2041 ccattgaaga cccatacctg gaggactcag aggcctccct aggcccccctg gcctaccaac
2101 ccatcccctt cagtcagtcg ggcaaccctg ttatgagcac tgttgccttc ctggcctctg
2161 tcgtcgatcc ccgagtcgcc tctgctgctg caaagtcagc cctagaggag ttctccaaaa
2221 tgaaggaaga ggtacccacg gccttggtgg aggcccatgt tcgaaaagtg gaagaagcag
2281 ccaaagtaac aggcaaggcg gaccctgcct tcggtctgga aagcagtggc attgcaggaa
2341 ccacctctga tgagcctgag cggattgagg agagcgggaa tgacgaggct cgggtggaag
2401 gccaggccac agatgagaag aaggagccca aggaaccccg agaaggaggg ggtgctatag
2461 aggaggaagc aaaagagaaa accagcgagg ctcccaagaa ggatgaggag aaagggaaag
2521 aaggcgacag tgagaaggag tccgagaaga gtgatggaga cccaatagtc gatcctgaga
2581 aggagaagga gccaaaggaa gggcaggagg aagtgctgaa ggaagtggtg gagtctgagg
2641 gggaaaggaa gacaaaggtg gagcgggaca ttggcgaggg caacctctcc accgctgctg
2701 ccgccgccct ggccgccgcc gcagtgaaag ctaagcactt ggctgctgtt gaggaaagga
2761 agatcaaatc tttggtggcc ctgctggtgg agacccagat gaaaaagttg gagatcaaac
2821 ttcggcactt tgaggagctg gagactatca tggaccggga gcgagaagca ctggagtatc
2881 agaggcagca gctcctggcc gacagacaag ccttccacat ggagcagctg aagtatgcgg
2941 agatgagggc tcggcagcag cacttccaac agatgcacca acagcagcag cagccaccac
3001 cagccctgcc cccaggctcc cagcctatcc ccccaacagg ggctgctggg ccacccgcag
3061 tccatggctt ggctgtggct ccagcctctg tagtccctgc tcctgctggc agtggggccc
3121 ctccaggaag tttgggccct tctgaacaga ttgggcaggc agggtcaact gcagggccac
3181 agcagcagca accagctgga gcccccagc ctggggcagt cccaccaggg gttcccccc
3241 ctggacccca tggcccctca ccgttcccca accaacaaac tcctccctca atgatgccag
3301 gggcagtgcc aggcagcggg cacccaggcg tggcgggtaa tgctcctttg ggtttgcctt
3361 ttggcatgcc gcctcctcct cctcctcctg ctccatccat catcccattt ggtagtctag
3421 ctgactccat cagtattaac ctccccgctc ctcctaacct gcatgggcat caccaccatc
3481 tcccgttcgc cccgggcact ctccccccac ctaacctgcc tgtgtccatg gcgaaccctc
3541 tacatcctaa cctgccggcg accaccacca tgccatcttc cttgcctctc gggccggggc
3601 tcggatccgc cgcagcccaa agccctgcca ttgtggcagc tgttcagggc aacctcctgc
3661 ccagtgccag cccactgcca gacccaggca ccccccctgcc tccagacccc acagccccga
3721 gcccaggcac ggtcacccct gtgccacctc cacagtgagg agccagccag acatctctcc
3781 ccctcacccc ctgtggacat cacggttcca ggaacagccc ttcccccacc actgggaccc
3841 tccccagcct ggagagttca tcactacgta aggaaagctc cttccgcccc tccaaagccc
3901 tcaccatgcc taacagaggc atgcattttt atatcagatt attcaaggac ttctgtttaa
3961 aagatgttta taatgtctgg gagagaggat aggatgggaa tgctgcccta aaggaagggc
4021 tggtgaaagg tgtttataca aggttctatt aaccacttct aagggtacac ctccctccaa
4081 actactgcat tttctatgga ttaaaaaaaa aaaaaaaaag tagattttaa aaagccacat
4141 tggagctccc ttctacccac taaaaaataa ccaattttta catttttga gggggagtga
4201 gttttaggaa aggggaatta agattccagg gagagctctg gggatagaac agggcgcaga
4261 ttccatctct ccccaagccc ctttttagtg actaagtcaa ggccccaact cccctccccc
4321 accctacgct gagcttattc gagttcattc gtactaataa tccctcctgc ggcttcctca
4381 ttgttgctgt tttaggccac cccagctcag ccaatgattc ctttccctct gaatgtcagt
4441 tttgttttta aaagtcactt gcttagttga tgtcagcgta tgtgtatttg gtggggaaaa
4501 cctaatttcg ggatttctg tggtaggtaa taggagaaga aagggcactg gggctgttc
4561 tccttccttc cctgggctgt atccatggac tcctggaagg cacagagaag ggagctataa
4621 gaggatgtga agttttaaaa cctgaaattg ttttttaaag cacttaagca cctccatatt
4681 atgacttggt gggtcacccc ttagcttcct ccctctccca ccaagactat gagaacttca
4741 gctgatagct gggggctccc cagatgagga tgcagggatt tgggagcagt ggaagagggt
4801 gcccaacctt gggttggacc aacccttggc tcgcagctca actctgcttc ccgcattcct
4861 gctccacgtg tcccagcttc tcccctgtga cgggaaggca ggtgtgactc caggctctgc
4921 actggttctt cttggttcct cccaccaggc cctttgttcc tcatgtcccc atgtttctct
4981 ccctctgcgt cttagcacct ttcttctgtt caaagttttc tgtaaatttt ctcttttttt
5041 ctttctttct tttttttttt tttataaatt aatttgcttt cagttccaaa aaaaaaaaaa
5101 aaaaaa TABLE 1-continued SEQ ID NO: 44 Human SMARCC2 Amino Acid Sequence Isoform A (NP_003066.2)

```
   1 mavrkkdggp nvkyyeaadt vtqfdnvrlw lgknykkyiq aepptnksls slvvqllqfq
  61 eevfgkhvsn apltklpikc fldfkaggsl chilaaaykf ksdqgwrryd fqnpsrmdrn
 121 vemfmtieks lvqnnclsrp niflcpeiep kllgklkdii krhqgtvted knnashvvyp
 181 vpgnleeeew vrpvmkrdkq vllhwgyypd sydtwipase ieasvedapt pekprkvhak
 241 wildtdtfne wmneedyevn ddknpvsrrk kisaktltde vnspdsdrrd kkggnykkrk
 301 rspspsptpe akkknakkgp stpytkskrg hreeeqedlt kdmdepspvp nveevtlpkt
 361 vntkkdsesa pvkggtmtdl deqedesmet tgkdedenst gnkgeqtknp dlhednvteq
 421 thhiiipsya awfdynsvha ierralpeff ngknksktpe iylayrnfmi dtyrinpqey
 481 ltstacrrnl agdvcaimrv hafleqwgli nyqvdaesrp tpmgppptsh fhvladtpsg
 541 lvplqpktpq qtsasqqmln fpdkgkekpt dmqnfglrtd mytkknvpsk skaaasatre
 601 wtegetllll ealemykddw nkvsehvgsr tqdecilhfl rlpiedpyle dseaslgpla
 661 yqpipfsgsg npvmstvafl asvvdprvas aaaksaleef skmkeevpta lveahvrkve
 721 eaakvtgkad pafglessgi agttsdeper ieesgndear vegqatdekk epkepreggg
 781 aieeeakekt seapkkdeek gkegdsekes eksdgdpivd pekekepkeg qeevlkevve
 841 segerktkve rdigegnlst aaaaalaaaa vkakhlaave erkikslval lvetqmkkle
 901 iklrhfeele timdrereal eygrqqllad rgafhmeglk yaemrarqqh fqqmhqqqqq
 961 pppalppgsq pipptgaagp pavhglavap asvvpapags gappgslgps egiggagsta
1021 gpqqqqpaga pqpgavppgv pppgphgpsp fpnqqtppsm mpgavpgsgh pgvagnaplg
1081 lpfgmppppp ppapsiipfg sladsisinl pappnlhghh hhlpfapgtl pppnlpvsma
1141 nplhpnlpat ttmpsslplg pglgsaaaqs paivaavqgn llpsasplpd pgtplppdpt
1201 apspgtvtpv pppq
```

SEQ ID NO: 45 Human SMARCC2 cDNA Sequence Variant 2 (NM_139067.3, CDS: 114-3506)

```
   1 ggaggcggcg gccgcggcgg cgggaggcgg cgggaggcgg gcggaggagg aggcggagga
  61 ggcgggagct gagctgagtg gggcgggcgg cggcggggcc cgagccggag aagatggcgg
 121 tgcggaagaa ggacggcggc cccaacgtga agtactacga ggccgcggac accgtgaccc
 181 agttcgacaa cgtgcggctg tggctcggca agaactacaa gaagtatata caagctgaac
 241 cacccaccaa caagtccctg tctagcctgg ttgtacagtt gctacaattt caggaagaag
 301 tttttggcaa acatgtcagc aatgcaccgc tcactaaact gccgatcaaa tgtttcctag
 361 atttcaaagc gggaggctcc ttgtgccaca ttcttgcagc tgcctacaaa ttcaagagtg
 421 accagggatg gcggcgttac gatttccaga atccatcacg catggaccgc aatgtggaaa
 481 tgtttatgac cattgagaag tccttggtgc agaataattg cctgtctcga cctaacattt
 541 ttctgtgccc agaaattgag cccaaactac tagggaaatt aaaggacatt atcaagagac
 601 accagggaac agtcactgag gataagaaca atgcctccca tgttgtgtat cctgtcccgg
 661 ggaatctaga agaagaggaa tgggtacgac cagtcatgaa gagggataag caggttcttc
 721 tgcactgggg ctactatcct gacagttacg acacgtggat cccagcgagt gaaattgagg
 781 catctgtgga agatgctcca actcctgaga aacctaggaa ggttcatgca aagtggatcc
 841 tggacaccga caccttcaat gaatggatga atgaggaaga ctatgaagta aatgatgaca
 901 aaaaccctgt ctcccgccga aagaagattt cagccaagac actgacagat gaggtgaaca
 961 gcccagattc agatcgacgg gacaagaagg ggggaaacta taagaagagg aagcgctccc
1021 cctctccttc accaacccca gaagcaaaga agaaaaatgc taagaaaggt ccctcaacac
1081 cttacactaa gtcaaagcgt ggccacagag aagaggagca agaagacctg acaaaggaca
1141 tggacgagcc ctcaccagtc cccaatgtag aagaggtgac acttcccaaa acagtcaaca
1201 caaagaaaga ctcagagtcg gccccagtca aaggcggcac catgaccgac ctggatgaac
1261 aggaagatga aagcatggag acgacgggca aggatgagga tgagaacagt acggggaaca
1321 agggagagca gaccaagaat ccagacctgc atgaggacaa tgtgactgaa cagacccacc
1381 acatcatcat tcccagctac gctgcctggt ttgactacaa tagtgttcat gccattgagc
1441 ggagggctct ccccgagttc ttcaacggca agaacaagtc caagactcca gagatctacc
1501 tggcctatcg aaactttatg attgacactt accgactgaa cccccaagag tatcttacct
1561 ctaccgcctg ccgccgaaac ctagcgggtg atgtctgtgc catcatgagg gtccatgcct
1621 tcctagaaca gtggggtctt attaactacc aggtggatgc tgagagtcga ccaaccccaa
1681 tggggcctcc gcctacctct cacttccatg tcttggctga cacaccatca gggctggtgc
1741 ctctgcagcc caagacacct cagggccgcc aggttgatgc tgataccaag gctgggcgaa
1801 agggcaaaga gctggatgac ctggtgccag agacggctaa gggcaagcca gagctgcaga
1861 cctctgcttc ccaacaaatg ctcaactttc ctgacaaagg caaagagaaa ccaacagaca
1921 tgcaaaactt tgggctgcgc acagacatgt acacaaaaaa gaatgttccc tccaagagca
1981 aggctgcagc cagtgccact cgtgagtgga cagaacagga aaccctgctt ctcctggagg
2041 cactggaaat gtacaaagat gactggaaca aagtgtccga gcatgtggga agccgcacac
2101 aggacgagtg catcttgcat tttcttcgtc ttcccattga agacccatac ctggaggact
2161 cagaggcctc cctaggcccc ctggcctacc aacccatccc cttcagtcag tcgggcaacc
2221 ctgttatgag cactgttgcc ttcctggcct ctgtcgtcga tccccgagtc gcctctgctg
2281 ctgcaaagtc agccctagag gagttctcca aaatgaagga agaggtaccc acggccttgg
2341 tggaggccca tgttcgaaaa gtggaagaag cagccaaagt aacaggcaag gcggaccctg
2401 ccttcggtct ggaaagcagt ggcattgcag gaaccacctc tgatgagcct gagcggattg
2461 aggagagcgg gaatgacgag gctcgggtgg aaggccaggc cacagatgag aagaaggagc
2521 ccaaggaacc ccgagaagga gggggtgcta tagaggagga agcaaaagag aaaaccagcg
2581 aggctcccaa gaaggatgag gagaaaggga aagaaggcga cagtgagaag gagtccgaga
2641 agagtgatgg agacccaata gtcgatcctg agaaggagaa ggagccaaag gaagggcagg
2701 aggaagtgct gaaggaagtg gtggagtctg agggggaaag gaagacaaag gtggagcggg
2761 acattggcga gggcaacctc tccaccgctg ctgccgccgc cctggccgcc gccgcagtga
2821 aagctaagca cttggctgct gttgaggaaa ggaagatcaa atctttggtg gccctgctgg
2881 tggagaccca gatgaaaaag ttggagatca aacttcggca ctttgaggag ctggagacta
2941 tcatggaccg ggagcgagaa gcactggagt atcagaggca gcagctcctg gccgacagac
3001 aagccttcca catggagcag ctgaagtatg cggagatgag ggctcggcag cagcacttcc
3061 aacagatgca ccaacagcag cagcagccac caccagccct gcccccaggc tcccagccta
3121 tcccccccaac aggggctgct gggccacccg cagtccatgg cttggctgtg gctccagcct
3181 ctgtagtccc tgctcctgct ggcagtgggg cccctccagg aagtttgggc ccttctgaac
3241 agattgggca ggcagggtca actgcagggc cacagcagca gcaaccagct ggagcccccc
```

TABLE 1-continued 3301 agcctggggc agtcccacca ggggttcccc cccctggacc ccatggcccc tcaccgttcc
3361 ccaaccaaca aactcctccc tcaatgatgc caggggcagt gccaggcagc gggcacccag
3421 gcgtggcgga cccaggcacc cccctgcctc cagaccccac agccccgagc ccaggcacgg
3481 tcacccctgt gccacctcca cagtgaggag ccagccagac atctctcccc ctcacccccct
3541 gtggacatca cggttccagg aacagccctt cccccaccac tgggaccctc cccagcctgg
3601 agagttcatc actacgtaag gaaagctcct tccgcccctc caaagccctc accatgccta
3661 acagaggcat gcatttttat atcagattat tcaaggactt ctgtttaaaa gatgtttata
3721 atgtctggga gagaggatag gatgggaatg ctgccctaaa ggaagggctg gtgaaaggtg
3781 tttatacaag gttctattaa ccacttctaa gggtacacct ccctccaaac tactgcattt
3841 tctatggatt aaaaaaaaaa aaaaaaagta gattttaaaa agccacattg gagctccctt
3901 ctacccacta aaaaataacc aatttttaca ttttttgagg gggagtgagt tttaggaaag
3961 gggaattaag attccaggga gagctctggg gatagaacag ggcgcagatt ccatctctcc
4021 ccaagcccct ttttagtgac taagtcaagg ccccaactcc cctcccccac cctacgctga
4081 gcttattcga gttcattcgt actaataatc cctcctgcgg cttcctcatt gttgctgttt
4141 taggccaccc cagctcagcc aatgattcct ttccctctga atgtcagttt tgtttttaaa
4201 agtcacttgc ttagttgatg tcagcgtatg tgtatttggt ggggaaaacc taatttcggg
4261 gatttctgtg gtaggtaata ggagaagaaa gggcactggg ggctgttctc cttccttccc
4321 tgggctgtat ccatggactc ctggaaggca cagagaaggg agctataaga ggatgtgaag
4381 ttttaaaacc tgaaattgtt ttttaaagca cttaagcacc tccatattat gacttggtgg
4441 gtcacccctt agcttcctcc ctctcccacc aagactatga gaacttcagc tgatagctgg
4501 gggctcccca gatgaggatg cagggatttg ggagcagtgg aagagggtgc ccaaccttgg
4561 gttggaccaa cccttggctc gcagctcaac tctgcttccc gcattcctgc tccacgtgtc
4621 ccagcttctc ccctgtgacg ggaaggcagg tgtgactcca ggctctgcac tggttcttct
4681 tggttcctcc caccaggccc tttgttcctc atgtccccat gtttctctcc ctctgcgtct
4741 tagcaccttt cttctgttca aagttttctg taaattttct cttttttttct ttctttcttt
4801 tttttttttt tataaattaa tttgctttca gttccaaaaa aaaaaaaaaa aaaa SEQ ID NO: 46 Human SMARCC2 Amino Acid Sequence Isoform B (NP_620706.1)
1 mavrkkdggp nvkyyeaadt vtqfdnvrlw lgknykkyiq aepptnksls slvvqllqfq
61 eevfgkhvsn apltklpikc fldfkaggsl chilaaaykf ksdqgwrryd fqnpsrmdrn
121 vemfmtieks lvqnnclsrp niflcpeiep kllgklkdii krhqgtvted knnashvvyp
181 vpgnleeeew vrpvmkrdkq vllhwgyypd sydtwipase ieasvedapt pekprkvhak
241 wildtdtfne wmneedyevn ddknpvsrrk kisaktltde vnspdsdrrd kkggnykkrk
301 rspspsptpe akkknakkgp stpytkskrg hreeeqedlt kdmdepspvp nveevtlpkt
361 vntkkdsesa pvkggtmtdl deqedesmet tgkdedenst gnkgeqtknp dlhednvteq
421 thhiiipsya awfdynsvha ierralpeff ngknksktpe iylayrnfmi dtyrinpqey
481 ltstacrrnl agdvcaimrv hafleqwgli nyqvdaesrp tpmgppptsh fhvladtpsg
541 lvplqpktpq grqvdadtka grkgkelddl vpetakgkpe lqtsasqqml nfpdkgkekp
601 tdmqnfglrt dmytkknvps kskaaasatr ewtegetlll lealemykdd wnkvsehvgs
661 rtqdecilhf lrlpiedpyl edseaslgpl ayqpipfsqs gnpvmstvaf lasvvdprva
721 saaaksalee fskmkeevpt alveahvrkv eeaakvtgka dpafglessg iagttsdepe
781 rieesgndea rvegqatdek kepkepregg gaieeeakek tseapkkdee kgkegdseke
841 seksdgdpiv dpekekepke gqeevlkevv esegerktkv erdigegnls taaaaalaaa
901 avkakhlaav eerkikslva llvetqmkkl eiklrhfeel etimdrerea leygrqqlla
961 drqafhmeql kyaemrargq hfqqmhqqqq qpppalppgs qpipptgaag ppavhglava
1021 pasvvpapag sgappgslgp seqigqagst agpqqqqpag apqpgavppg vpppgphgps
1081 pfpnqqtpps mmpgavpgsg hpgvadpgtp lppdptapsp gtvtpvpppq SEQ ID NO: 47 Human SMARCC2 cDNA Sequence Variant 3 (NM_001130420.2, CDS: 114-3572)
1 ggaggcggcg gccgcggcgg cgggaggcgg cgggaggcgg gcggaggagg aggcggagga
61 ggcgggagct gagctgagtg gggcgggcgg cggcggggcc cgagccggag aagatggcgg
121 tgcggaagaa ggacggcggc cccaacgtga agtactacga ggccgcggac accgtgaccc
181 agttcgacaa cgtgcggctg tggctcggca agaactacaa gaagtatata caagctgaac
241 cacccaccaa caagtccctg tctagcctgg ttgtacagtt gctacaattt caggaagaag
301 tttttggcaa acatgtcagc aatgcaccgc tcactaaact gccgatcaaa tgtttcctag
361 atttcaaagc gggaggctcc ttgtgccaca ttcttgcagc tgcctacaaa ttcaagagtg
421 accagggatg gcggcgttac gatttccaga atccatcacg catggaccgc aatgtggaaa
481 tgtttatgac cattgagaag tccttggtgc agaataattg cctgtctcga cctaacattt
541 ttctgtgccc agaaattgag cccaaactac tagggaaatt aaaggacatt atcaagagac
601 accagggaac agtcactgag gataagaaca atgcctccca tgttgtgtat cctgtcccgg
661 ggaatctaga agaagaggaa tgggtacgac cagtcatgaa gagggataag caggttcttc
721 tgcactgggg ctactatcct gacagttacg acacgtggat cccagcgagt gaaattgagg
781 catctgtgga agatgctcca actcctgaga aacctaggaa ggttcatgca aagtggatcc
841 tggacaccga caccttcaat gaatggatga atgaggaaga ctatgaagta aatgatgaca
901 aaaaccctgt ctcccgccga aagaagattt cagccaagac actgacagat gaggtgaaca
961 gcccagattc agatcgacgg gacaagaagg ggggaaacta taagaagagg aagcgctccc
1021 cctctccttc accaacccca gaagcaaaga agaaaaatgc taagaaaggt ccctcaacac
1081 cttacactaa gtcaaagcgt ggccacagag aagaggagca agaagacctg acaaaggaca
1141 tggacgagcc ctcaccagtc cccaatgtag aagaggtgac acttcccaaa acagtcaaca
1201 caaagaaaga ctcagagtcg gccccagtca aaggcggcac catgaccgac ctggatgaac
1261 aggaagatga aagcatggag acgacgggca aggatgagga tgagaacagt acggggaaca
1321 agggagagca gaccaagaat ccagacctgc atgaggacaa tgtgactgaa cagacccacc
1381 acatcatcat tcccagctac gctgcctggt ttgactacaa tagtgttcat gccattgagc
1441 ggagggctct ccccgagttc ttcaacggca agaacaagtc caagactcca gagatctacc
1501 tggcctatcg aaactttatg attgacactt accgactgaa cccccaagag tatcttacct
1561 ctaccgcctg ccgccgaaac ctagcgggtg atgtctgtgc catcatgagg gtccatgcct
1621 tcctagaaca gtggggtctt attaactacc aggtggatgc tgagagtcga ccaaccccaa
1681 tggggcctcc gcctacctct cacttccatg tcttggctga cacaccatca gggctggtgc
1741 ctctgcagcc caagacacct cagggccgcc aggttgatgc tgataccaag gctgggcgaa TABLE 1-continued

```
1801 agggcaaaga gctggatgac ctggtgccag agacggctaa gggcaagcca gagctgcaga
1861 cctctgcttc ccaacaaatg ctcaactttc ctgacaaagg caaagagaaa ccaacagaca
1921 tgcaaaactt tgggctgcgc acagacatgt acacaaaaaa gaatgttccc tccaagagca
1981 aggctgcagc cagtgccact cgtgagtgga cagaacagga aaccctgctt ctcctggagg
2041 cactggaaat gtacaaagat gactggaaca aagtgtccga gcatgtggga agccgcacac
2101 aggacgagtg catcttgcat ttttcttcgtc ttcccattga agacccatac ctggaggact
2161 cagaggcctc cctaggcccc ctggcctacc aacccatccc cttcagtcag tcgggcaacc
2221 ctgttatgag cactgttgcc ttcctggcct ctgtcgtcga tccccgagtc gcctctgctg
2281 ctgcaaagtc agccctagag gagttctcca aaatgaagga agaggtaccc acggccttgg
2341 tggaggccca tgttcgaaaa gtggaagaag cagccaaagt aacaggcaag gcggaccctg
2401 ccttcggtct ggaaagcagt ggcattgcag gaaccacctc tgatgagcct gagcggattg
2461 aggagagcgg gaatgacgag gctcgggtgg aaggccaggc cacagatgag aagaaggagc
2521 ccaaggaacc ccgagaagga gggggtgcta tagaggagga agcaaaagag aaaaccagcg
2581 aggctcccaa gaaggatgag gagaaaggga aagaaggcga cagtgagaag gagtccgaga
2641 agagtgatgg agacccaata gtcgatcctg agaaggagaa ggagccaaag gaagggcagg
2701 aggaagtgct gaaggaagtg gtggagtctg agggggaaag gaagacaaag gtggagcggg
2761 acattggcga gggcaacctc tccaccgctg ctgccgccgc cctggccgcc gccgcagtga
2821 aagctaagca cttggctgct gttgaggaaa ggaagatcaa atctttggtg gccctgctgg
2881 tggagaccca gatgaaaaag ttggagatca aacttcggca ctttgaggag ctggagacta
2941 tcatggaccg ggagcgagaa gcactggagt atcagaggca gcagctcctg gccgacagac
3001 aagccttcca catggagcag ctgaagtatg cggagatgag ggctcggcag cagcacttcc
3061 aacagatgca ccaacagcag cagcagccac caccagccct gcccccaggc tcccagccta
3121 tccccccaac aggggctgct gggccacccg cagtccatgg cttggctgtg gctccagcct
3181 ctgtagtccc tgctcctgct ggcagtgggg cccctccagg aagtttgggc ccttctgaac
3241 agattgggca ggcagggtca actgcagggc cacagcagca gcaaccagct ggagcccccc
3301 agcctggggc agtcccacca ggggttcccc cccctggacc ccatggcccc tcaccgttcc
3361 ccaaccaaca aactcctccc tcaatgatgc caggggcagt gccaggcagc gggcacccag
3421 gcgtggcggc ccaaagccct gccattgtgg cagctgttca gggcaacctc ctgcccagtg
3481 ccagcccact gccagaccca ggcacccccc tgcctccaga ccccacagcc ccgagcccag
3541 gcacggtcac ccctgtgcca cctccacagt gaggagccag ccagacatct ctccccctca
3601 cccccctgtgg acatcacggt tccaggaaca gcccttcccc caccactggg accctcccca
3661 gcctggagag ttcatcacta cgtaaggaaa gctccttccg cccctccaaa gccctcacca
3721 tgcctaacag aggcatgcat ttttatatca gattattcaa ggacttctgt ttaaaagatg
3781 tttataatgt ctgggagaga ggataggatg ggaatgctgc cctaaaggaa gggctggtga
3841 aaggtgttta tacaaggttc tattaaccac ttctaagggt acacctccct ccaaactact
3901 gcattttcta tggattaaaa aaaaaaaaaa aaagtagatt ttaaaaagcc acattggagc
3961 tcccttctac ccactaaaaa ataaccaatt tttacatttt ttgaggggga gtgagtttta
4021 ggaaagggga attaagattc cagggagagc tctggggata gaacagggcg cagattccat
4081 ctctccccaa gccccttttt agtgactaag tcaaggcccc aactcccctc ccccacccta
4141 cgctgagctt attcgagttc attcgtacta ataatccctc ctgcggcttc ctcattgttg
4201 ctgttttagg ccaccccagc tcagccaatg attcctttcc ctctgaatgt cagttttgtt
4261 tttaaaagtc acttgcttag ttgatgtcag cgtatgtgta tttggtgggg aaaacctaat
4321 ttcggggatt tctgtggtag gtaataggag aagaaagggc actgggggct gttctccttc
4381 cttccctggg ctgtatccat ggactcctgg aaggcacaga gaagggagct ataagaggat
4441 gtgaagtttt aaaacctgaa attgtttttt aaagcactta agcacctcca tattatgact
4501 tggtgggtca ccccttagct tcctccctct cccaccaaga ctatgagaac ttcagctgat
4561 agctgggggc tccccagatg aggatgcagg gatttgggag cagtggaaga gggtgcccaa
4621 ccttgggttg gaccaaccct tggctcgcag ctcaactctg cttcccgcat tcctgctcca
4681 cgtgtcccag cttctcccct gtgacgggaa ggcaggtgtg actccaggct ctgcactggt
4741 tcttcttggt tcctcccacc aggccctttg ttcctcatgt ccccatgttt ctctccctct
4801 gcgtcttagc acctttcttc tgttcaaagt tttctgtaaa ttttctcttt ttttctttct
4861 ttctttttt tttttttata aattaatttg ctttcagttc caaaaaaaaa aaaaaaaaaa
```

SEQ ID NO: 48 Human SMARCC2 Amino Acid Sequence Isoform C (NP_001123892.1)

```
   1 mavrkkdggp nvkyyeaadt vtqfdnvrlw lgknykkyiq aepptnksls slvvqllqfq
  61 eevfgkhvsn apltklpikc fldfkaggsl chilaaaykf ksdqgwrryd fqnpsrmdrn
 121 vemfmtieks lvqnnclsrp niflcpeiep kllgklkdii krhqgtvted knnashvvyp
 181 vpgnleeeew vrpvmkrdkq vllhwgyypd sydtwipase ieasvedapt pekprkvhak
 241 wildtdtfne wmneedyevn ddknpvsrrk kisaktltde vnspdsdrrd kkggnykkrk
 301 rspspsptpe akkknakkgp stpytkskrg hreeeqedlt kdmdepspvp nveevtlpkt
 361 vntkkdsesa pvkggtmtdl deqedesmet tgkdedenst gnkgeqtknp dlhednvteq
 421 thhiiipsya awfdynsvha ierralpeff ngknksktpe iylayrnfmi dtyrinpqey
 481 ltstacrrnl agdvcaimry hafleqwgli nyqvdaesrp tpmgppptsh fhvladtpsg
 541 lvplqpktpq grqvdadtka grkgkelddl vpetakgkpe lgtsasqqml nfpdkgkekp
 601 tdmqnfglrt dmytkknvps kskaaasatr ewtegetlll lealemykdd wnkvsehvgs
 661 rtqdecilhf lrlpiedpyl edseaslgpl ayqpipfsqs gnpvmstvaf lasvvdprva
 721 saaaksalee fskmkeevpt alveahvrkv eeaakvtgka dpafglessg iagttsdepe
 781 rieesgndea rvegqatdek kepkepregg gaieeeakek tseapkkdee kgkegdseke
 841 seksdgdpiv dpekekepke gqeevlkevv esegerktkv erdigegnls taaaaalaaa
 901 avkakhlaav eerkikslva llvetqmkkl eiklrhfeel etimdrerea leygrqqlla
 961 drqafhmeql kyaemrargq hfqqmhqqqq qpppalppgs qpipptgaag ppavhglava
1021 pasvvpapag sgappgslgp segiggagst agpqqqqpag apqpgavppg vpppgphgps
1081 pfpnqqtpps mmpgavpgsg hpgvaaqspa ivaavggnll psasplpdpg tplppdptap
1141 spgtvtpvpp pq
```

SEQ ID NO: 49 Human SMARCC2 cDNA Sequence Variant 4 (NM_001330288.1, CDS: 114-3851)

```
   1 ggaggcggcg gccgcggcgg cgggaggcgg cgggaggcgg gcggaggagg aggcggagga
  61 ggcgggagct gagctgagtg gggcggcgg cggcggggcc cgagccggag aagatggcgg
 121 tgcggaagaa ggacggcggc cccaacgtga agtactacga ggccgcggac accgtgaccc
```

TABLE 1-continued 181 agttcgacaa cgtgcggctg tggctcggca agaactacaa gaagtatata caagctgaac
241 cacccaccaa caagtccctg tctagcctgg ttgtacagtt gctacaattt caggaagaag
301 tttttggcaa acatgtcagc aatgcaccgc tcactaaact gccgatcaaa tgtttcctag
361 atttcaaagc gggaggctcc ttgtgccaca ttcttgcagc tgcctacaaa ttcaagagtg
421 accagggatg gcggcgttac gatttccaga atccatcacg catggaccgc aatgtggaaa
481 tgtttatgac cattgagaag tccttggtgc agaataattg cctgtctcga cctaacattt
541 ttctgtgccc agaaattgag cccaaactac tagggaaatt aaaggacatt atcaagagac
601 accagggaac agtcactgag gataagaaca atgcctccca tgttgtgtat cctgtcccgg
661 ggaatctaga agaagaggaa tgggtacgac cagtcatgaa gagggataag caggttcttc
721 tgcactgggg ctactatcct gacagttacg acacgtggat cccagcgagt gaaattgagg
781 catctgtgga agatgctcca actcctgaga aacctaggaa ggttcatgca aagtggatcc
841 tggacaccga caccttcaat gaatggatga atgaggaaga ctatgaagta aatgatgaca
901 aaaaccctgt ctcccgccga aagaagattt cagccaagac actgacagat gaggtgaaca
961 gcccagattc agatcgacgg gacaagaagg ggggaaacta taagaagagg aagcgctccc
1021 cctctccttc accaacccca gaagcaaaga agaaaaatgc taagaaaggt ccctcaacac
1081 cttacactaa gtcaaagcgt ggccacagag aagaggagca agaagacctg acaaaggaca
1141 tggacgagcc ctcaccagtc cccaatgtag aagaggtgac acttcccaaa acagtcaaca
1201 caaagaaaga ctcagagtcg gccccagtca aaggcggcac catgaccgac ctggatgaac
1261 aggaagatga aagcatggag acgacgggca aggatgagga tgagaacagt acggggaaca
1321 agggagagca gaccaagaat ccagacctgc atgaggacaa tgtgactgaa cagacccacc
1381 acatcatcat tcccagctac gctgcctggt ttgactacaa tagtgttcat gccattgagc
1441 ggagggctct ccccgagttc ttcaacggca agaacaagtc caagactcca gagatctacc
1501 tggcctatcg aaactttatg attgacactt accgactgaa cccccaagag tatcttacct
1561 ctaccgcctg ccgccgaaac ctagcgggtg atgtctgtgc catcatgagg gtccatgcct
1621 tcctagaaca gtggggtctt attaactacc aggtggatgc tgagagtcga ccaaccccaa
1681 tggggcctcc gcctacctct cacttccatg tcttggctga cacaccatca gggctggtgc
1741 ctctgcagcc caagacacct cagggccgcc aggttgatgc tgataccaag gctgggcgaa
1801 agggcaaaga gctggatgac ctggtgccag agacggctaa gggcaagcca gagctgcaga
1861 cctctgcttc ccaacaaatg ctcaactttc ctgacaaagg caaagagaaa ccaacagaca
1921 tgcaaaactt tgggctgcgc acagacatgt acacaaaaaa gaatgttccc tccaagagca
1981 aggctgcagc cagtgccact cgtgagtgga cagaacagga aaccctgctt ctcctggagg
2041 cactggaaat gtacaaagat gactggaaca aagtgtccga gcatgtggga agccgcacac
2101 aggacgagtg catcttgcat tttcttcgtc ttcccattga agacccatac ctggaggact
2161 cagaggcctc cctaggcccc ctggcctacc aacccatccc cttcagtcag tcgggcaacc
2221 ctgttatgag cactgttgcc ttcctggcct ctgtcgtcga tccccgagtc gcctctgctg
2281 ctgcaaagtc agccctagag gagttctcca aaatgaagga agaggtaccc acggccttgg
2341 tggaggccca tgttcgaaaa gtggaagaag cagccaaagt aacaggcaag gcggaccctg
2401 ccttcggtct ggaaagcagt ggcattgcag gaaccacctc tgatgagcct gagcggattg
2461 aggagagcgg gaatgacgag gctcgggtgg aaggccaggc cacagatgag aagaaggagc
2521 ccaaggaacc ccgagaagga gggggtgcta tagaggagga agcaaaagag aaaaccagcg
2581 aggctcccaa gaaggatgag gagaaaggga aagaaggcga cagtgagaag gagtccgaga
2641 agagtgatgg agacccaata gtcgatcctg agaaggagaa ggagccaaag gaagggcagg
2701 aggaagtgct gaaggaagtg gtggagtctg agggggaaag gaagacaaag gtggagcggg
2761 acattggcga gggcaacctc tccaccgctg ctgccgccgc cctggccgcc gccgcagtga
2821 aagctaagca cttggctgct gttgaggaaa ggaagatcaa atctttggtg gccctgctgg
2881 tggagaccca gatgaaaaag ttggagatca aacttcggca ctttgaggag ctggagacta
2941 tcatggaccg ggagcgagaa gcactggagt atcagaggca gcagctcctg gccgacagac
3001 aagccttcca catggagcag ctgaagtatg cggagatgag ggctcggcag cagcacttcc
3061 aacagatgca ccaacagcag cagcagccac caccagccct gcccccaggc tcccagccta
3121 tcccccccaac aggggctgct gggccacccg cagtccatgg cttggctgtg gctccagcct
3181 ctgtagtccc tgctcctgct ggcagtgggg cccctccagg aagtttgggc ccttctgaac
3241 agattgggca ggcagggtca actgcagggc cacagcagca gcaaccagct ggagcccccc
3301 agcctggggc agtcccacca ggggttcccc cccctggacc ccatggcccc tcaccgttcc
3361 ccaaccaaca aactcctccc tcaatgatgc caggggcagt gccaggcagc gggcacccag
3421 gcgtggcggg taatgctcct ttgggtttgc cttttggcat gccgcctcct cctcctcctc
3481 ctgctccatc catcatccca tttggtagtc tagctgactc catcagtatt aacctccccg
3541 ctcctcctaa cctgcatggg catcaccacc atctcccgtt cgccccgggc actctccccc
3601 cacctaacct gcctgtgtcc atggcgaacc ctctacatcc taacctgccg gcgaccacca
3661 ccatgccatc ttccttgcct ctcgggccgg ggctcggatc cgccgcagcc caaagccctg
3721 ccattgtggc agctgttcag ggcaacctcc tgcccagtgc cagcccactg ccagacccag
3781 gcacccccct gcctccagac cccacagccc cgagcccagg cacggtcacc cctgtgccac
3841 ctccacagtg aggagccagc cagacatctc tccccctcac cccctgtgga catcacggtt
3901 ccaggaacag cccttccccc accactggga ccctccccag cctggagagt tcatcactac
3961 gtaaggaaag ctccttccgc ccctccaaag ccctcaccat gcctaacaga ggcatgcatt
4021 tttatatcag attattcaag gacttctgtt taaaagatgt ttataatgtc tgggagagag
4081 gataggatgg gaatgctgcc ctaaaggaag ggctggtgaa aggtgtttat acaaggttct
4141 attaaccact tctaagggta cacctccctc caaactactg cattttctat ggattaaaaa
4201 aaaaaaaaaa aagtagattt taaaaagcca cattggagct cccttctacc cactaaaaaa
4261 taaccaattt ttacattttt tgagggggag tgagttttag gaaaggggaa ttaagattcc
4321 agggagagct ctggggatag aacagggcgc agattccatc tctccccaag ccccttttta
4381 gtgactaagt caaggcccca actcccctcc cccaccctac gctgagctta ttcgagttca
4441 ttcgtactaa taatccctcc tgcggcttcc tcattgttgc tgttttaggc caccccagct
4501 cagccaatga ttcctttccc tctgaatgtc agttttgttt ttaaaagtca cttgcttagt
4561 tgatgtcagc gtatgtgtat ttggtgggga aaacctaatt tcggggattt ctgtggtagg
4621 taataggaga agaaagggca ctgggggctg ttctccttcc ttccctgggc tgtatccatg
4681 gactcctgga aggcacagag aagggagcta taagaggatg tgaagtttta aaacctgaaa
4741 ttgtttttta aagcacttaa gcacctccat attatgactt ggtgggtcac cccttagctt
4801 cctccctctc ccaccaagac tatgagaact tcagctgata gctgggggct ccccagatga
4861 ggatgcaggg atttgggagc agtggaagag ggtgcccaac cttgggttgg accaaccctt
4921 ggctcgcagc tcaactctgc ttcccgcatt cctgctccac gtgtcccagc ttctcccctg TABLE 1-continued

```
4981 tgacgggaag gcaggtgtga ctccaggctc tgcactggtt cttcttggtt cctcccacca
5041 ggccctttgt tcctcatgtc cccatgtttc tctccctctg cgtcttagca cctttcttct
5101 gttcaaagtt ttctgtaaat ttctcttttt tttctttctt tctttttttt ttttttataa
5161 attaatttgc tttcagttcc aaaaaaaaaa aaaaaaaaa
```

SEQ ID NO: 50 Human SMARCC2 Amino Acid Sequence Isoform D (NP_001317217.1)

```
   1 mavrkkdggp nvkyyeaadt vtqfdnvrlw lgknykkyiq aepptnksls slvvqllqfq
  61 eevfgkhvsn apltklpikc fldfkaggsl chilaaaykf ksdqgwrryd fqnpsrmdrn
 121 vemfmtieks lvqnnclsrp niflcpeiep kllgklkdii krhqgtvted knnashvvyp
 181 vpgnleeeew vrpvmkrdkq vllhwgyypd sydtwipase ieasvedapt pekprkvhak
 241 wildtdtfne wmneedyevn ddknpvsrrk kisaktltde vnspdsdrrd kkggnykkrk
 301 rspspsptpe akkknakkgp stpytkskrg hreeeqedlt kdmdepspvp nveevtlpkt
 361 vntkkdsesa pvkggtmtdl deqedesmet tgkdedenst gnkgeqtknp dlhednvteq
 421 thhiiipsya awfdynsvha ierralpeff ngknksktpe iylayrnfmi dtyrinpqey
 481 ltstacrrnl agdvcaimrv hafleqwgli nyqvdaesrp tpmgppptsh fhvladtpsg
 541 lvplqpktpq grqvdadtka grkgkelddl vpetakgkpe lqtsasqqml nfpdkgkekp
 601 tdmqnfglrt dmytkknvps kskaaasatr ewtegetlll lealemykdd wnkvsehvgs
 661 rtqdecilhf lrlpiedpyl edseaslgpl ayqpipfsqs gnpvmstvaf lasvvdprva
 721 saaaksalee fskmkeevpt alveahvrkv eeaakvtgka dpafglessg iagttsdepe
 781 rieesgndea rvegqatdek kepkepregg gaieeeakek tseapkkdee kgkegdseke
 841 seksdgdpiv dpekekepke gqeevlkevv esegerktkv erdigegnls taaaaalaaa
 901 avkakhlaav eerkikslva llvetqmkkl eiklrhfeel etimdrerea leyqrqqlla
 961 drqafhmeql kyaemrargq hfqqmhqqqq qpppalppgs qpipptgaag ppavhglava
1021 pasvvpapag sgappgslgp segiggagst agpqqqqpag apqpgavppg vpppgphgps
1081 pfpnqqtpps mmpgavpgsg hpgvagnapl glpfgmpppp pppapsiipf gsladsisin
1141 lpappnlhgh hhhlpfapgt lpppnlpvsm anplhpnlpa tttmpsslpl gpglgsaaaq
1201 spaivaavqg nllpsasplp dpgtplppdp tapspgtvtp vpppq
```

SEQ ID NO: 51 Mouse SMARCC2 cDNA Sequence Variant 1 (NM_001114097.1, CDS: 92-3733)

```
   1 gtggcggcgg gaggcggcgg gaggcgggcg gaggaggagg cgggagctga gctgagcggg
  61 gcgggcggcg gcggggcccg agcccgagaa gatggcggtg cggaagaagg acggcggccc
 121 caacgtgaag tactacgagg ccgcggacac cgtgacccag ttcgacaacg tgcggctctg
 181 gctcggcaag aactacaaga agtacataca agcagaaccg ccaaccaaca agtctctgtc
 241 cagcctggtg gtgcagttgc tccagtttca ggaagaggtt tttggcaaac atgtcagcaa
 301 cgcaccgctt actaaactgc cgatcaaatg tttcctagat ttcaaagcag gaggatccct
 361 ctgccatatt cttgcagctg cctacaaatt caagagtgac cagggatggc ggcgttacga
 421 tttccagaat ccatcacgca tggaccgcaa tgtggaaatg ttcatgacca ttgagaagtc
 481 cttggtacag aataattgcc tgtcacgacc taacattttc ctctgcccag aaattgagcc
 541 caaactgcta gggaaattaa aagacattgt taagagacac cagggaacca tctctgagga
 601 taagagcaat gcctcccatg ttgtgtatcc tgtcccaggg aacctagaag aagaggaatg
 661 ggtacggcca gtcatgaaga gggataaaca ggttcttctg cactggggct actatcctga
 721 cagctacgac acgtggatcc cagcgagtga aattgaagca tctgtggagg acgctcccac
 781 tcctgagaaa ccgaggaagg tccatgcgaa gtggatcctc gacaccgaca cattcaacga
 841 gtggatgaat gaggaagact acgaagtcag tgacgacaaa agcccagtct cccgcaggaa
 901 gaagatctca gccaagacgc tgacagacga ggtaaacagc ccagattcag acagacgaga
 961 caagaagggg ggcaactata agaagaggaa gcgctctccc tctccttcac ccaccccaga
1021 ggctaagaag aaaaacgcta agaaaggacc ctcaacacct tataccaagt caaagcgagg
1081 ccacagagaa gaggaacaag aagacctgac aaaagacatg gatgagccct ctccagtccc
1141 aaacgtggaa gaggtgacac tccccaaaac agtcaacact aaaaaggact ctgagtcagc
1201 cccagtcaaa ggcggcacca tgactgacct ggatgaacag gacgatgaaa gcatggagac
1261 caccggcaag gacgaggatg agaacagcac gggcaacaaa ggcgagcaga cgaagaaccc
1321 ggacctgcat gaggacaatg tgaccgagca gacccaccac atcatcatcc ccagctacgc
1381 cgcctggttt gactacaaca gcgtccatgc cattgaacgg agggctcttc ctgagttctt
1441 caacggcaag aacaagtcta agactccaga gatctacctg gcgtatcgga acttcatgat
1501 tgacacttac cgactgaatc cccaggagta tctaacatct actgcctgtc ggcggaattt
1561 ggcgggtgat gtctgcgcta tcatgagggt ccatgccttc ctggaacagt ggggtcttat
1621 taactaccag gtagatgctg agagccgacc aaccccaatg ggccctccac ccacctctca
1681 cttccatgtc ttggcggaca caccatcagg gctggttcct cttcagccga agcctccaca
1741 gcagagctct gcttcccagc aaatgctgaa cttccctgag aagggcaagg agaaaccagc
1801 agacatgcag aattttgggc tgcgcacaga catgtacaca aagaagaacg tcccctccaa
1861 gagcaaagct gcagcaagtg ccactcggga atggacggag caggagactc tgctgctcct
1921 ggaggctttg gaaatgtaca aggacgactg gaacaaagta tctgagcacg tgggaagccg
1981 cacgcaggac gagtgcatct tgcattttct ccgccttccc attgaagacc catacctgga
2041 ggactcggag gcttctctag gccctctggc ctaccaaccc atccccttca gtcagtcagg
2101 caaccctgtt atgagcaccg ttgccttcct ggcctctgtc gtcgatcccc gagttgcctc
2161 tgctgctgcg aagtcagccc tagaagagtt ctcaaaaatg aaggaagagg tgcccacagc
2221 tttggtggaa gcccacgtgc gtaaggtcga agaagcggcc aaagtcacag gcaaggccga
2281 cccagccttt ggtctggaga gtagcggcat cgcagggact gcctctgatg agcctgagcg
2341 cattgaggaa agcgggactg aggaggcacg gccagagggc caggcagcag atgagaagaa
2401 ggagcctaag gaaccacggg aaggaggggg cgctgtggag gaagaagcaa aggaggaaat
2461 aagtgaggtc cccaagaaag atgaagagaa agggaaagaa ggtgacagtg agaaggagtc
2521 tgagaagagt gacggggacc cgatagttga tcctgagaaa gacaaggaac caacagaagg
2581 gcaggaggaa gtgctaaagg aagtggcaga gccagagggg gagaggaaaa ccaaggtgga
2641 gcgtgacatt ggtgaaggca acctgtccac agctgcagcc gcagccctgg ccgctgctgc
2701 agtcaaggcc aagcacttgg ctgcagttga ggagagaaag atcaagtctt tggtggctct
2761 gctggtagag acccaaatga agaaactaga gatcaaactc cgacattttg aggagctgga
2821 gacaataatg gaccgggagc gagaggcgct ggaataccag aggcagcagc tcctggccga
2881 ccggcaagcc ttccacatgg agcagctgaa gtatgcagag atgagggccc ggcagcagca
2941 cttccagcag atgcaccagc agcagcagca gcagccacca accttgcccc caggctccca
```

TABLE 1-continued

```
3001 gcccatacct cccaccgggg ctgctggacc acctacagtc catggtctag ctgtgcctcc
3061 agccgctgtg gcctctgccc ctcctggcag tggggcccct cctggaagct tgggcccttc
3121 tgaacagatt gggcaggcag ggacaactgc agggccacag cagccacaac aagctggagc
3181 ccctcagcct ggggcagtcc caccaggggt accccccct ggaccccatg gcccctcacc
3241 gttccccaac caaccaactc ctccctcaat gatgccaggg gcagtgccag gcagcgggca
3301 cccaggcgtg gcgggtaatg ctcctttggg tttgcctttt ggcatgccgc ctcctcctcc
3361 tgctgctcca tccgtcatcc cattcggtag tctagctgac tccattagta ttaaccttcc
3421 ccctcctcct aacctgcatg ggcatcacca ccatctcccg tttgccccgg gcactatccc
3481 cccacctaac ctgcctgtgt ccatggcgaa ccctctacat cctaacctgc cggcgaccac
3541 caccatgcca tcttccttgc ctctcgggcc ggggctcgga tccgccgcag cccagagccc
3601 tgccattgtg gcagctgttc agggcaacct cctgcccagt gccagcccac tgccagaccc
3661 aggcaccccg ctgcctccag accccacagc tccaagccca ggcacagtca cccctgtgcc
3721 acctccacag tgaggaacca gccagccatc tctcccctc actccccatg gagatcacag
3781 ttccaggaac agccctcccc cactactggg accctccctc agcctgaaga gttcatcact
3841 acgtaaggaa agctcctcct gccccctcac cacccccacc atgcccagca gaggtgtgca
3901 gtttatatc caattattat ccacggactt ctgactaaaa gatgtttcta atgcctggga
3961 gagagaatag gagggaaaga tgtttatacg aggttctact aactggttct gagggtctac
4021 cccttcagaa ttactgcatt tttgaagtga taacatgaaa atgaaaccct ttaaaaggga
4081 ggttttaaaa aaagacactt cggagcccac aaaaaaagaa cttttttaat tattattatt
4141 attattttga ggggaaaggg caggttttaa gaggaattaa atttctgggg caaggtgtga
4201 ggtggaatag ggcaccgagc ctgtctccct gagcccttgg cagtgctgag tcagctcccc
4261 tcacccattc cagtttattc atacaaatcc ctcctgctgc tcgtcatggt tgctgtttta
4321 ggcccagttc agccaatgac cttttcctcc agtcagcttt gtgtttgtgt ttaagtcacc
4381 tgcttactcg tcagcgtctg tgtacttgtg ggaaatgtag ttttcgggga ttctgtggta
4441 ggaaatagag gaagaagggg cctcagttgg gctcttcttc ctgctttcct agttgtatct
4501 gtgagtgccc aacaggcatc agaggggggag ctctaagagg atggggggcc tgcagaccct
4561 caagtttgaa aagcacttaa gcacctactt ttgacagtgg gacagtctgc taacttctgc
4621 ccccaccaac caagcctgac agaacccagt gatagctagg agttccccaa atgaggacaa
4681 agatttggga gcagtgcagc gtgcctctgc actccaggtc ttcctcttca ccccctactt
4741 ggaggcagac acaattccag gccgcaccag agcctggccc ctcccaccag gcgctttgct
4801 ccttctgtcc cagcgtctcc ttcctctgca tctccacacc tttcttctgt tcaaagtctt
4861 ctgtaaaatt ttctttcctt ctttgttctt ttctttttcc ttttttttt ataaattaat
4921 ttgctttcag ttccaaaaaa aaaaaaaaaa aaaaaaaaaa aaaa
```

SEQ ID NO: 52 Mouse SMARCC2 Amino Acid Sequence Isoform 1 (NP_001107569.1)

```
   1 mavrkkdggp nvkyyeaadt vtqfdnvrlw lgknykkyiq aepptnksls slvvqllfq
  61 eevfgkhvsn apltklpikc fldfkaggsl chilaaaykf ksdqgwrryd fqnpsrmdrn
 121 vemfmtieks lvqnnclsrp niflcpeiep kllgklkdiv krhqgtised ksnashvvyp
 181 vpgnleeeew vrpvmkrdkq vllhwgyypd sydtwipase ieasvedapt pekprkvhak
 241 wildtdtfne wmneedyevs ddkspvsrrk kisaktltde vnspdsdrrd kkggnykkrk
 301 rspspsptpe akkknakkgp stpytkskrg hreeeqedlt kdmdepspvp nveevtlpkt
 361 vntkkdsesa pvkggtmtdl deqddesmet tgkdedenst gnkgeqtknp dlhednvteq
 421 thhiiipsya awfdynsvha ierralpeff ngknksktpe iylayrnfmi dtyrinpqey
 481 ltstacrrnl agdvcaimry hafleqwgli nyqvdaesrp tpmgppptsh fhvladtpsg
 541 lvplqpkppq qssasqqmln fpekgkekpa dmqnfglrtd mytkknvpsk skaaasatre
 601 wtegetllll ealemykddw nkvsehvgsr tqdecilhfl rlpiedpyle dseaslgpla
 661 yqpipfsgsg npvmstvafl asvvdprvas aaaksaleef skmkeevpta lveahvrkve
 721 eaakvtgkad pafglessgi agtasdeper ieesgteear pegqaadekk epkepreggg
 781 aveeeakeei sevpkkdeek gkegdsekes eksdgdpivd pekdkepteg qeevlkevae
 841 pegerktkve rdigegnlst aaaaalaaaa vkakhlaave erkikslval lvetqmkkle
 901 iklrhfeele timdrereal eygrqqllad rqafhmeglk yaemrarqqh fqqmhqqqqq
 961 qpptlppgsq pipptgaagp ptvhglavpp aavasappgs gappgslgps eqigqagtta
1021 gpqqpqqaga pqpgavppgv pppgphgpsp fpnqptppsm mpgavpgsgh pgvagnaplg
1081 lpfgmppppp aapsvipfgs ladsisinlp pppnlhghhh hlpfapgtip ppnlpvsman
1141 plhpnlpatt tmpsslplgp glgsaaaqsp aivaavggnl lpsasplpdp gtplppdpta
1201 pspgtvtpvp ppq
```

SEQ ID NO: 53 Mouse SMARCC2 cDNA Sequence Variant 2 (NM_001114096.1, CDS: 92-3484)

```
   1 gtggcggcgg gaggcggcgg gaggcgggcg gaggaggagg cgggagctga gctgagcggg
  61 gcgggcggcg gcggggcccg agcccgagaa gatggcggtg cggaagaagg acggcggccc
 121 caacgtgaag tactacgagg ccgcggacac cgtgacccag ttcgacaacg tgcggctctg
 181 gctcggcaag aactacaaga agtacataca agcagaaccg ccaaccaaca agtctctgtc
 241 cagcctggtg gtgcagttgc tccagtttca ggaagaggtt tttggcaaac atgtcagcaa
 301 cgcaccgctt actaaactgc cgatcaaatg tttcctagat ttcaaagcag gaggatccct
 361 ctgccatatt cttgcagctg cctacaaatt caagagtgac cagggatggc ggcgttacga
 421 tttccagaat ccatcacgca tggaccgcaa tgtggaaatg ttcatgacca ttgagaagtc
 481 cttggtacag aataattgcc tgtcacgacc taacattttc ctctgcccag aaattgagcc
 541 caaactgcta gggaaattaa aagacattgt taagagacac cagggaacca tctctgagga
 601 taagagcaat gcctcccatg ttgtgtatcc tgtcccaggg aacctagaag aagaggaatg
 661 ggtacggcca gtcatgaaga gggataaaca ggttcttctg cactggggct actatcctga
 721 cagctacgac acgtggatcc cagcgagtga aattgaagca tctgtggagg acgctcccac
 781 tcctgagaaa ccgaggaagg tccatgcgaa gtggatcctc gacaccgaca cattcaacga
 841 gtggatgaat gaggaagact acgaagtcag tgacgacaaa agcccagtct cccgcaggaa
 901 gaagatctca gccaagacgc tgacagacga ggtaaacagc ccagattcag acagacgaga
 961 caagaagggg ggcaactata agaagaggaa gcgctctccc tctccttcac ccaccccaga
1021 ggctaagaag aaaaacgcta agaaaggacc ctcaacacct tataccaagt caaagcgagg
1081 ccacagagaa gaggaacaag aagacctgac aaaagacatg gatgagccct ctccagtccc
1141 aaacgtggaa gaggtgacac tccccaaaac agtcaacact aaaaaggact ctgagtcagc
1201 cccagtcaaa ggcggcacca tgactgacct ggatgaacag gacgatgaaa gcatggagac
```

TABLE 1-continued

```
1261 caccggcaag gacgaggatg agaacagcac gggcaacaaa ggcgagcaga cgaagaaccc
1321 ggacctgcat gaggacaatg tgaccgagca gacccaccac atcatcatcc ccagctacgc
1381 cgcctggttt gactacaaca gcgtccatgc cattgaacgg agggctcttc ctgagttctt
1441 caacggcaag aacaagtcta agactccaga gatctacctg gcgtatcgga acttcatgat
1501 tgacacttac cgactgaatc cccaggagta tctaacatct actgcctgtc ggcggaattt
1561 ggcgggtgat gtctgcgcta tcatgagggt ccatgccttc ctggaacagt ggggtcttat
1621 taactaccag gtagatgctg agagccgacc aaccccaatg gggcctccac ccacctctca
1681 cttccatgtc ttggcggaca caccatcagg gctggttcct cttcagccga agcctccaca
1741 gggccgccag gttgatgctg acaccaaggc tgggcggaag ggcaaagagc tggatgacct
1801 ggtgccagag acggctaagg gcaagccaga gctgcagagc tctgcttccc agcaaatgct
1861 gaacttccct gagaagggca aggagaaacc agcagacatg cagaattttg ggctgcgcac
1921 agacatgtac acaaagaaga acgtcccctc caagagcaaa gctgcagcaa gtgccactcg
1981 ggaatggacg gagcaggaga ctctgctgct cctggaggct ttggaaatgt acaaggacga
2041 ctggaacaaa gtatctgagc acgtgggaag ccgcacgcag gacgagtgca tcttgcattt
2101 tctccgcctt cccattgaag acccatacct ggaggactcg gaggcttctc taggccctct
2161 ggcctaccaa cccatcccct tcagtcagtc aggcaacccct gttatgagca ccgttgcctt
2221 cctggcctct gtcgtcgatc cccgagttgc ctctgctgct gcgaagtcag ccctagaaga
2281 gttctcaaaa atgaaggaag aggtgcccac agctttggtg gaagcccacg tgcgtaaggt
2341 cgaagaagcg gccaaagtca caggcaaggc cgacccagcc tttggtctgg agagtagcgg
2401 catcgcaggg actgcctctg atgagcctga gcgcattgag gaaagcggga ctgaggaggc
2461 acggccagag ggccaggcag cagatgagaa gaaggagcct aaggaaccac gggaaggagg
2521 gggcgctgtg gaggaagaag caaaggagga aataagtgag gtccccaaga aagatgaaga
2581 gaaagggaaa gaaggtgaca gtgagaagga gtctgagaag agtgacgggg acccgatagt
2641 tgatcctgag aaagacaagg aaccaacaga agggcaggag gaagtgctaa aggaagtggc
2701 agagccagag ggggagagga aaaccaaggt ggagcgtgac attggtgaag gcaacctgtc
2761 cacagctgca gccgcagccc tggccgctgc tgcagtcaag gccaagcact tggctgcagt
2821 tgaggagaga aagatcaagt ctttggtggc tctgctggta gagacccaaa tgaagaaact
2881 agagatcaaa ctccgacatt ttgaggagct ggagacaata atggaccggg agcgagaggc
2941 gctggaatac cagaggcagc agctcctggc cgaccggcaa gccttccaca tggagcagct
3001 gaagtatgca gagatgaggg cccggcagca gcacttccag cagatgcacc agcagcagca
3061 gcagcagcca ccaaccttgc ccccaggctc ccagcccata cctcccaccg gggctgctgg
3121 accacctaca gtccatggtc tagctgtgcc tccagccgct gtggcctctg cccctcctgg
3181 cagtggggcc cctcctggaa gcttgggccc ttctgaacag attgggcagg cagggacaac
3241 tgcagggcca cagcagccac aacaagctgg agcccctcag cctggggcag tcccaccagg
3301 ggtacccccc cctggacccc atggccccctc accgttcccc aaccaaccaa ctcctccctc
3361 aatgatgcca ggggcagtgc caggcagcgg gcacccaggc gtggcggacc caggcacccc
3421 gctgcctcca gaccccacag ctccaagccc aggcacagtc acccctgtgc cacctccaca
3481 gtgaggaacc agccagccat ctctcccccct cactccccat ggagatcaca gttccaggaa
3541 cagccctccc ccactactgg gaccctccct cagcctgaag agttcatcac tacgtaagga
3601 aagctcctcc tgccccctca ccacccccac catgcccagc agaggtgtgc agttttatat
3661 ccaattatta tccacggact tctgactaaa agatgtttct aatgcctggg agagagaata
3721 ggagggaaag atgtttatac gaggttctac taactggttc tgagggtcta ccccttcaga
3781 attactgcat ttttgaagtg ataacatgaa aatgaaaccc tttaaaaggg aggttttaaa
3841 aaaaagacact tcggagccca caaaaaaaga actttttttaa ttattattat tattattttg
3901 aggggaaagg gcaggtttta agaggaatta aatttctggg gcaaggtgtg aggtggaata
3961 gggcaccgag cctgtctccc tgagcccttg gcagtgctga gtcagctccc ctcacccatt
4021 ccagtttatt catacaaatc cctcctgctg ctcgtcatgg ttgctgtttt aggcccagtt
4081 cagccaatga cctttcctc cagtcagctt tgtgtttgtg tttaagtcac ctgcttactc
4141 gtcagcgtct gtgtacttgt gggaaatgta gttttcgggg attctgtggt aggaaataga
4201 ggaagaaggg gcctcagttg ggctcttctt cctgctttcc tagttgtatc tgtgagtgcc
4261 caacaggcat cagaggggga gctctaagag gatggggggc ctgcagaccc tcaagtttga
4321 aaagcactta agcacctact tttgacagtg ggacagtctg ctaacttctg cccccaccaa
4381 ccaagcctga cagaacccag tgatagctag gagttcccca aatgaggaca aagatttggg
4441 agcagtgcag cgtgcctctg cactccaggt cttcctcttc accccctact tggaggcaga
4501 cacaattcca ggccgcacca gagcctggcc cctcccacca ggcgctttgc tccttctgtc
4561 ccagcgtctc cttcctctgc atctccacac ctttcttctg ttcaaagtct tctgtaaaat
4621 tttctttcct tctttgttct tttctttttc cttttttttt tataaattaa tttgctttca
4681 gttccaaaaa aaaaaaaaaa aaaaaaaaaa aaaaa
```

SEQ ID NO: 54 Mouse SMARCC2 Amino Acid Sequence Isoform 2 (NP_001107568.1)

```
   1 mavrkkdggp nvkyyeaadt vtqfdnvrlw lgknykkyiq aepptnksls slvvqllqfq
  61 eevfgkhvsn apltklpikc fldfkaggsl chilaaaykf ksdqgwrryd fqnpsrmdrn
 121 vemfmtieks lvqnnclsrp niflcpeiep kllgklkdiv krhqgtised ksnashvvyp
 181 vpgnleeeew vrpvmkrdkq vllhwgyypd sydtwipase ieasvedapt pekprkvhak
 241 wildtdtfne wmneedyevs ddkspvsrrk kisaktltde vnspdsdrrd kkggnykkrk
 301 rspspsptpe akkknakkgp stpytkskrg hreeeqedlt kdmdepspvp nveevtlpkt
 361 vntkkdsesa pvkggtmtdl deqddesmet tgkdedenst gnkgeqtknp dlhednvteq
 421 thhiiipsya awfdynsvha ierralpeff ngknksktpe iylayrnfmi dtyrinpqey
 481 ltstacrrnl agdvcaimrv hafleqwgli nyqvdaesrp tpmgppptsh fhvladtpsg
 541 lvplqpkppq grqvdadtka grkgkelddl vpetakgkpe lqssasqqml nfpekgkekp
 601 admqnfglrt dmytkknvps kskaaasatr ewtegetlll lealemykdd wnkvsehvgs
 661 rtqdecilhf lrlpiedpyl edseaslgpl ayqpipfsqs gnpvmstvaf lasvvdprva
 721 saaaksalee fskmkeevpt alveahvrkv eeaakvtgka dpafglessg iagtasdepe
 781 rieesgteea rpegqaadek kepkepregg gaveeeakee isevpkkdee kgkegdseke
 841 seksdgdpiv dpekdkepte gqeevlkeva epegerktkv erdigegnls taaaaalaaa
 901 avkakhlaav eerkikslva llvetqmkkl eiklrhfeel etimdrerea leyqrqqlla
 961 drqafhmeql kyaemrargq hfqqmhqqqq qqpptlppgs qpipptgaag pptvhglavp
1021 paavasappg sgappgslgp segiggagtt agpqqpqqag apqpgavppg vppppgphgps
1081 pfpnqptpps mmpgavpgsg hpgvadpgtp lppdptapsp gtvtpvpppq
```

TABLE 1-continued

SEQ ID NO: 55 Mouse SMARCC2 cDNA Sequence Variant 3 (NM_198160.2, CDS: 92-3391)

```
   1 gtggcggcgg gaggcggcgg gaggcgggcg gaggaggagg cgggagctga gctgagcggg
  61 gcgggcggcg gcggggcccg agcccgagaa gatggcggtg cggaagaagg acggcggccc
 121 caacgtgaag tactacgagg ccgcggacac cgtgacccag ttcgacaacg tgcggctctg
 181 gctcggcaag aactacaaga agtacataca agcagaaccg ccaaccaaca agtctctgtc
 241 cagcctggtg gtgcagttgc tccagtttca ggaagaggtt tttggcaaac atgtcagcaa
 301 cgcaccgctt actaaactgc cgatcaaatg tttcctagat ttcaaagcag gaggatccct
 361 ctgccatatt cttgcagctg cctacaaatt caagagtgac cagggatggc ggcgttacga
 421 tttccagaat ccatcacgca tggaccgcaa tgtggaaatg ttcatgacca ttgagaagtc
 481 cttggtacag aataattgcc tgtcacgacc taacattttc ctctgcccag aaattgagcc
 541 caaactgcta gggaaattaa aagacattgt taagagacac cagggaacca tctctgagga
 601 taagagcaat gcctcccatg ttgtgtatcc tgtcccaggg aacctagaag aagaggaatg
 661 ggtacggcca gtcatgaaga gggataaaca ggttcttctg cactggggct actatcctga
 721 cagctacgac acgtggatcc cagcgagtga aattgaagca tctgtggagg acgctcccac
 781 tcctgagaaa ccgaggaagg tccatgcgaa gtggatcctc gacaccgaca cattcaacga
 841 gtggatgaat gaggaagact acgaagtcag tgacgacaaa agcccagtct cccgcaggaa
 901 gaagatctca gccaagacgc tgacagacga ggtaaacagc ccagattcag acagacgaga
 961 caagaagggg ggcaactata agaagaggaa gcgctctccc tctccttcac ccaccccaga
1021 ggctaagaag aaaaacgcta agaaaggacc ctcaacacct tataccaagt caaagcgagg
1081 ccacagagaa gaggaacaag aagacctgac aaaagacatg gatgagccct ctccagtccc
1141 aaacgtggaa gaggtgacac tccccaaaac agtcaacact aaaaaggact ctgagtcagc
1201 cccagtcaaa ggcggcacca tgactgacct ggatgaacag gacgatgaaa gcatggagac
1261 caccggcaag gacgaggatg agaacagcac gggcaacaaa ggcgagcaga cgaagaaccc
1321 ggacctgcat gaggacaatg tgaccgagca gacccaccac atcatcatcc ccagctacgc
1381 cgcctggttt gactacaaca gcgtccatgc cattgaacgg agggctcttc ctgagttctt
1441 caacggcaag aacaagtcta agactccaga gatctacctg gcgtatcgga acttcatgat
1501 tgacacttac cgactgaatc cccaggagta tctaacatct actgcctgtc ggcggaattt
1561 ggcgggtgat gtctgcgcta tcatgagggt ccatgccttc ctggaacagt ggggtcttat
1621 taactaccag gtagatgctg agagccgacc aaccccaatg gggcctccac ccacctctca
1681 cttccatgtc ttggcggaca caccatcagg gctggttcct cttcagccga agcctccaca
1741 gcagagctct gcttcccagc aaatgctgaa cttccctgag aagggcaagg agaaaccagc
1801 agacatgcag aattttgggc tgcgcacaga catgtacaca aagaagaacg tcccctccaa
1861 gagcaaagct gcagcaagtg ccactcggga atggacggag caggagactc tgctgctcct
1921 ggaggctttg gaaatgtaca aggacgactg gaacaaagta tctgagcacg tgggaagccg
1981 cacgcaggac gagtgcatct tgcattttct ccgccttccc attgaagacc catacctgga
2041 ggactcggag gcttctctag gccctctggc ctaccaaccc atccccttca gtcagtcagg
2101 caaccctgtt atgagcaccg ttgccttcct ggcctctgtc gtcgatcccc gagttgcctc
2161 tgctgctgcg aagtcagccc tagaagagtt ctcaaaaatg aaggaagagg tgcccacagc
2221 tttggtggaa gcccacgtgc gtaaggtcga agaagcggcc aaagtcacag gcaaggccga
2281 cccagccttt ggtctggaga gtagcggcat cgcagggact gcctctgatg agcctgagcg
2341 cattgaggaa agcgggactg aggaggcacg gccagagggc caggcagcag atgagaagaa
2401 ggagcctaag gaaccacggg aaggaggggg cgctgtggag gaagaagcaa aggaggaaat
2461 aagtgaggtc cccaagaaag atgaagagaa agggaaagaa ggtgacagtg agaaggagtc
2521 tgagaagagt gacggggacc cgatagttga tcctgagaaa gacaaggaac caacagaagg
2581 gcaggaggaa gtgctaaagg aagtggcaga gccagagggg gagaggaaaa ccaaggtgga
2641 gcgtgacatt ggtgaaggca acctgtccac agctgcagcc gcagccctgg ccgctgctgc
2701 agtcaaggcc aagcacttgg ctgcagttga ggagagaaag atcaagtctt tggtggctct
2761 gctggtagag acccaaatga agaaactaga gatcaaactc cgacattttg aggagctgga
2821 gacaataatg gaccgggagc gagaggcgct ggaataccag aggcagcagc tcctggccga
2881 ccggcaagcc ttccacatgg agcagctgaa gtatgcagag atgagggccc ggcagcagca
2941 cttccagcag atgcaccagc agcagcagca gcagccacca accttgcccc caggctccca
3001 gcccatacct cccaccgggg ctgctggacc acctacagtc catggtctag ctgtgcctcc
3061 agccgctgtg gcctctgccc ctcctggcag tggggcccct cctggaagct tgggcccttc
3121 tgaacagatt gggcaggcag ggacaactgc agggccacag cagccacaac aagctggagc
3181 ccctcagcct ggggcagtcc caccaggggt acccccccct ggaccccatg gcccctcacc
3241 gttccccaac caaccaactc ctccctcaat gatgccaggg gcagtgccag gcagcgggca
3301 cccaggcgtg gcggacccag gcaccccgct gcctccagac cccacagctc caagcccagg
3361 cacagtcacc cctgtgccac ctccacagtg aggaaccagc cagccatctc tcccccctcac
3421 tccccatgga gatcacagtt ccaggaacag ccctccccca ctactgggac cctccctcag
3481 cctgaagagt tcatcactac gtaaggaaag ctcctcctgc cccctcacca cccccaccat
3541 gcccagcaga ggtgtgcagt tttatatcca attattatcc acggacttct gactaaaaga
3601 tgtttctaat gcctgggaga gagaatagga gggaaagatg tttatacgag gttctactaa
3661 ctggttctga gggtctaccc cttcagaatt actgcatttt tgaagtgata acatgaaaat
3721 gaaacccttt aaaagggagg ttttaaaaaa agacacttcg gagcccacaa aaaaagaact
3781 tttttaatta ttattattat tattttgagg ggaaagggca ggttttaaga ggaattaaat
3841 ttctggggca aggtgtgagg tggaataggg caccgagcct gtctccctga gcccttggca
3901 gtgctgagtc agctcccctc acccattcca gtttattcat acaaatccct cctgctgctc
3961 gtcatggttg ctgttttagg cccagttcag ccaatgacct tttcctccag tcagctttgt
4021 gtttgtgttt aagtcacctg cttactcgtc agcgtctgtg tacttgtggg aaatgtagtt
4081 ttcggggatt ctgtggtagg aaatagagga agaaggggcc tcagttgggc tcttcttcct
4141 gctttcctag ttgtatctgt gagtgcccaa caggcatcag agggggagct ctaagaggat
4201 ggggggcctg cagaccctca agtttgaaaa gcacttaagc acctactttt gacagtggga
4261 cagtctgcta acttctgccc ccaccaacca agcctgacag aacccagtga tagctaggag
4321 ttccccaaat gaggacaaag atttgggagc agtgcagcgt gcctctgcac tccaggtctt
4381 cctcttcacc ccctacttgg aggcagacac aattccaggc cgcaccagag cctggcccct
4441 cccaccaggc gctttgctcc ttctgtccca gcgtctcctt cctctgcatc tccacacctt
4501 tcttctgttc aaagtcttct gtaaaatttt ctttccttct ttgttctttt ctttttcctt
4561 ttttttttat aaattaattt gctttcagtt ccaaaaaaaa aaaaaaaaaa aaaaaaaaaa
4621 aa
```

TABLE 1-continued

SEQ ID NO: 56 Mouse SMARCC2 Amino Acid Sequence Isoform 3 (NP_937803.1)
1 mavrkkdggp nvkyyeaadt vtqfdnvrlw lgknykkyiq aepptnksls slvvqllqfq
61 eevfgkhvsn apltklpikc fldfkaggsl chilaaaykf ksdqgwrryd fqnpsrmdrn
121 vemfmtieks lvqnnclsrp niflcpeiep kllgklkdiv krhqgtised ksnashvvyp
181 vpgnleeeew vrpvmkrdkq vllhwgyypd sydtwipase ieasvedapt pekprkvhak
241 wildtdtfne wmneedyevs ddkspvsrrk kisaktltde vnspdsdrrd kkggnykkrk
301 rspspsptpe akkknakkgp stpytkskrg hreeeqedlt kdmdepspvp nveevtlpkt
361 vntkkdsesa pvkggtmtdl deqddesmet tgkdedenst gnkgeqtknp dlhednvteq
421 thhiiipsya awfdynsvha ierralpeff ngknksktpe iylayrnfmi dtyrinpqey
481 ltstacrrnl agdvcaimry hafleqwgli nyqvdaesrp tpmgppptsh fhvladtpsg
541 lvplqpkppq qssasqqmln fpekgkekpa dmqnfglrtd mytkknvpsk skaaasatre
601 wteqetllll ealemykddw nkvsehvgsr tqdecilhfl rlpiedpyle dseaslgpla
661 yqpipfsgsg npvmstvafl asvvdprvas aaaksaleef skmkeevpta lveahvrkve
721 eaakvtgkad pafglessgi agtasdeper ieesgteear pegqaadekk epkepreggg
781 aveeeakeei sevpkkdeek gkegdsekes eksdgdpivd pekdkepteg qeevlkevae
841 pegerktkve rdigegnlst aaaaalaaaa vkakhlaave erkikslval lvetqmkkle
901 iklrhfeele timdrereal eygrqqllad rqafhmeqlk yaemrarqqh fqqmhqqqqq
961 qpptlppgsq pipptgaagp ptvhglavpp aavasappgs gappgslgps eqigqagtta
1021 gpqqpqqaga pqpgavppgv pppgphgpsp fpnqptppsm mpgavpgsgh pgvadpgtpl
1081 ppdptapspg tvtpvpppq SEQ ID NO: 57 Human SMARCD1 cDNA Sequence Variant 1 (NM_003076.4, CDS: 171-1718)
1 agcacgcctt ttccgctagt cgccccgctc tatcccatag tctcgctgcc ctgagcctcc
61 cgtgccggcc ggccggccgg gggaacaggc gggcgctcgg ggggcgctcg gggggcgggg
121 ggagttccgg ttccggttct ttgtgcggct gcatcggcgg ctccgggaag atggcggccc
181 gggcgggttt ccagtctgtg gctccaagcg gcggcgccgg agcctcagga ggggcgggcg
241 cggctgctgc cttgggcccg ggcggaactc cggggcctcc tgtgcgaatg ggcccggctc
301 cgggtcaagg gctgtaccgc tccccgatgc ccggagcggc ctatccgaga ccaggtatgt
361 tgccaggcag ccgaatgaca cctcagggac cttccatggg acccccctggc tatgggggga
421 acccttcagt ccgacctggc ctggcccagt cagggatgga tcagtcccgc aagagacctg
481 cccctcagca gatccagcag gtccagcagc aggcggtcca aaatcgaaac cacaatgcaa
541 agaaaaagaa gatggctgac aaaattctac ctcaaaggat tcgtgaactg gtaccagaat
601 cccaggccta tatggatctc ttggcttttg aaaggaaact ggaccagact atcatgagga
661 aacggctaga tatccaagag gccttgaaac gtcccatcaa gcaaaaacgg aagctgcgaa
721 ttttcatttc taacactttc aatccggcta agtcagatgc cgaggatggg gaagggacgg
781 tggcttcctg ggagcttcgg gtagaaggac ggctcctgga ggattcagcc ttgtccaaat
841 atgatgccac taaacaaaag aggaagttct cttccttttt taagtccttg gtgattgaac
901 tggacaaaga cctgtatggg ccagacaacc atctggtaga atggcacagg accgccacta
961 cccaggagac cgatggcttt caggtgaagc ggccgggaga cgtgaatgta cggtgtactg
1021 tcctactgat gctggattac cagcctcccc agtttaaatt agacccccgc ctagctcgac
1081 tcctgggcat ccatacccag actcgtccag tgatcatcca agcactgtgg caatatatta
1141 agacacataa gctccaggac cctcacgagc gggagtttgt catctgtgac aagtacctgc
1201 agcagatctt tgagtctcaa cgtatgaagt tttcagagat ccctcagcgg ctccatgcct
1261 tgcttatgcc accagaacct atcatcatta atcatgtcat cagtgttgac ccgaatgatc
1321 agaaaaagac agcttgttat gacattgatg ttgaagtgga tgacaccttg aagacccaga
1381 tgaattcttt tctgctgtcc actgccagcc aacaggagat tgctactcta gacaacaaga
1441 tccatgagac aatagaaacc atcaaccagc tgaagactca gcgggagttc atgctgagct
1501 ttgccagaga ccctcagggt ttcatcaatg actggcttca gtcccagtgc agggacctca
1561 agacaatgac tgatgtggtg ggtaacccag aggaggagcg ccgagctgag ttctacttcc
1621 agccctgggc tcaggaggct gtgtgccgat acttctactc caaggtgcag cagagacgac
1681 aagaattaga gcaagccctg ggaatccgga atacataggg cctctcccac agccctgatt
1741 cgactgcacc aattcttgat ttgggccctg tgctgcctgc ctcatagtat ctgccttggt
1801 cttgcttggg gcgttccagg ggatgctgtt ggttcaagga caacaccaga atgaagaggg
1861 tctcacaaga cacctgttat cctcttcttt caccctatct cttcccaccc ccagcttccc
1921 tttgccccac aaagttccca tgtgcctgta ccctcccctg gtctacatag gacctctaga
1981 tagtgttaga gagagaacat gtagtggtaa tgagtgcttg gaatggattg ggcctcaggc
2041 caggtggtct tcaaggggac cagctaactg atcctgccct tcagagaccc aggagttggg
2101 agctttcgct ccttctccaa gactcaggcc tgtgggcact ctataagcta gttgatcttg
2161 gctctcctga taacagaatc caatttcctt ccttccctcc acaggtttgg aacaaactct
2221 cccttcactt gttgccctgt agcactacag aaaccctggt tcttgggctc cactgagccc
2281 caggtcagtc cccagccctc tgggttggcc tgctgtcagt gcttctctca ctccttagtt
2341 ggggtccaca tcagtattgg agttttgttc tttattgctc cctcccagac actccctgtg
2401 gctgcccttt gtgattccct cagatctgcc ctaatcccgg gcatttgggt gggggaatct
2461 tgcctttccc tttcagagcc ccagggatct catctgggga actgtcattg ccagcagagg
2521 ctgttccttc ctgctgtttg gagatgtgac tcattcattc actcactcca ccctgcctct
2581 gcatccctta atggagaaac gggcctaaaa ccaaacgggt aaaaagccct gggccatccc
2641 tgtcttcctg tcccttgtct gcccagttga cacctactgg tgacttctag ggcactgagg
2701 agtgaaagcg cctagggctg gagaatagcg ctgagttggg tttgtgactc ttccctctcc
2761 ctgcctcaca ggattgtgac tccccagccc ctgccctcaa agcttcagac ccctcaggta
2821 gcagcaggac cttgtgatct tggccccttg gatctgagat ggtttttgca tctttccagg
2881 agagcctcac attcttcttc caggttgtat cacccccgag ttagcatatc ccaggctcgc
2941 agactcaaca cagcaagggt gggagacagc tgggcacaaa gggggaattc cgttcagcat
3001 gggctctaaa cccacagaac tgacaaagcc cctgcttccc caccccctcc tcaggctcct
3061 gcgagcacac ccccaccccc aaatccctcc ctgttctaca ctggggacag cagaattttc
3121 tccccgtctt cccccttcctg ccattttccc tcccttgaaa ggttgacact ggacaacctt
3181 ggggcagctg agccctggcc gcctcctggc tggaaccatg agaaggaagc tcagtacttc
3241 ccacagtgtc cctgttgata actgttttta ttaactgaat tgttttttttc atggaccaaa
3301 cttttttttg tactgtcccc ttattgatgt tacccagttt taataaaaga atcttctgaa TABLE 1-continued

```
3361 ggatgggtcc tcctacctac tgtgagagag ctcttccctg agctcttctt ccttcaatac
3421 cattagccaa a

SEQ ID NO: 58 Human SMARCD1 Amino Acid Sequence Isoform A (NP_003067.3)
   1 maaragfqsv apsggagasg gagaaaalgp ggtpgppvrm gpapgqglyr spmpgaaypr
  61 pgmlpgsrmt pqgpsmgppg yggnpsvrpg lagsgmdqsr krpapqqiqq vqqqavqnrn
 121 hnakkkkmad kilpqrirel vpesqaymdl laferkldqt imrkrldiqe alkrpikqkr
 181 klrifisntf npaksdaedg egtvaswelr vegrlledsa lskydatkqk rkfssffksl
 241 vieldkdlyg pdnhlvewhr tattqetdgf qvkrpgdvnv rctvllmldy qppqfkldpr
 301 larllgihtq trpviiqalw qyikthklqd pherefvicd kylgqifesq rmkfseipqr
 361 lhallmppep iiinhvisvd pndqkktacy didvevddtl ktqmnsflls tasqqeiatl
 421 dnkihetiet inglktgref mlsfardpqg findwlqsqc rdlktmtdvv gnpeeerrae
 481 fyfqpwagea vcryfyskvq qrrqeleqal girnt

SEQ ID NO: 59 Human SMARCD1 cDNA Sequence Variant 2 (NM_139071.2,
CDS: 171-1595)
   1 agcacgcctt ttccgctagt cgccccgctc tatcccatag tctcgctgcc ctgagcctcc
  61 cgtgccggcc ggccggccgg gggaacaggc gggcgctcgg ggggcgctcg gggggcgggg
 121 ggagttccgg ttccggttct ttgtgcggct gcatcggcgg ctccgggaag atggcggccc
 181 gggcgggttt ccagtctgtg gctccaagcg gcggcgccgg agcctcagga ggggcgggcg
 241 cggctgctgc cttgggcccg ggcggaactc cggggcctcc tgtgcgaatg ggcccggctc
 301 cgggtcaagg gctgtaccgc tccccgatgc ccggagcggc ctatccgaga ccaggtatgt
 361 tgccaggcag ccgaatgaca cctcagggac cttccatggg accccctggc tatgggggga
 421 acccttcagt ccgacctggc ctggcccagt cagggatgga tcagtcccgc aagagacctg
 481 cccctcagca gatccagcag gtccagcagc aggcggtcca aaatcgaaac cacaatgcaa
 541 agaaaaagaa gatggctgac aaaattctac ctcaaaggat tcgtgaactg gtaccagaat
 601 cccaggccta tatggatctc ttggcttttg aaaggaaact ggaccagact atcatgagga
 661 aacggctaga tatccaagag gccttgaaac gtcccatcaa gcaaaaacgg aagctgcgaa
 721 ttttcatttc taacactttc aatccggcta agtcagatgc cgaggatggg gaagggacgg
 781 tggcttcctg ggagcttcgg gtagaaggac ggctcctgga ggattcagcc ttgtccaaat
 841 atgatgccac taaacaaaag aggaagttct cttccttttt taagtccttg gtgattgaac
 901 tggacaaaga cctgtatggg ccagacaacc atctggtaga atggcacagg accgccacta
 961 cccaggagac cgatggcttt caggtgaagc ggccgggaga cgtgaatgta cggtgtactg
1021 tcctactgat gctggattac cagcctcccc agtttaaatt agacccccgc ctagctcgac
1081 tcctgggcat ccatacccag actcgtccag tgatcatcca agcactgtgg caatatatta
1141 agacacataa gctccaggac cctcacgagc gggagtttgt catctgtgac aagtacctgc
1201 agcagatctt tgagtctcaa cgtatgaagt tttcagagat ccctcagcgg ctccatgcct
1261 tgcttatgcc accagaacct atcatcatta atcatgtcat cagtgttgac ccgaatgatc
1321 agaaaaagac agcttgttat gacattgatg ttgaagtgga tgacaccttg aagacccaga
1381 tgaattcttt tctgctgtcc actgccagcc aacaggagat tgctactcta gacaacaaga
1441 caatgactga tgtggtgggt aacccagagg aggagcgccg agctgagttc tacttccagc
1501 cctgggctca ggaggctgtg tgccgatact tctactccaa ggtgcagcag agacgacaag
1561 aattagagca agccctggga atccggaata catagggcct ctcccacagc cctgattcga
1621 ctgcaccaat tcttgatttg ggccctgtgc tgcctgcctc atagtatctg ccttggtctt
1681 gcttggggcg ttccagggga tgctgttggt tcaaggacaa caccagaatg aagagggtct
1741 cacaagacac ctgttatcct cttctttcac cctatctctt cccaccccca gcttcccttt
1801 gccccacaaa gttcccatgt gcctgtaccc tcccctggtc tacataggac ctctagatag
1861 tgttagagag agaacatgta gtggtaatga gtgcttggaa tggattgggc ctcaggccag
1921 gtggtcttca aggggaccag ctaactgatc ctgcccttca gagacccagg agttgggagc
1981 tttcgctcct tctccaagac tcaggcctgt gggcactcta taagctagtt gatcttggct
2041 ctcctgataa cagaatccaa tttccttcct tccctccaca ggtttggaac aaactctccc
2101 ttcacttgtt gccctgtagc actacagaaa ccctggttct tgggctccac tgagccccag
2161 gtcagtcccc agccctctgg gttggcctgc tgtcagtgct tctctcactc cttagttggg
2221 gtccacatca gtattggagt tttgttcttt attgctccct cccagacact ccctgtggct
2281 gccctttgtg attccctcag atctgcccta atcccgggca tttgggtggg ggaatcttgc
2341 ctttcccttt cagagcccca gggatctcat ctggggaact gtcattgcca gcagaggctg
2401 ttccttcctg ctgtttggag atgtgactca ttcattcact cactccaccc tgcctctgca
2461 tcccttaatg gagaaacggg cctaaaacca aacgggtaaa aagccctggg ccatccctgt
2521 cttcctgtcc cttgtctgcc cagttgacac ctactggtga cttctagggc actgaggagt
2581 gaaagcgcct agggctggag aatagcgctg agttgggttt gtgactcttc cctctccctg
2641 cctcacagga ttgtgactcc ccagcccctg ccctcaaagc ttcagacccc tcaggtagca
2701 gcaggacctt gtgatcttgg ccccttggat ctgagatggt ttttgcatct ttccaggaga
2761 gcctcacatt cttcttccag gttgtatcac ccccgagtta gcatatccca ggctcgcaga
2821 ctcaacacag caagggtggg agacagctgg gcacaaaggg ggaattccgt tcagcatggg
2881 ctctaaaccc acagaactga caaagcccct gcttccccac cccctcctca ggctcctgcg
2941 agcacacccc cacccccaaa tccctccctg ttctacactg gggacagcag aattttctcc
3001 ccgtcttccc cttcctgcca ttttccctcc cttgaaaggt tgacactgga caaccttggg
3061 gcagctgagc cctggccgcc tcctggctgg aaccatgaga aggaagctca gtacttccca
3121 cagtgtccct gttgataact gtttttatta actgaattgt ttttttcatg gaccaaactt
3181 tttttgtac tgtcccctta ttgatgttac ccagttttaa taaaagaatc ttctgaagga
3241 tgggtcctcc tacctactgt gagagagctc ttccctgagc tcttcttcct tcaataccat
3301 tagccaaa

SEQ ID NO: 60 Human SMARCD1 Amino Acid Sequence Isoform B (NP_620710.2)
   1 maaragfqsv apsggagasg gagaaaalgp ggtpgppvrm gpapgqglyr spmpgaaypr
  61 pgmlpgsrmt pqgpsmgppg yggnpsvrpg lagsgmdqsr krpapqqiqq vqqqavqnrn
 121 hnakkkkmad kilpqrirel vpesqaymdl laferkldqt imrkrldiqe alkrpikqkr
 181 klrifisntf npaksdaedg egtvaswelr vegrlledsa lskydatkqk rkfssffksl
 241 vieldkdlyg pdnhlvewhr tattqetdgf qvkrpgdvnv rctvllmldy qppqfkldpr
 301 larllgihtq trpviiqalw qyikthklqd pherefvicd kylqqifesq rmkfseipqr
```

TABLE 1-continued

```
 361 lhallmppep iiinhvisvd pndqkktacy didvevddtl ktqmnsflls tasqqeiatl
 421 dnktmtdvvg npeeerraef yfqpwageav cryfyskvqq rrgelegalg irnt
```

SEQ ID NO: 61 Mouse SMARCD1 cDNA Sequence (NM_031842.2, CDS: 36-1583)

```
   1 gttctttgtg cagctgcagc ggcggctccg ggaagatggc ggcccgggcg ggtttccagt
  61 ctgtggctcc gagcggcggc gcgggagcct caggaggagc gggcgtggcg gctgctctgg
 121 gcccgggcgg aactcccggg cctcccgtgc gaatgggccc ggcgccgggt caagggctgt
 181 accgctctcc gatgcccggg gcggcctatc cgagaccagg tatgctgcca ggtagccgaa
 241 tgacacctca gggaccttcc atggacctc ctggctatgg ggggaaccct tcagtccgac
 301 ctggtctggc ccagtcaggg atggaccagt cccgcaagag acctgcacct caacagatcc
 361 agcaggtcca gcagcaggcg gtccaaaatc gaaatcacaa tgcaaagaaa aagaagatgg
 421 ctgacaaaat cctacctcaa aggattcggg aactggtccc agaatcacag gcctacatgg
 481 atctcctggc ttttgaaagg aaactggacc agactattat gaggaagcgg ctagatatcc
 541 aggaggcctt gaaacgtccc atcaagcaaa aacggaagct gcgaattttc atttctaaca
 601 cgttcaatcc ggctaagtcg gacgcggagg atggggaagg gacggtggct tcctgggagc
 661 tccgggtaga aggccggctc ctggaggacg cggccttgtc caaatatgac gccaccaagc
 721 aaaagagaaa gttctcttcc ttttttaagt ccttggtgat cgaactggac aaagacctct
 781 atggcccaga caaccatctg gtagaatggc acaggaccgc cactacccag gagaccgatg
 841 gcttccaggt gaagcggcca ggagatgtga atgtacggtg tactgtcctg ctgatgctgg
 901 actaccagcc cccccagttt aaattagacc ctcgcctggc tcggctcttg ggcatccata
 961 cccagacacg tccagtgatc atccaagcac tgtggcagta tattaaaaca cacaagctcc
1021 aggaccctca cgagcgagag tttgttctct gtgacaagta cctccagcag atctttgaat
1081 ctcagcggat gaagttctca gagatccctc agcggctcca cgccttgctt atgccaccag
1141 agcccatcat catcaatcat gtcatcagtg tggacccaaa tgaccagaaa aagaccgcgt
1201 gctatgacat tgacgtggag gtggatgaca ctctgaagac ccagatgaac tctttcctgt
1261 tgtccactgc cagccagcag gagatcgcca ctctagacaa caagatccat gagacgatag
1321 agaccatcaa ccagctgaag acccagcgag agttcatgtt gagctttgcc cgagaccctc
1381 agggtttcat caatgattgg cttcagtccc agtgcaggga cctcaagacg atgactgatg
1441 tggtgggtaa cccggaagag gagcgtcgtg ctgagttcta cttccagccc tgggctcagg
1501 aggctgtgtg ccgatacttc tactccaagg tgcagcagag gcggcaagag ttagagcaag
1561 ccctgggaat ccgaaacaca tagggcctct gtggccctag cctggctgca ccgattcctt
1621 gggccctgtg ctgcctgcct cagtgtacct gtcttggtct tgcttgaggc attccagggg
1681 acttggcttc aggacagtgt cacaatgaag agggtgtcac atttctgtct cacagtcacc
1741 tgttatcccg tcctgtaccc cagtcgtccc ccgtcccgtc gtgtcccccc ctcaccccac
1801 cccgcctcag ctcctcccca tcaggctcct gtgtgcctct acctccctat cctacatagg
1861 acctctagat agtgttagag aaccacagag tgggggcctc ctgaggtcag gtggtcttga
1921 gggagaccag ctacactgat cctgcccttg tcaggagacc taggccttgg gagctatccc
1981 tgtctgagcc tcaggcctag ggcagtctgt aagctagctg accttggccc tcccggtagc
2041 ttgacttctt ccctcccctc cgcaggttgg ggcagaggct cctttacctc tggcagtaaa
2101 ggagcctggg cttcactgag ccccgggttg gtcccctgcc ctctggactt aacctgctgt
2161 ctcagtgtcc tctgacccct taggggtcca tgtcagtatt ggagtgtgtg ttgaattgtt
2221 gctccctccc acacactccc gtagccgccc agtttaggat ttccctacac ctgccctaac
2281 ccacgctttt gggttgggga tcttgccttt ccttgtcatt cccagcagag actgttcctt
2341 cctgctgtta gaggagtggc ttgtttattc actccaccct gccccctcct gtaaatggag
2401 aaacaggcct gaaatcaaac gggtaaagcc ctaggccatc cctgtcttcc tgtcccatgt
2461 ctgcccagtt gaatcccact ggtggcttcc cgggcactga ggagtaaaag cgcctagggc
2521 tggagaatag gtctgaaatg ggtttgtgac tccccacccc ctgccctgcc ctcaaagctt
2581 cagacccctc agggagcagc aggatgtggg atcgaggccc cttgggacag atgctttgaa
2641 tcttccaggg aagcctccga ttcttccagg tttgtcaccc ggagttagca tgtcccaggc
2701 tcgcagacaa cactgcaggg tgggagacag ctgggcacag ggggattctg ttgagcatgg
2761 gctctgaacc cacagaactg acaaagcccc tgcttcccca cccccacctc aggctcctgc
2821 gagcagtgct cctgcaccct tcccagcctg ttctgtactg gggacagcag tcttctccct
2881 gtcctcccat gtcctatatc caccccctccc cttggaaggt cctccccaca gtgacactgg
2941 acagccctgg ggcagctgag ccccagcctg gcttctggct ggaagcgcga tgaggagact
3001 tagcactcca cagtgtccct ggtggtaact gttcttatta actgattgtg ttttgttttg
3061 ttttgttttg ttttcatgga ccaaaatttt ttttgtactg tctccttaac tgatgtcacc
3121 cagttttaat aaaagacttc taaagagcag gtc
```

SEQ ID NO: 62 Mouse SMARCD1 Amino Acid Sequence (NP_114030.2)

```
   1 maaragfqsv apsggagasg gagvaaalgp ggtpgppvrm gpapgqglyr spmpgaaypr
  61 pgmlpgsrmt pqgpsmgppg yggnpsvrpg lagsgmdqsr krpapqqiqq vqqqavqnrn
 121 hnakkkkmad kilpqrirel vpesqaymdl laferkldqt imrkrldiqe alkrpikqkr
 181 klrifisntf npaksdaedg egtvaswelr vegrlledaa lskydatkqk rkfssffksl
 241 vieldkdlyg pdnhlvewhr tattqetdgf qvkrpgdvnv rctvllmldy qppqfkldpr
 301 larllgihtq trpviiqalw qyikthklqd pherefvlcd kylgqifesq rmkfseipqr
 361 lhallmppep iiinhvisvd pndqkktacy didvevddtl ktqmnsflls tasqqeiatl
 421 dnkihetiet inglktgref mlsfardpqg findwlqsqc rdlktmtdvv gnpeeerrae
 481 fyfqpwagea vcryfyskvq qrrqeleqal girnt
```

SEQ ID NO: 63 Human SMARCD2 cDNA Sequence Variant 1 (NM_001098426.1, CDS: 318-1913)

```
   1 gttgggcggg gcagggagtt cgtagccgcc tctgggtaac tcgactcggg cggccaaacc
  61 tccggaggcc ggggacggaa ggcgggcccg cagcagatcc tggatccgga atctcccggg
 121 caggagcgga atctgtcccg aaccgggtct gtgaggaact cgcgaacttg gattaggaaa
 181 tcccggagcc cggatcgaca aatcccggaa cccggaatta agatcgccaa gtcccggatc
 241 gcggagcaca gagcacggag tggactcgac gcggagcccg gagtccggat cgcggcaccg
 301 cgggacggga cggagcgatg tcgggccgag gcgcgggcgg gttcccgctg cccccgctaa
 361 gccctggcgg cggcgccgtg gctgcggccc tgggagcgcc gcctcccccc gcgggacccg
 421 gcatgctgcc cggaccggcg ctccggggac cgggtccggc aggaggcgtg gggggccccg
 481 gggccgccgc cttccgcccc atgggccccg cgggccccgc ggcgcagtac cagcgacctg
```

TABLE 1-continued

```
 541 gcatgtcacc agggaaccgg atgcccatgg ctggcttgca ggtgggaccc cctgctggct
 601 ccccatttgg tgcagcagct ccgcttcgac ctggcatgcc acccaccatg atggatccat
 661 tccgaaaacg cctgcttgtg ccccaggcgc agcctcccat gcctgcccag cgcccggggt
 721 taaagaggag gaagatggca gataaggttc tacctcagcg aatccgggag cttgttccag
 781 agtctcaggc gtacatggat ctcttggctt ttgagcggaa gctggaccag accattgctc
 841 gcaagcggat ggagatccag gaggccatca aaaagcctct gacacaaaag cgaaagcttc
 901 ggatctacat ttccaatacg ttcagtccca gcaaggcgga aggcgatagt gcaggaactg
 961 cagggacccc tgggggaacc ccagcagggg acaaggtggc ttcctgggaa ctccgagtgg
1021 aaggaaaact gctggatgat cctagcaaac agaagaggaa gtttcttca ttctttaaga
1081 gcctcgtcat tgagctggac aaggagctgt acgggcctga caatcacctg gtggagtggc
1141 accggatgcc caccacccag gagacagatg gcttccaagt aaaacggcct ggagacctca
1201 acgtcaagtg caccctcctg ctcatgctgg atcatcagcc tccccagtac aaattggacc
1261 cccgattggc aaggctgctg ggagtgcaca cgcagacgag ggccgccatc atgcaggccc
1321 tgtggcttta catcaagcac aaccagctgc aggatggca cgagcgggag tacatcaact
1381 gcaaccgtta cttccgccag atcttcagtt gtggccgact ccgtttctcc gagattccca
1441 tgaagctggc agggttgctg cagcatccag accccattgt catcaaccat gtcattagtg
1501 tcgaccctaa cgaccagaag aagacagcct gttacgacat cgatgtggag gtggacgacc
1561 cactgaaggc ccaaatgagc aatttctgg cctctaccac caatcagcag gagatcgcct
1621 cccttgatgt caagatccat gagaccattg agtccatcaa ccagctgaag acccagagag
1681 atttcatgct cagttttagc accgaccccc aggacttcat ccaggaatgg ctccgttccc
1741 agcgccgaga cctcaagatc atcactgatg tgattggaaa tcctgaggag gagagacgag
1801 ctgctttcta ccaccagccc tgggcccagg aagcagtagg caggcacatc tttgccaagg
1861 tgcagcagcg aaggcaggaa ctggaacagg tgctgggaat tcgcctgacc taactgctca
1921 gggatctttc ttcccagccc tggagcctgg agggagacca ccctctgggt ccttgctggg
1981 gccgcagaca cgtaggctgg ggtgaggagt gtctgctgtc accctctact ctccagcttt
2041 agtcttataa atgtagtgat aggattcctt gttgcttggt ccccaaagcc ttatactttt
2101 tgcattggct ttaattgggt tcagcagatg cctcctctgc ccccctgcag gcaggcccaa
2161 gtaggactgc tggaggctgt gctttgacat tgtaagacat ttccgaacca aaggctgctg
2221 ggtttgcatg tttacagact ccccctgggg cgagggtcag agctggctct ggggagctgg
2281 gctaggaaga ggaggtgcag cccagactct tcctagcctt tctaaaccaa agttctttgc
2341 cattcctaca agcccagcct tgctgctggt tttttccttt cctttgggta tttgcactat
2401 tttgggagca agttttctat gtgggagcca cttttttgt acaggggtaa gttggggggtt
2461 ttcagggagc ctgttaggtg cctccttctt ttctttcctc aatctatgca agcggctctg
2521 gccgccatca tctcctggga tgccagaggg ctgcctctcc agcggcttgg gccggggagg
2581 ggacactcca gttctctagc atggcctgag gtatggggta tgtgcatgtg gaggccaggg
2641 taaggtgaat ggggaggctg ggaggactgg tgttgccctt tggagcttgg tgaggagggt
2701 gggcctaggg cttggcgagt gccacatctg gcaggtttgg aaatttccaa ataaatcctt
2761 ttgtctattg
```

SEQ ID NO: 64 Human SMARCD2 Amino Acid Sequence Isoform 1 (NP_001091896.1)

```
  1 msgrgaggfp lpplspggga vaaalgappp pagpgmlpgp alrgpgpagg vggpgaaafr
 61 pmgpagpaaq yqrpgmspgn rmpmaglqvg ppagspfgaa aplrpgmppt mmdpfrkrll
121 vpqaqppmpa qrrglkrrkm adkvlpgrir elvpesqaym dllaferkld qtiarkrmei
181 qeaikkpltq krklriyisn tfspskaegd sagtagtpgg tpagdkvasw elrvegklld
241 dpskqkrkfs sffkslviel dkelygpdnh lvewhrmptt qetdgfqvkr pgdlnvkctl
301 llmldhqppq ykldprlarl lgvhtqtraa imqalwlyik hnqlqdgher eyincnryfr
361 qifscgrlrf seipmklagl lqhpdpivin hvisvdpndq kktacydidv evddplkaqm
421 snflasttnq qeiasldvki hetiesinql ktqrdfmlsf stdpgdfiqe wlrsqrrdlk
481 iitdvignpe eerraafyhq pwaqeavgrh ifakvqqrrq eleqvlgirl t
```

SEQ ID NO: 65 Human SMARCD2 cDNA Sequence Variant 2 (NM_001330439.1, CDS: 96-1466)

```
   1 agtaccaggt gagcaaggag gacgcgagcg gacgggggcg agaggcgctg cgagggcgcc
  61 cgggccggcg gctgaagggg cctcgacgac ctggcatgtc accagggaac cggatgccca
 121 tggctggctt gcaggtggga ccccctgctg gctccccatt tggtgcagca gctccgcttc
 181 gacctggcat gccacccacc atgatggatc cattccgaaa acgcctgctt gtgccccagg
 241 cgcagcctcc catgcctgcc cagcgcccgg ggttaaagag gaggaagatg gcagataagg
 301 ttctacctca gcgaatccgg gagcttgttc cagagtctca ggcgtacatg gatctcttgg
 361 cttttgagcg gaagctggac cagaccattg ctcgcaagcg gatggagatc caggaggcca
 421 tcaaaaagcc tctgacacaa aagcgaaagc ttcggatcta catttccaat acgttcagtc
 481 ccagcaaggc ggaaggcgat agtgcaggaa ctgcagggac ccctggggga accccagcag
 541 gggacaaggt ggcttcctgg gaactccgag tggaaggaaa actgctggat gatcctagca
 601 aacagaagag gaagtttct tcattcttta agagcctcgt cattgagctg gacaaggagc
 661 tgtacgggcc tgacaatcac ctggtggagt ggcaccggat gcccaccacc caggagacag
 721 atggcttcca agtaaaacgg cctggagacc tcaacgtcaa gtgcaccctc ctgctcatgc
 781 tggatcatca gcctccccag tacaaattgg acccccgatt ggcaaggctg ctgggagtgc
 841 acacgcagac gagggccgcc atcatgcagg ccctgtggct ttacatcaag cacaaccagc
 901 tgcaggatgg gcacgagcgg gagtacatca actgcaaccg ttacttccgc cagatcttca
 961 gttgtggccg actccgtttc tccgagattc ccatgaagct ggcagggttg ctgcagcatc
1021 cagaccccat tgtcatcaac catgtcatta gtgtcgaccc taacgaccag aagaagacag
1081 cctgttacga catcgatgtg gaggtggacg acccactgaa ggcccaaatg agcaattttc
1141 tggcctctac caccaatcag caggagatcg cctcccttga tgtcaagatc catgagacca
1201 ttgagtccat caaccagctg aagacccaga gagatttcat gctcagtttt agcaccgacc
1261 cccaggactt catccaggaa tggctccgtt cccagcgccg agacctcaag atcatcactg
1321 atgtgattgg aaatcctgag gaggagagac gagctgcttt ctaccaccag ccctgggccc
1381 aggaagcagt aggcaggcac atctttgcca aggtgcagca gcgaaggcag gaactggaac
1441 aggtgctggg aattcgcctg acctaactgc tcagggatct ttcttcccag ccctggagcc
1501 tggagggaga ccaccctctg ggtccttgct ggggccgcag acacgtaggc tggggtgagg
1561 agtgtctgct gtcaccctct actctccagc tttagtctta taaatgtagt gataggattc
1621 cttgttgctt ggtccccaaa gccttatact tttgcattg gctttaattg ggttcagcag
```

TABLE 1-continued

```
1681 atgcctcctc tgcccccctg caggcaggcc caagtaggac tgctggaggc tgtgctttga
1741 cattgtaaga catttccgaa ccaaaggctg ctgggtttgc atgtttacag actcccccctg
1801 gggcgagggt cagagctggc tctggggagc tgggctagga agaggaggtg cagcccagac
1861 tcttcctagc ctttctaaac caaagttctt tgccattcct acaagcccag ccttgctgct
1921 ggttttttcc tttcctttgg gtatttgcac tattttggga gcaagttttc tatgtgggag
1981 ccactttttt tgtacagggg taagttgggg gttttcaggg agcctgttag gtgcctcctt
2041 cttttctttc ctcaatctat gcaagcggct ctggccgcca tcatctcctg ggatgccaga
2101 gggctgcctc tccagcggct tgggccgggg aggggacact ccagttctct agcatggcct
2161 gaggtatggg gtatgtgcat gtggaggcca gggtaaggtg aatggggagg ctgggaggac
2221 tggtgttgcc ctttggagct tggtgaggag ggtgggccta gggcttggcg agtgccacat
2281 ctggcaggtt tggaaatttc caaataaatc cttttgtcta ttgaaaaaaa aaaaaaaaaa
2341 a
```

SEQ ID NO: 66 Human SMARCD2 Amino Acid Sequence Isoform 2 (NP_001317368.1)

```
  1 mspgnrmpma glqvgppags pfgaaaplrp gmpptmmdpf rkrllvpqaq ppmpagrrgl
 61 krrkmadkvl pqrirelvpe sqaymdllaf erkldqtiar krmeigeaik kpltqkrklr
121 iyisntfsps kaegdsagta gtpggtpagd kvaswelrve gkllddpskq krkfssffks
181 lvieldkely gpdnhlvewh rmpttgetdg fqvkrpgdln vkctlllmld hqppqykldp
241 rlarllgvht qtraaimqal wlyikhnqlq dghereyinc nryfrqifsc grlrfseipm
301 klagllqhpd pivinhvisv dpndqkktac ydidvevddp lkaqmsnfla sttnqqeias
361 ldvkihetie sinqlktqrd fmlsfstdpq dfigewlrsq rrdlkiitdv ignpeeerra
421 afyhqpwaqe avgrhifakv qqrrqeleqv lgirlt
```

SEQ ID NO: 67 Human SMARCD2 cDNA Sequence Variant 3 (NM_001330440.1, CDS: 48-1499)

```
   1 agtgtgtgca aggcagagct gccaaacagg ccttgcaggc agcagccatg gggaggcggg
  61 tggggtgga ggtgactccc agatgggctc cacagaaatg tcagggagca aggcctcagc
 121 gacctggcat gtcaccaggg aaccggatgc ccatggctgg cttgcaggtg ggaccccctg
 181 ctggctcccc atttggtgca gcagctccgc ttcgacctgg catgccaccc accatgatgg
 241 atccattccg aaaacgcctg cttgtgcccc aggcgcagcc tcccatgcct gcccagcgcc
 301 gggggttaaa gaggaggaag atggcagata aggttctacc tcagcgaatc cgggagcttg
 361 ttccagagtc tcaggcgtac atggatctct tggcttttga gcggaagctg gaccagacca
 421 ttgctcgcaa gcggatggag atccaggagg ccatcaaaaa gcctctgaca caaaagcgaa
 481 agcttcggat ctacatttcc aatacgttca gtcccagcaa ggcggaaggc gatagtgcag
 541 gaactgcagg gaccccctggg ggaaccccag caggggacaa ggtggcttcc tgggaactcc
 601 gagtggaagg aaaactgctg gatgatccta gcaaacagaa gaggaagttt tcttcattct
 661 ttaagagcct cgtcattgag ctggacaagg agctgtacgg gcctgacaat cacctggtgg
 721 agtggcaccg gatgcccacc acccaggaga cagatggctt ccaagtaaaa cggcctggag
 781 acctcaacgt caagtgcacc ctcctgctca tgctggatca tcagcctccc cagtacaaat
 841 tggacccccg attggcaagg ctgctgggag tgcacacgca gacgagggcc gccatcatgc
 901 aggccctgtg gctttacatc aagcacaacc agctgcagga tgggcacgag cgggagtaca
 961 tcaactgcaa ccgttacttc cgccagatct tcagttgtgg ccgactccgt ttctccgaga
1021 ttcccatgaa gctggcaggg ttgctgcagc atccagaccc cattgtcatc aaccatgtca
1081 ttagtgtcga ccctaacgac cagaagaaga cagcctgtta cgacatcgat gtggaggtgg
1141 acgacccact gaaggcccaa atgagcaatt ttctggcctc taccaccaat cagcaggaga
1201 tcgcctccct tgatgtcaag atccatgaga ccattgagtc catcaaccag ctgaagaccc
1261 agagagattt catgctcagt tttagcaccg acccccagga cttcatccag gaatggctcc
1321 gttcccagcg ccgagacctc aagatcatca ctgatgtgat tggaaatcct gaggaggaga
1381 gacgagctgc tttctaccac cagccctggg cccaggaagc agtaggcagg cacatctttg
1441 ccaaggtgca gcagcgaagg caggaactgg aacaggtgct gggaattcgc ctgacctaac
1501 tgctcaggga tctttcttcc cagccctgga gcctggaggg agaccaccct ctgggtcctt
1561 gctggggccg cagacacgta ggctggggtg aggagtgtct gctgtcaccc tctactctcc
1621 agctttagtc ttataaatgt agtgatagga ttccttgttg cttggtcccc aaagccttat
1681 actttttgca ttggctttaa ttgggttcag cagatgcctc ctctgccccc ctgcaggcag
1741 gcccaagtag gactgctgga ggctgtgctt tgacattgta agacatttcc gaaccaaagg
1801 ctgctgggtt tgcatgttta cagactcccc ctggggcgag ggtcagagct ggctctgggg
1861 agctgggcta ggaagaggag gtgcagccca gactcttcct agcctttcta aaccaaagtt
1921 ctttgccatt cctacaagcc cagccttgct gctggttttt tcctttcctt tgggtatttg
1981 cactattttg ggagcaagtt ttctatgtgg gagccacttt ttttgtacag gggtaagttg
2041 ggggttttca gggagcctgt taggtgcctc cttcttttct ttcctcaatc tatgcaagcg
2101 gctctggccg ccatcatctc ctgggatgcc agagggctgc ctctccagcg gcttgggccg
2161 gggaggggac actccagttc tctagcatgg cctgaggtat ggggtatgtg catgtggagg
2221 ccagggtaag gtgaatgggg aggctgggag gactggtgtt gccctttgga gcttggtgag
2281 gagggtgggc ctagggcttg gcgagtgcca catctggcag gtttggaaat ttccaaataa
2341 atccttttgt ctattgaaaa aaaaaaaaaa aaaa
```

SEQ ID NO: 68 Human SMARCD2 Amino Acid Sequence Isoform 3 (NP_001317369.1)

```
  1 mgrrvgvevt prwapqkcqg arpqrpgmsp gnrmpmaglq vgppagspfg aaaplrpgmp
 61 ptmmdpfrkr llvpqaqppm paqrrglkrr kmadkvlpqr irelvpesqa ymdllaferk
121 ldqtiarkrm eigeaikkpl tqkrklriyi sntfspskae gdsagtagtp ggtpagdkva
181 swelrvegkl lddpskqkrk fssffkslvi eldkelygpd nhlvewhrmp ttqetdgfqv
241 krpgdlnvkc tlllmldhqp pqykldprla rllgvhtqtr aaimqalwly ikhnqlqdgh
301 ereyincnry frgifscgrl rfseipmkla gllqhpdpiv inhvisvdpn dqkktacydi
361 dvevddplka qmsnflastt nqqeiasldv kihetiesin qlktgrdfml sfstdpqdfi
421 gewlrsqrrd lkiitdvign peeerraafy hqpwaqeavg rhifakvqqr rqeleqvlgi
481 rlt
```

TABLE 1-continued

SEQ ID NO: 69 Mouse SMARCD2 cDNA Sequence Variant 1 (NM_001130187.1, CDS: 265-1860)
```
   1 ctccggcgat caaacctccg gaggccggga gaggcctgcg ggctcgcggc acatcccgga
  61 tctggagtat ccctggcagg agcggagtca gaggggccgc gggatcctaa agccgggctg
 121 caaagaactt gcgaacttgg agtagaagat cccggaaccc ggtagtaaaa tcgggaagtc
 181 ccggatcgcg gaacgtagct cgcggagcgg actcaacacg gagaccggag gccggatcgc
 241 tgcaccgcgg gacgggacag agtgatgtcc ggccgtggcg cgggcgggtt cccgctgcct
 301 ccgctgagcc ccggcggcgg cgccgttgcc gcggcccttg gtgcgccgcc tccgcctgcg
 361 ggacccggaa tgctgcccag cccggcgctc aggggcccgg ggccttctgg aggcatgggg
 421 gtaccggggg ccgccgcctt ccgccccatg ggccccgctg gccccgcggc gcagtaccag
 481 cgtcctggca tgtcaccagg aagcaggatg cccatggctg gcttgcaggt gggacctcct
 541 gccggttccc catttggcac agctgctccg ctccgacctg gcatgccacc taccatgatg
 601 gatccattcc gaaaacgcct gcttgtgcct caggcccagc cccgatgcc tgcccagcgc
 661 cgagggttaa agaggaggaa gatggcagat aaggttctac ctcagcgaat ccgggagctt
 721 gtcccagagt ctcaggcata catggatctt ttagctttcg agaggaagct ggaccagacc
 781 atcgctcgca agcggatgga gattcaagag gccatcaaga agcctctgac gcaaaagcga
 841 aaacttcgga tctatatttc caatacattc agccccagca aggcggatgg agataatgcg
 901 ggaactgcgg ggacccctgg gggaaccccg gcagcagaca aggtggcctc ctgggagctt
 961 cgagtagagg ggaaactgct ggatgatcct agcaaacaga agaggaagtt ctcatcattc
1021 tttaagagcc ttgtgattga gttggacaag gaactctatg ggccggacaa ccatctggtg
1081 gagtggcatc ggatgcccac cacacaggaa acagatggct ttcaggtgaa acggccagga
1141 gatctcaatg tcaagtgcac ccttctgctc atgctggatc atcagcctcc tcagtataaa
1201 ctggaccccc gcctggcgag gttgctggga gtgcacacac agaccagggc ggcaatcatg
1261 caggcactgt ggctttacat caaacacaac cagctgcagg acggccatga gcgcgagtac
1321 atcaactgca atcgttactt ccgccagatc ttcagttgtg gccgactccg tttctccgag
1381 attcccatga agctggctgg attgctgcag catccagacc ccattgttat taatcatgtc
1441 attagtgtgg atcctaatga ccaaaagaag acagcctgct atgacattga tgtagaggtt
1501 gatgacccac tgaaggccca gatgagcaac ttcctggcct ctaccaccaa ccagcaggag
1561 attgcttctc ttgacgtcaa gatccatgag accattgagt ccatcaacca gctaaagacc
1621 cagagggatt tcatgctcag ctttagcacc gagccccagg acttcatcca ggagtggctc
1681 cgttcccaac gccgagacct caagatcatc acagatgtga ttggaaaccc tgaggaggag
1741 agacgagctg ctttctacca ccagccctgg gctcaggaag cagtggggag gcacatcttt
1801 gccaaggtgc agcagcgaag gcaggaactg gaacaggtgc tgggaattcg cctgacctaa
1861 ctgctcaggg attgcctcct tccttcctcc cctgccctgg atggaacctg gcaagagccc
1921 gtcctctggg ttctggcttg ggctgcagac atgtaggatg gagtgaggtg tgtttcctgt
1981 caccctccac tccccagctt tagtttcata aatgtagttt tagatccctc actgcttggt
2041 tcccaaagcc ttattactga ccttttagcg ctggctttaa ttgggtttgc aatgagcggc
2101 ctcagccccc tgcaggcagg caggcctgag taggaggctg gaggctgtgc tttaactttg
2161 taccagacat ttccaaacca aaggctgctg ggtttgcatg tttacaggct ccaccctagg
2221 gccagtgcca gagctggctt tggggagctg ggcaaggaag agaaggccct agactcttcc
2281 tggcctttct aaccaaagtt ttttgccatt cctacaagcc cagtcttgct gctggtttgt
2341 ccttcttttt gggtatttgc actatttggg gagcaggttt ttctatgtgg gagccacttt
2401 tttgtacaga ggtaatgggg tttttcaggg agcccacttg gtgcctcctt cttcctttct
2461 tttcttaatc tatgcaagcg gctgcagccg ccatcatctc ctggtatgcc acaaggctgc
2521 ccacccatag ctgcttgggc agggggaggt ggaatctcct gagagtggca atgccagttc
2581 tctaacccag ttacagcagg ggtgtgtgtg cgtgcgtgcg tgcgtgctgc aggggaaggg
2641 gaaagctgga ggactgctgt taccttttgc agtcggtctt aaagaggatg ggcctaaggc
2701 ttggcaaact tggaaaattc caaataaatc tttttgttta ttggtggtgc ccagaaaaaa
2761 aaaaaaa
```

SEQ ID NO: 70 Mouse SMARCD2 Amino Acid Sequence Isoform 1 (NP_001123659.1)
```
   1 msgrgaggfp lpplspggga vaaalgappp pagpgmlpsp alrgpgpsgg mgvpgaaafr
  61 pmgpagpaaq yqrpgmspgs rmpmaglqvg ppagspfgta aplrpgmppt mmdpfrkrll
 121 vpqaqppmpa qrrglkrrkm adkvlpgrir elvpesqaym dllaferkld qtiarkrmei
 181 qeaikkpltq krklriyisn tfspskadgd nagtagtpgg tpaadkvasw elrvegklld
 241 dpskqkrkfs sffkslviel dkelygpdnh lvewhrmptt getdgfqvkr pgdlnvkctl
 301 llmldhqppq ykldprlarl lgvhtqtraa imqalwlyik hnqlqdgher eyincnryfr
 361 qifscgrlrf seipmklagl lqhpdpivin hvisvdpndq kktacydidv evddplkaqm
 421 snflasttnq qeiasldvki hetiesinql ktqrdfmlsf stepqdfige wlrsqrrdlk
 481 iitdvignpe eerraafyhq pwaqeavgrh ifakvqqrrq eleqvlgirl t
```

SEQ ID NO: 71 Mouse SMARCD2 cDNA Sequence Variant 2 (NM_031878.2, CDS: 40-1494)
```
   1 tttgttcctg gtctccccat ttgagagaga gagagagaga tggagggtat gggctatgga
  61 cctcggaggg ctccgccact gacctgtgtc cctccactgt tccactttcc tcagcgtcct
 121 ggcatgtcac caggaagcag gatgcccatg gctggcttgc aggtgggacc tcctgccggt
 181 tccccatttg gcacagctgc tccgctccga cctggcatgc cacctaccat gatggatcca
 241 ttccgaaaac gcctgcttgt gcctcaggcc cagcccccga tgcctgccca gcgccgaggg
 301 ttaaagagga ggaagatggc agataaggtt ctacctcagc gaatccggga gcttgtccca
 361 gagtctcagg catacatgga tcttttagct ttcgagagga agctggacca gaccatcgct
 421 cgcaagcgga tggagattca agaggccatc aagaagcctc tgacgcaaaa gcgaaaactt
 481 cggatctata tttccaatac attcagcccc agcaaggcgg atggagataa tgcgggaact
 541 gcggggaccc ctgggggaac cccggcagca gacaaggtgg cctcctggga gcttcgagta
 601 gaggggaaac tgctggatga tcctagcaaa cagaagagga agttctcatc attctttaag
 661 agccttgtga ttgagttgga caaggaactc tatgggccgg acaaccatct ggtggagtgg
 721 catcggatgc ccaccacaca ggaaacagat ggctttcagg tgaaacggcc aggagatctc
 781 aatgtcaagt gcacccttct gctcatgctg gatcatcagc ctcctcagta taaactggac
 841 ccccgcctgg cgaggttgct gggagtgcac acacagacca gggcggcaat catgcaggca
 901 ctgtggcttt acatcaaaca caaccagctg caggacggcc atgagcgcga gtacatcaac
 961 tgcaatcgtt acttccgcca gatcttcagt tgtggccgac tccgtttctc cgagattccc
```

TABLE 1-continued

```
1021 atgaagctgg ctggattgct gcagcatcca gaccccattg ttattaatca tgtcattagt
1081 gtggatccta atgaccaaaa gaagacagcc tgctatgaca ttgatgtaga ggttgatgac
1141 ccactgaagg cccagatgag caacttcctg gcctctacca ccaaccagca ggagattgct
1201 tctcttgacg tcaagatcca tgagaccatt gagtccatca accagctaaa gacccagagg
1261 gatttcatgc tcagctttag caccgagccc caggacttca tccaggagtg gctccgttcc
1321 caacgccgag acctcaagat catcacagat gtgattggaa accctgagga ggagagacga
1381 gctgctttct accaccagcc ctgggctcag gaagcagtgg ggaggcacat ctttgccaag
1441 gtgcagcagc gaaggcagga actggaacag gtgctgggaa ttcgcctgac ctaactgctc
1501 agggattgcc tccttccttc ctcccctgcc ctggatggaa cctggcaaga gcccgtcctc
1561 tgggttctgg cttgggctgc agacatgtag gatggagtga ggtgtgtttc ctgtcaccct
1621 ccactcccca gctttagttt cataaatgta gttttagatc cctcactgct tggttcccaa
1681 agccttatta ctgacctttt agcgctggct ttaattgggt ttgcaatgag cggcctcagc
1741 cccctgcagg caggcaggcc tgagtaggag gctggaggct gtgctttaac tttgtaccag
1801 acatttccaa accaaaggct gctgggtttg catgtttaca ggctccaccc tagggccagt
1861 gccagagctg gctttgggga gctgggcaag gaagagaagg ccctagactc ttcctggcct
1921 ttctaaccaa agttttttgc cattcctaca agcccagtct tgctgctggt ttgtccttct
1981 ttttgggtat ttgcactatt tggggagcag gtttttctat gtgggagcca ctttttttgta
2041 cagaggtaat ggggtttttc agggagccca cttggtgcct ccttcttcct ttcttttctt
2101 aatctatgca agcggctgca gccgccatca tctcctggta tgccacaagg ctgcccaccc
2161 atagctgctt gggcaggggg aggtggaatc tcctgagagt ggcaatgcca gttctctaac
2221 ccagttacag caggggtgtg tgtgcgtgcg tgcgtgcgtg ctgcagggga aggggaaagc
2281 tggaggactg ctgttacctt ttgcagtcgg tcttaaagag gatgggccta aggcttggca
2341 aacttggaaa attccaaata aatctttttg tttattggtg gtgcccagaa aaaaaaaaaa
2401 a
```

SEQ ID NO: 72 Mouse SMARCD2 Amino Acid Sequence Isoform 2 (NP_114084.2)

```
  1 megmgygprr appltcvppl fhfpqrpgms pgsrmpmagl qvgppagspf gtaaplrpgm
 61 pptmmdpfrk rllvpqaqpp mpaqrrglkr rkmadkvlpq rirelvpesq aymdllafer
121 kldqtiarkr meiqeaikkp ltqkrklriy isntfspska dgdnagtagt pggtpaadkv
181 aswelrvegk llddpskqkr kfssffkslv ieldkelygp dnhlvewhrm pttqetdgfq
241 vkrpgdlnvk ctlllmldhq ppqykldprl arllgvhtqt raaimgalwl yikhnqlqdg
301 hereyincnr yfrqifscgr lrfseipmkl agllqhpdpi vinhvisvdp ndqkktacyd
361 idvevddplk aqmsnflast tnqqeiasld vkihetiesi nqlktqrdfm lsfstepqdf
421 iqewlrsqrr dlkiitdvig npeeerraaf yhqpwageav grhifakvqq rrgelegvlg
481 irlt
```

SEQ ID NO: 73 Human SMARCD3 cDNA Sequence Variant 1 (NM_001003802.1, CDS: 130-1542)

```
   1 ctggcatctt cctcccctcc tcctttccag atcctcagaa tggcccttgg tgctgcaggc
  61 gcggtgggct ccgggcccag gcaccgaggg ggcactggat gactctccag gtgcaggacc
 121 ctgccatcta tgactccagg tcttcagcac ccacccaccg tggtacagcg ccccgggatg
 181 ccgtctggag cccggatgcc cccaccaggggg gcgcccatgg gccccccggg ctccccgtac
 241 atgggcagcc ccgccgtgcg acccggcctg gccccccgcgg gcatggagcc cgcccgcaag
 301 cgagcagcgc ccccgcccgg gcagagccag gcacagagcc agggccagcc ggtgcccacc
 361 gcccccgcgc ggagccgcag tgccaagagg aggaagatgg ctgacaaaat cctccctcaa
 421 aggattcggg agctggtccc cgagtcccag gcttacatgg acctcttggc atttgagagg
 481 aaactggatc aaaccatcat gcggaagcgg gtggacatcc aggaggctct gaagaggccc
 541 atgaagcaaa agcggaagct gcgactctat atctccaaca cttttaaccc tgcgaagcct
 601 gatgctgagg attccgacgg cagcattgcc tcctgggagc tacgggtgga ggggaagctc
 661 ctggatgatc ccagcaaaca gaagcggaag ttctcttctt tcttcaagag tttggtcatc
 721 gagctggaca aagatcttta tggccctgac aaccacctcg ttgagtggca tcggacaccc
 781 acgacccagg agacggacgg cttccaggtg aaacggcctg gggacctgag tgtgcgctgc
 841 acgctgctcc tcatgctgga ctaccagcct ccccagttca aactggatcc ccgcctagcc
 901 cggctgctgg ggctgcacac acagagccgc tcagccattg tccaggccct gtggcagtat
 961 gtgaagacca acaggctgca ggactcccat gacaaggaat acatcaatgg ggacaagtat
1021 ttccagcaga tttttgattg tccccggctg aagttttctg agattcccca gcgcctcaca
1081 gccctgctat tgccccctga cccaattgtc atcaaccatg tcatcagcgt ggacccttca
1141 gaccagaaga agacggcgtg ctatgacatt gacgtggagg tggaggagcc attaaagggg
1201 cagatgagca gcttcctcct atccacggcc aaccagcagg agatcagtgc tctggacagt
1261 aagatccatg agacgattga gtccataaac cagctcaaga tccagaggga cttcatgcta
1321 agcttctcca gagaccccaa aggctatgtc caagacctgc tccgctccca gagccgggac
1381 ctcaaggtga tgacagatgt agccggcaac cctgaagagg agcgccgggc tgagttctac
1441 caccagccct ggtcccagga ggccgtcagt cgctacttct actgcaagat ccagcagcgc
1501 aggcaggagc tggagcagtc gctggttgtg cgcaacacct aggagcccaa aaataagcag
1561 cacgacggaa ctttcagccg tgtcccgggc cccagcattt tgccccgggc tccagcatca
1621 ctcctctgcc accttggggt gtggggctgg attaaaagtc attcatctga caaaaaaaaa
1681 aaaaaaaaa
```

SEQ ID NO: 74 Human SMARCD3 Amino Acid Sequence Isoform 1 (NP_001003802.1 and NP_003069.2)

```
  1 mtpglqhppt vvqrpgmpsg armphqgapm gppgspymgs pavrpglapa gmeparkraa
 61 pppggsgags qgqpvptapa rsrsakrrkm adkilpqrir elvpesqaym dllaferkld
121 qtimrkrvdi gealkrpmkg krklrlyisn tfnpakpdae dsdgsiaswe lrvegkllldd
181 pskqkrkfss ffkslvield kdlygpdnhl vewhrtpttq etdgfqvkrp gdlsvrctll
241 lmldyqppqf kldprlarll glhtqsrsai vgalwqyvkt nrlqdshdke yingdkyfqq
301 ifdcprlkfs eipqrltall lppdpivinh visvdpsdqk ktacydidve veeplkgqms
361 sfllstangq eisaldskih etiesinqlk iqrdfmlsfs rdpkgyvqdl lrsgsrdlkv
421 mtdvagnpee erraefyhqp wsqeaysryf yckiqqrrge leqslvvrnt
```

TABLE 1-continued

SEQ ID NO: 75 Human SMARCD3 cDNA Sequence Variant 2 (NM_003078.3, CDS: 169-1581)

```
   1 gccgggccga gccgagcgcc gagcagggag cgggcggccg cgctccgggc cggggtcccg
  61 ggggagcaga tcctcagaat ggcccttggt gctgcaggcg cggtgggctc cgggcccagg
 121 caccgagggg gcactggatg actctccagg tgcaggaccc tgccatctat gactccaggt
 181 cttcagcacc cacccaccgt ggtacagcgc cccgggatgc cgtctggagc ccggatgccc
 241 caccaggggg cgcccatggg ccccccgggc tccccgtaca tgggcagccc cgccgtgcga
 301 cccggcctgg cccccgcggg catggagccc gcccgcaagc gagcagcgcc cccgcccggg
 361 cagagccagg cacagagcca gggccagccg gtgcccaccg cccccgcgcg gagccgcagt
 421 gccaagagga ggaagatggc tgacaaaatc ctccctcaaa ggattcggga gctggtcccc
 481 gagtcccagg cttacatgga cctcttggca tttgagagga aactggatca aaccatcatg
 541 cggaagcggg tggacatcca ggaggctctg aagaggccca tgaagcaaaa gcggaagctg
 601 cgactctata tctccaacac ttttaaccct gcgaagcctg atgctgagga ttccgacggc
 661 agcattgcct cctgggagct acgggtggag gggaagctcc tggatgatcc cagcaaacag
 721 aagcggaagt tctcttcttt cttcaagagt ttggtcatcg agctggacaa agatctttat
 781 ggccctgaca accacctcgt tgagtggcat cggacaccca cgacccagga gacggacggc
 841 ttccaggtga aacggcctgg ggacctgagt gtgcgctgca cgctgctcct catgctggac
 901 taccagcctc cccagttcaa actggatccc cgcctagccc ggctgctggg gctgcacaca
 961 cagagccgct cagccattgt ccaggccctg tggcagtatg tgaagaccaa caggctgcag
1021 gactcccatg acaaggaata catcaatggg gacaagtatt tccagcagat tttttgattgt
1081 ccccggctga agttttctga gattccccag cgcctcacag ccctgctatt gccccctgac
1141 ccaattgtca tcaaccatgt catcagcgtg gacccttcag accagaagaa gacggcgtgc
1201 tatgacattg acgtggaggt ggaggagcca ttaaaggggc agatgagcag cttcctccta
1261 tccacggcca accagcagga gatcagtgct ctggacagta agatccatga gacgattgag
1321 tccataaacc agctcaagat ccagagggac ttcatgctaa gcttctccag agaccccaaa
1381 ggctatgtcc aagacctgct ccgctcccag agccgggacc tcaaggtgat gacagatgta
1441 gccggcaacc ctgaagagga gcgccgggct gagttctacc accagccctg gtcccaggag
1501 gccgtcagtc gctacttcta ctgcaagatc cagcagcgca ggcaggagct ggagcagtcg
1561 ctggttgtgc gcaacaccta ggagcccaaa aataagcagc acgacggaac tttcagccgt
1621 gtcccgggcc ccagcatttt gccccgggct ccagcatcac tcctctgcca ccttggggtg
1681 tggggctgga ttaaaagtca ttcatctgac aaaaaaaaaa aaaaaaaa
```

SEQ ID NO: 76 Human SMARCD3 Amino Acid Sequence Isoform 2 (NP_001317368.1)

```
   1 mspgnrmpma glqvgppags pfgaaaplrp gmpptmmdpf rkrllvpqaq ppmpaqrrgl
  61 krrkmadkvl pqrirelvpe sqaymdllaf erkldqtiar krmeigeaik kpltqkrklr
 121 iyisntfsps kaegdsagta gtpggtpagd kvaswelrve gkllddpskq krkfssffks
 181 lvieldkely gpdnhlvewh rmpttqetdg fqvkrpgdln vkctlllmld hqppqykldp
 241 rlarllgvht qtraaimqal wlyikhnqlq dghereyinc nryfrqifsc grlrfseipm
 301 klagllqhpd pivinhvisv dpndqkktac ydidvevddp lkaqmsnfla sttnqqeias
 361 ldvkihetie singlktgrd fmlsfstdpq dfigewlrsq rrdlkiitdv ignpeeerra
 421 afyhqpwaqe avgrhifakv qqrrgeleqv lgirlt
```

SEQ ID NO: 77 Human SMARCD3 cDNA Sequence Variant 3 (NM_001003801.1, CDS: 102-1553)

```
   1 agcaggactc agaggggaga gttggaggaa aaaaaaaggc agaaaaggga aagaaagagg
  61 aagagagaga gagagtgaga ggagccgctg agcccacccc gatggccgcg gacgaagttg
 121 ccggaggggc gcgcaaagcc acgaaaagca aactttttga gtttctggtc catggggtgc
 181 gccccgggat gccgtctgga gcccggatgc ccccaccaggg ggcgcccatg ggccccccgg
 241 gctccccgta catgggcagc ccccgccgtgc gacccggcct ggcccccgcg ggcatggagc
 301 ccgcccgcaa gcgagcagcg cccccgcccg ggcagagcca ggcacagagc cagggccagc
 361 cggtgcccac cgcccccgcg cggagccgca gtgccaagag gaggaagatg gctgacaaaa
 421 tcctccctca aaggattcgg gagctggtcc ccgagtccca ggcttacatg gacctcttgg
 481 catttgagag gaaactggat caaaccatca tgcggaagcg ggtggacatc caggaggctc
 541 tgaagaggcc catgaagcaa aagcggaagc tgcgactcta tatctccaac acttttaacc
 601 ctgcgaagcc tgatgctgag gattccgacg gcagcattgc ctcctgggag ctacgggtgg
 661 aggggaagct cctggatgat cccagcaaac agaagcggaa gttctcttct ttcttcaaga
 721 gtttggtcat cgagctggac aaagatcttt atggccctga caaccacctc gttgagtggc
 781 atcggacacc cacgacccag gagacggacg gcttccaggt gaaacggcct ggggacctga
 841 gtgtgcgctg cacgctgctc ctcatgctgg actaccagcc tccccagttc aaactggatc
 901 cccgcctagc ccggctgctg gggctgcaca cacagagccg ctcagccatt gtccaggccc
 961 tgtggcagta tgtgaagacc aacaggctgc aggactccca tgacaaggaa tacatcaatg
1021 gggacaagta tttccagcag atttttgatt gtccccggct gaagttttct gagattcccc
1081 agcgcctcac agccctgcta ttgccccctg acccaattgt catcaaccat gtcatcagcg
1141 tggacccttc agaccagaag aagacggcgt gctatgacat tgacgtggag gtggaggagc
1201 cattaaaggg gcagatgagc agcttcctcc tatccacggc caaccagcag gagatcagtg
1261 ctctggacag taagatccat gagacgattg agtccataaa ccagctcaag atccagaggg
1321 acttcatgct aagcttctcc agagacccca aaggctatgt ccaagacctg ctccgctccc
1381 agagccggga cctcaaggtg atgacagatg tagccggcaa ccctgaagag gagcgccggg
1441 ctgagttcta ccaccagccc tggtcccagg aggccgtcag tcgctacttc tactgcaaga
1501 tccagcagcg caggcaggag ctggagcagt cgctggttgt gcgcaacacc taggagccca
1561 aaaataagca gcacgacgga actttcagcc gtgtcccggg ccccagcatt ttgccccggg
1621 ctccagcatc actcctctgc caccttgggg tgtggggctg gattaaaagt cattcatctg
1681 acaaaaaaaa aaaaaaaaaa
```

SEQ ID NO: 78 Mouse SMARCD3 cDNA Sequence (NM_025891.3, CDS: 145-1596)

```
   1 gggccccctc cccactccgc tcgagtagaa gtgtgagaga gcccagcagg actcagaggg
  61 gagagttgga ggaaaaaaaa ggcagaaaag ggaaagaaag aggaagagag agagagagtg
 121 agaggagccg ctgagcccac cccgatggcc gcggacgaag ttgccggagg ggcgcgcaaa
 181 gccacgaaaa gcaaactttt tgagtttctg gtccatgggg tgcgccccgg gatgccgtct
 241 ggagcccgaa tgccccacca gggggcgccc atgggccccc cgggctcccc gtacatgggc
```

TABLE 1-continued

```
 301 agccccgcgg tacgacccgg cctggccccc gcgggcatgg agcccgcccg caagcgagca
 361 gcgcccccgc ccgggcagag ccaggcacag ggccagggcc agcccgtgcc caccgcccca
 421 gcgcggagcc gcagtgccaa gaggaggaag atggctgaca aaatcctccc tcaaaggatt
 481 cgggagctgg tacccgagtc ccaggcttac atggacctcc tagcatttga gaggaaactg
 541 gatcaaacca tcatgcggaa gcgggtggac atccaggagg ccctgaagag gcccatgaag
 601 caaaagcgaa agctgcgcct ttatatctcc aatactttta accctgcgaa gcctgatgcg
 661 gaagactctg atggcagcat tgcctcctgg gagctgcggg tggaggggaa gctcttggat
 721 gatcctagta agcagaagag gaagttttct tccttcttca agagtttggt cattgagttg
 781 gacaaagacc tttatggccc agacaaccac cttgttgagt ggcaccggac acccacaacc
 841 caggaaacag atgggttcca agtgaagaga ccaggggact tgagtgtgcg ctgcaccctg
 901 ctcctgatgc tggactatca gcctccccag ttcaaattgg acccccgctt agcccggctg
 961 ctggggttac acacacagag ccgctcagcc attgtccagg cactgtggca gtatgtgaag
1021 accaacaggc tacaggactc ccatgacaag gagtacatca atggcgacaa gtatttccag
1081 cagatttttg actgccccg cctaaagttc tctgagattc cccagcgcct cacagccctg
1141 ctgctgcccc ctgaccccat tgtgatcaac cacgtcatca gcgtggaccc atcagaccag
1201 aagaagacag cgtgctatga catagatgtg gaggtggagg aaccgctgaa agggcagatg
1261 agtagcttcc tcctgtccac ggccaaccag caggagatca gtgctctgga cagtaagatc
1321 catgagacga ttgagtccat aaaccagctc aagatccaga gggacttcat gctaagtttc
1381 tccagagacc ccaaaggcta cgtccaagac ctgctccgct cccagagccg tgatctcaag
1441 gtgatgacag atgtggcagg gaaccccgag gaagaacgca gggctgagtt ctaccaccag
1501 ccctggtccc aggaagccgt tagccgctac ttctactgta agatccagca gcgcaggcag
1561 gagctggagc agtcgctggt cgtgcgcaac acctaggagc ccgtgaacaa gcgtcagggt
1621 ggaccagcca ctccgcccag cacaggccct gggctctgga ctccccctct cgcgctgtgc
1681 ggaaggtggg gagggctgga tggattaaag gtcacgtaac agacaaaaaa aaaaaaaaaa
1741 aaa
```

SEQ ID NO: 79 Mouse SMARCD3 Amino Acid Sequence (NP_080167.3)

```
   1 maadevagga rkatksklfe flvhgvrpgm psgarmphqg apmgppgspy mgspavrpgl
  61 apagmepark raapppgqsq aggqggpvpt aparsrsakr rkmadkilpq rirelvpesq
 121 aymdllafer kldqtimrkr vdiqealkrp mkqkrklrly isntfnpakp daedsdgsia
 181 swelrvegkl lddpskqkrk fssffkslvi eldkdlygpd nhlvewhrtp ttgetdgfqv
 241 krpgdlsvrc tlllmldyqp pqfkldprla rllglhtqsr saivqalwqy vktnrlqdsh
 301 dkeyingdky fqqifdcprl kfseipqrlt alllppdpiv inhvisvdps dqkktacydi
 361 dveveeplkg qmssfllsta nqqeisalds kihetiesin qlkiqrdfml sfsrdpkgyv
 421 qdllrsqsrd lkvmtdvagn peeerraefy hqpwsqeays ryfyckiqqr rgelegslvv
 481 rnt
```

SEQ ID NO: 80 Human SMARCB1 cDNA Sequence Variant 1 (NM_003073.4, CDS: 240-1397)

```
   1 tttgtttgag cggcggcgcg cgcgtcagcg tcaacgccag cgcctgcgca ctgagggcgg
  61 cctggtcgtc gtctgcggcg gcggcggcgg ctgaggagcc cggctgaggc gccagtaccc
 121 ggcccggtcc gcatttcgcc ttccggcttc ggtttccctc ggcccagcac gccccggccc
 181 cgccccagcc ctcctgatcc ctcgcagccc ggctccggcc gcccgcctct gccgccgcaa
 241 tgatgatgat ggcgctgagc aagaccttcg ggcagaagcc cgtgaagttc cagctggagg
 301 acgacggcga gttctacatg atcggctccg aggtgggaaa ctacctccgt atgttccgag
 361 gttctctgta caagagatac ccctcactct ggaggcgact agccactgtg gaagagagga
 421 agaaaatagt tgcatcgtca catggtaaaa aaacaaaacc taacactaag gatcacggat
 481 acacgactct agccaccagt gtgaccctgt taaaagcctc ggaagtggaa gagattctgg
 541 atggcaacga tgagaagtac aaggctgtgt ccatcagcac agagcccccc acctacctca
 601 gggaacagaa ggccaagagg aacagccagt gggtacccac cctgcccaac agctcccacc
 661 acttagatgc cgtgccatgc tccacaacca tcaacaggaa ccgcatgggc cgagacaaga
 721 agagaacctt ccccctttgc tttgatgacc atgacccagc tgtgatccat gagaacgcat
 781 ctcagcccga ggtgctggtc cccatccggc tggacatgga gatcgatggg cagaagctgc
 841 gagacgcctt cacctggaac atgaatgaga agttgatgac gcctgagatg ttttcagaaa
 901 tcctctgtga cgatctggat ttgaacccgc tgacgtttgt gccagccatc gcctctgcca
 961 tcagacagca gatcgagtcc taccccacgg acagcatcct ggaggaccag tcagaccagc
1021 gcgtcatcat caagctgaac atccatgtgg gaaacatttc cctggtggac cagtttgagt
1081 gggacatgtc agagaaggag aactcaccag agaagtttgc cctgaagctg tgctcggagc
1141 tggggttggg cggggagttt gtcaccacca tcgcatacag catccgggga cagctgagct
1201 ggcatcagaa gacctacgcc ttcagcgaga accctctgcc cacagtggag attgccatcc
1261 ggaacacggg cgatgcggac cagtggtgcc cactgctgga gactctgaca gacgctgaga
1321 tggagaagaa gatccgcgac caggacagga acacgaggcg gatgaggcgt cttgccaaca
1381 cggccccggc ctggtaacca gcccatcagc acacggctcc cacggagcat ctcagaagat
1441 tgggccgcct ctcctccatc ttctggcaag gacagaggcg aggggacagc ccagcgccat
1501 cctgaggatc gggtgggggt ggagtggggg cttccaggtg gcccttcccg gcacacattc
1561 catttgttga gccccagtcc tgccccccac cccaccctcc ctacccctcc ccagtctctg
1621 gggtcaggaa gaaaccttat tttaggttgt gttttgtttt tgtataggag ccccaggcag
1681 ggctagtaac agtttttaaa taaaaggcaa caggtcatgt tcaatttctt caacaaaaaa
1741 aaaaaaaaa
```

SEQ ID NO: 81 Human SMARCB1 Amino Acid Sequence Isoform A (NP_003064.2)

```
   1 mmmmalsktf gqkpvkfqle ddgefymigs evgnylrmfr gslykrypsl wrrlatveer
  61 kkivasshgk ktkpntkdhg yttlatsvtl lkaseveeil dgndekykav sistepptyl
 121 reqkakrnsq wvptlpnssh hldavpcstt inrnrmgrdk krtfplcfdd hdpavihena
 181 sqpevlvpir ldmeidgqkl rdaftwnmne klmtpemfse ilcddldlnp ltfvpaiasa
 241 irqqiesypt dsiledqsdq rviiklnihv gnislvdqfe wdmsekensp ekfalklcse
 301 lglggefvtt iaysirgqls whqktyafse nplptveiai rntgdadqwc plletltdae
 361 mekkirdqdr ntrrmrrlan tapaw
```

TABLE 1-continued

SEQ ID NO: 82 Human SMARCB1 cDNA Sequence Variant 2 (NM_001007468.2, CDS: 240-1370)

```
   1 tttgtttgag cggcggcgcg cgcgtcagcg tcaacgccag cgcctgcgca ctgagggcgg
  61 cctggtcgtc gtctgcggcg gcggcggcgg ctgaggagcc cggctgaggc gccagtaccc
 121 ggcccggtcc gcatttcgcc ttccggcttc ggtttccctc ggcccagcac gccccggccc
 181 cgccccagcc ctcctgatcc ctcgcagccc ggctccggcc gcccgcctct gccgccgcaa
 241 tgatgatgat ggcgctgagc aagaccttcg ggcagaagcc cgtgaagttc cagctggagg
 301 acgacggcga gttctacatg atcggctccg aggtgggaaa ctacctccgt atgttccgag
 361 gttctctgta caagagatac ccctcactct ggaggcgact agccactgtg gaagagagga
 421 agaaaatagt tgcatcgtca catgatcacg gatacacgac tctagccacc agtgtgaccc
 481 tgttaaaagc ctcggaagtg gaagagattc tggatggcaa cgatgagaag tacaaggctg
 541 tgtccatcag cacagagccc cccacctacc tcagggaaca gaaggccaag aggaacagcc
 601 agtgggtacc caccctgccc aacagctccc accacttaga tgccgtgcca tgctccacaa
 661 ccatcaacag gaaccgcatg ggccgagaca agaagagaac cttcccctt tgctttgatg
 721 accatgaccc agctgtgatc catgagaacg catctcagcc cgaggtgctg gtccccatcc
 781 ggctggacat ggagatcgat gggcagaagc tgcgagacgc cttcacctgg aacatgaatg
 841 agaagttgat gacgcctgag atgttttcag aaatcctctg tgacgatctg gatttgaacc
 901 cgctgacgtt tgtgccagcc atcgcctctg ccatcagaca gcagatcgag tcctacccca
 961 cggacagcat cctggaggac cagtcagacc agcgcgtcat catcaagctg aacatccatg
1021 tgggaaacat ttccctggtg gaccagtttg agtgggacat gtcagagaag gagaactcac
1081 cagagaagtt tgccctgaag ctgtgctcgg agctggggtt gggcggggag tttgtcacca
1141 ccatcgcata cagcatccgg ggacagctga gctggcatca gaagacctac gccttcagcg
1201 agaaccctct gcccacagtg gagattgcca tccggaacac gggcgatgcg gaccagtggt
1261 gcccactgct ggagactctg acagacgctg agatggagaa gaagatccgc gaccaggaca
1321 ggaacacgag gcggatgagg cgtcttgcca acacggcccc ggcctggtaa ccagcccatc
1381 agcacacggc tcccacggag catctcagaa gattgggccg cctctcctcc atcttctggc
1441 aaggacagag gcgaggggac agcccagcgc catcctgagg atcgggtggg ggtggagtgg
1501 gggcttccag gtggcccttc ccggcacaca ttccatttgt tgagccccag tcctgccccc
1561 caccccaccc tccctacccc tccccagtct ctggggtcag gaagaaacct tattttaggt
1621 tgtgttttgt ttttgtatag gagccccagg cagggctagt aacagttttt aaataaaagg
1681 caacaggtca tgttcaattt cttcaacaaa aaaaaaaaaa aa
```

SEQ ID NO: 83 Human SMARCB1 Amino Acid Sequence Isoform B (NP_001007469.1)

```
   1 mmmmalsktf gqkpvkfqle ddgefymigs evgnylrmfr gslykrypsl wrrlatveer
  61 kkivasshdh gyttlatsvt llkaseveei ldgndekyka vsisteppty lreqkakrns
 121 qwvptlpnss hhldavpcst tinrnrmgrd kkrtfplcfd dhdpavihen asqpevlvpi
 181 rldmeidgqk lrdaftwnmn eklmtpemfs eilcddldln pltfvpaias airqqiesyp
 241 tdsiledqsd qrviiklnih vgnislvdqf ewdmsekens pekfalklcs elglggefvt
 301 tiaysirgql swhqktyafs enplptveia irntgdadqw cplletltda emekkirdqd
 361 rntrrmrrla ntapaw
```

SEQ ID NO: 84 Human SMARCB1 cDNA Sequence Variant 3 (NM_001317946.1, CDS: 240-1424)

```
   1 tttgtttgag cggcggcgcg cgcgtcagcg tcaacgccag cgcctgcgca ctgagggcgg
  61 cctggtcgtc gtctgcggcg gcggcggcgg ctgaggagcc cggctgaggc gccagtaccc
 121 ggcccggtcc gcatttcgcc ttccggcttc ggtttccctc ggcccagcac gccccggccc
 181 cgccccagcc ctcctgatcc ctcgcagccc ggctccggcc gcccgcctct gccgccgcaa
 241 tgatgatgat ggcgctgagc aagaccttcg ggcagaagcc cgtgaagttc cagctggagg
 301 acgacggcga gttctacatg atcggctccg aggtgggaaa ctacctccgt atgttccgag
 361 gttctctgta caagagatac ccctcactct ggaggcgact agccactgtg gaagagagga
 421 agaaaatagt tgcatcgtca catgatcacg gatacacgac tctagccacc agtgtgaccc
 481 tgttaaaagc ctcggaagtg gaagagattc tggatggcaa cgatgagaag tacaaggctg
 541 tgtccatcag cacagagccc cccacctacc tcagggaaca gaaggccaag aggaacagcc
 601 agtgggtacc caccctgccc aacagctccc accacttaga tgccgtgcca tgctccacaa
 661 ccatcaacag gaaccgcatg ggccgagaca agaagagaac cttcccctt tggtgtggat
 721 gcatcgctgc actcaccctc cgtgctgatt ccgccttagt tctccacttt gatgaccatg
 781 acccagctgt gatccatgag aacgcatctc agcccgaggt gctggtcccc atccggctgg
 841 acatggagat cgatgggcag aagctgcgag acgccttcac ctggaacatg aatgagaagt
 901 tgatgacgcc tgagatgttt tcagaaatcc tctgtgacga tctggatttg aacccgctga
 961 cgtttgtgcc agccatcgcc tctgccatca gacagcagat cgagtcctac cccacggaca
1021 gcatcctgga ggaccagtca gaccagcgcg tcatcatcaa gctgaacatc catgtgggaa
1081 acatttccct ggtggaccag tttgagtggg acatgtcaga gaaggagaac tcaccagaga
1141 agtttgccct gaagctgtgc tcggagctgg ggttgggcgg ggagtttgtc accaccatcg
1201 catacagcat ccggggacag ctgagctggc atcagaagac ctacgccttc agcgagaacc
1261 ctctgcccac agtggagatt gccatccgga acacgggcga tgcggaccag tggtgcccac
1321 tgctggagac tctgacagac gctgagatgg agaagaagat ccgcgaccag gacaggaaca
1381 cgaggcggat gaggcgtctt gccaacacgg ccccggcctg gtaaccagcc catcagcaca
1441 cggctcccac ggagcatctc agaagattgg gccgcctctc ctccatcttc tggcaaggac
1501 agaggcgagg ggacagccca gcgccatcct gaggatcggg tgggggtgga gtgggggctt
1561 ccaggtggcc cttcccggca cacattccat ttgttgagcc ccagtcctgc ccccccaccc
1621 accctcccta cccctcccca gtctctgggg tcaggaagaa accttatttt aggttgtgtt
1681 ttgtttttgt ataggagccc caggcagggc tagtaacagt tttaaaataa aaggcaacag
1741 gtcatgttca atttcttcaa caaaaaaaaa aaaaaa
```

SEQ ID NO: 85 Human SMARCB1 Amino Acid Sequence Isoform C (NP_001304875.1)

```
   1 mmmmalsktf gqkpvkfqle ddgefymigs evgnylrmfr gslykrypsl wrrlatveer
  61 kkivasshdh gyttlatsvt llkaseveei ldgndekyka vsisteppty lreqkakrns
 121 qwvptlpnss hhldavpcst tinrnrmgrd kkrtfplwcg ciaaltlrad salvlhfddh
 181 dpavihenas qpevlvpirl dmeidgqklr daftwnmnek lmtpemfsei lcddldlnpl
 241 tfvpaiasai rqqiesyptd siledqsdqr viiklnihvg nislvdqfew dmsekenspe
```

TABLE 1-continued 301 kfalklcsel glggefvtti aysirgqlsw hqktyafsen plptveiair ntgdadqwcp
361 lletltdaem ekkirdqdrn trrmrrlant apaw SEQ ID NO: 86 Human SMARCB1 cDNA Sequence Variant 4 (NM_001362877.1, CDS: 240-1451)
1 tttgtttgag cggcggcgcg cgcgtcagcg tcaacgccag cgcctgcgca ctgagggcgg
61 cctggtcgtc gtctgcggcg gcggcggcgg ctgaggagcc cggctgaggc gccagtaccc
121 ggcccggtcc gcatttcgcc ttccggcttc ggtttccctc ggcccagcac gccccggccc
181 cgccccagcc ctcctgatcc ctcgcagccc ggctccggcc gcccgcctct gccgccgcaa
241 tgatgatgat ggcgctgagc aagaccttcg ggcagaagcc cgtgaagttc cagctggagg
301 acgacggcga gttctacatg atcggctccg aggtgggaaa ctacctccgt atgttccgag
361 gttctctgta caagagatac cccctcactct ggaggcgact agccactgtg gaagagagga
421 agaaaatagt tgcatcgtca catggtaaaa aaacaaaacc taacactaag gatcacggat
481 acacgactct agccaccagt gtgaccctgt taaaagcctc ggaagtggaa gagattctgg
541 atggcaacga tgagaagtac aaggctgtgt ccatcagcac agagcccccc acctacctca
601 gggaacagaa ggccaagagg aacagccagt gggtacccac cctgcccaac agctcccacc
661 acttagatgc cgtgccatgc tccacaacca tcaacaggaa ccgcatgggc cgagacaaga
721 agagaacctt cccccttttgg tgtggatgca tcgctgcact caccctccgt gctgattccg
781 ccttagttct ccactttgat gaccatgacc cagctgtgat ccatgagaac gcatctcagc
841 ccgaggtgct ggtccccatc cggctggaca tggagatcga tgggcagaag ctgcgagacg
901 ccttcacctg gaacatgaat gagaagttga tgacgcctga gatgttttca gaaatcctct
961 gtgacgatct ggatttgaac ccgctgacgt ttgtgccagc catcgcctct gccatcagac
1021 agcagatcga gtcctacccc acggacagca tcctggagga ccagtcagac cagcgcgtca
1081 tcatcaagct gaacatccat gtgggaaaca tttccctggt ggaccagttt gagtgggaca
1141 tgtcagagaa ggagaactca ccagagaagt ttgccctgaa gctgtgctcg gagctggggt
1201 tgggcgggga gtttgtcacc accatcgcat acagcatccg gggacagctg agctggcatc
1261 agaagaccta cgccttcagc gagaaccctc tgcccacagt ggagattgcc atccggaaca
1321 cgggcgatgc ggaccagtgg tgcccactgc tggagactct gacagacgct gagatggaga
1381 agaagatccg cgaccaggac aggaacacga ggcggatgag gcgtcttgcc aacacggccc
1441 cggcctggta accagcccat cagcacacgg ctcccacgga gcatctcaga agattgggcc
1501 gcctctcctc catcttctgg caaggacaga ggcgagggga cagcccagcg ccatcctgag
1561 gatcgggtgg gggtggagtg ggggcttcca ggtggccctt cccggcacac attccatttg
1621 ttgagcccca gtcctgcccc ccaccccacc ctccctaccc ctccccagtc tctggggtca
1681 ggaagaaacc ttattttagg ttgtgttttg tttttgtata ggagccccag gcagggctag
1741 taacagtttt taaataaaag gcaacaggtc atgttcaatt tcttcaacaa aaaaaaaaaa
1801 aaa SEQ ID NO: 87 Human SMARCB1 Amino Acid Sequence Isoform D (NP_001349806.1)
1 mmmmalsktf gqkpvkfqle ddgefymigs evgnylrmfr gslykrypsl wrrlatveer
61 kkivasshgk ktkpntkdhg yttlatsvtl lkaseveeil dgndekykav sistepptyl
121 reqkakrnsq wvptlpnssh hldavpcstt inrnrmgrdk krtfplwcgc iaaltlrads
181 alvlhfddhd pavihenasq pevlvpirld meidgqklrd aftwnmnekl mtpemfseil
241 cddldlnplt fvpaiasair qqiesyptds iledqsdqry iiklnihvgn islvdqfewd
301 msekenspek falklcselg lggefvttia ysirgqlswh qktyafsenp lptveiairn
361 tgdadqwcpl letltdaeme kkirdqdrnt rrmrrlanta paw SEQ ID NO: 88 Mouse SMARCB1 cDNA Sequence Variant 1 (NM_011418.2, CDS: 220-1377)
1 gtcagcttct ccacgcatgc gcaccgaggg cggcctgctc gttgcagaga cggccaagga
61 gcccagtagt gacacgagcg ctcgccccggt tcgcccggct tgccctgccc gaccttcacc
121 tccaggcctc cgttcctttc ggtccgacgc gcctcggccc cgccctagcc caccggattc
181 tttccagctc gaccccggct gccggtttcc cccgccgcca tgatgatgat ggcgttgagc
241 aagaccttcg ggcagaagcc cgtcaagttt cagctggagg acgacgggga gttctacatg
301 atcggctccg aggtgggaaa ctacctgcgt atgttccgag gttctctgta caagagatac
361 ccctcactct ggcggcgact agccactgtg gaagaaagga agaaaatagt ggcatcgtca
421 catggtaaaa aaacaaaacc taacactaag gatcatggat ataccaccct ggccaccagc
481 gtgacactcc tgaaagcctc agaggtagaa gagatcctgg atggcaatga cgagaagtac
541 aaggctgtgt ccatcagcac agagccccg acctacctca gggagcagaa ggccaagagg
601 aacagccagt gggtccccac cctgcccaac agctcccacc acctggatgc tgtgccctgt
661 tccaccacca tcaacaggaa ccgcatgggt cgggacaaga agagaacctt ccccttgtgc
721 tttgatgacc acgacccagc tgtgatccat gagaatgcgt cacagcctga ggtgctggtg
781 cccatccggc tcgacatgga gatcgacggg cagaagctgc gagacgcttt tacctggaac
841 atgaatgaga agctaatgac tcctgagatg ttttcagaaa tactttgtga tgacctggat
901 ttgaatccac tgacttttgt gccagctatt gcctctgcca ttcgacagca gattgagtcc
961 taccccacag acagcatcct agaggatcaa tccgaccagc gtgtcatcat caagctgaac
1021 atccacgtgg ggaacatctc cctggtggac cagtttgagt gggacatgtc agagaaagag
1081 aactccccag agaagtttgc cctgaagctg tgctcagagc tgggcttggg cggggagttt
1141 gtcaccacca ttgcatacag catccgagga cagctgagct ggcaccagaa gacctatgcc
1201 ttcagtgaga acccacttcc cacagtggag attgccatcc gaaataccgg agatgctgac
1261 cagtggtgcc ccctgctgga gacactgact gatgccgaga tggagaaaaa gatccgggat
1321 caagatagga acacaaggcg aatgaggcgt cttgccaaca ctgccccagc ctggtgatga
1381 agacatccat gctcgacctc tacggagcat ctcagactgc ctttccttcc tctgtggaaa
1441 gagaaaggca aagggacagc tggtgccatc ctgaggactg ggtaggagc ctcctaggtg
1501 cctcccttca gcacacattc catttgctaa accccaacac tgtcccccag agtctagagt
1561 cggaagcagc ctcattttgg gttgtgtttt gtttttgtat aggagcccag gcagggctgg
1621 taacactttt taaataaaaa gtaccatgtt caatttcaaa aaaaaaaaaa aaaa SEQ ID NO: 89 Mouse SMARCB1 Amino Acid Sequence Isoform 1 (NP_035548.1)
1 mmmmalsktf gqkpvkfqle ddgefymigs evgnylrmfr gslykrypsl wrrlatveer
61 kkivasshgk ktkpntkdhg yttlatsvtl lkaseveeil dgndekykav sistepptyl TABLE 1-continued

```
 121 reqkakrnsq wvptlpnssh hldavpcstt inrnrmgrdk krtfplcfdd hdpavihena
 181 sqpevlvpir ldmeidgqkl rdaftwnmne klmtpemfse ilcddldlnp ltfvpaiasa
 241 irqqiesypt dsiledqsdq rviiklnihv gnislvdqfe wdmsekensp ekfalklcse
 301 lglggefvtt iaysirgqls whqktyafse nplptveiai rntgdadqwc plletltdae
 361 mekkirdqdr ntrrmrrlan tapaw
```

SEQ ID NO: 90 Mouse SMARCB1 cDNA Sequence Variant 2 (NM_001161853.1, CDS: 220-1350)

```
    1 gtcagcttct ccacgcatgc gcaccgaggg cggcctgctc gttgcagaga cggccaagga
   61 gcccagtagt gacacgagcg ctcgcccggt tcgcccggct tgccctgccc gaccttcacc
  121 tccaggcctc cgttcctttc ggtccgacgc gcctcggccc cgccctagcc caccggattc
  181 tttccagctc gaccccggct gccggtttcc cccgccgcca tgatgatgat ggcgttgagc
  241 aagaccttcg ggcagaagcc cgtcaagttt cagctggagg acgacgggga gttctacatg
  301 atcggctccg aggtgggaaa ctacctgcgt atgttccgag gttctctgta caagagatac
  361 ccctcactct ggcggcgact agccactgtg gaagaaagga agaaaatagt ggcatcgtca
  421 catgatcatg gatataccac cctggccacc agcgtgacac tcctgaaagc ctcagaggta
  481 gaagagatcc tggatggcaa tgacgagaag tacaaggctg tgtccatcag cacagagccc
  541 ccgacctacc tcagggagca gaaggccaag aggaacagcc agtgggtccc caccctgccc
  601 aacagctccc accacctgga tgctgtgccc tgttccacca ccatcaacag gaaccgcatg
  661 ggtcgggaca agaagagaac cttccccttg tgctttgatg accacgaccc agctgtgatc
  721 catgagaatg cgtcacagcc tgaggtgctg gtgcccatcc ggctcgacat ggagatcgac
  781 gggcagaagc tgcgagacgc ttttacctgg aacatgaatg agaagctaat gactcctgag
  841 atgttttcag aaatactttg tgatgacctg gatttgaatc cactgacttt tgtgccagct
  901 attgcctctg ccattcgaca gcagattgag tcctacccca cagacagcat cctagaggat
  961 caatccgacc agcgtgtcat catcaagctg aacatccacg tggggaacat ctccctggtg
 1021 gaccagtttg agtgggacat gtcagagaaa gagaactccc cagagaagtt tgccctgaag
 1081 ctgtgctcag agctgggctt gggcggggag tttgtcacca ccattgcata cagcatccga
 1141 ggacagctga gctggcacca gaagacctat gccttcagtg agaaccccct tcccacagtg
 1201 gagattgcca tccgaaatac cggagatgct gaccagtggt gcccccctgct ggagacactg
 1261 actgatgccg agatggagaa aaagatccgg gatcaagata ggaacacaag gcgaatgagg
 1321 cgtcttgcca acactgcccc agcctggtga tgaagacatc catgctcgac ctctacggag
 1381 catctcagac tgcctttcct tcctctgtgg aaagagaaag gcaaagggac agctggtgcc
 1441 atcctgagga ctggggtagg agcctcctag gtgcctccct tcagcacaca ttccatttgc
 1501 taaaccccaa cactgtcccc cagagtctag agtcggaagc agcctcattt tgggttgtgt
 1561 tttgtttttg tataggagcc caggcagggc tggtaacact ttttaaataa aaagtaccat
 1621 gttcaatttc aaaaaaaaaa aaaaaaa
```

SEQ ID NO: 91 Mouse SMARCB1 Amino Acid Sequence Isoform 2 (NP_001155325.1)

```
    1 mmmmalsktf gqkpvkfqle ddgefymigs evgnylrmfr gslykrypsl wrrlatveer
   61 kkivasshdh gyttlatsvt llkaseveei ldgndekyka vsisteppty lreqkakrns
  121 qwvptlpnss hhldavpcst tinrnrmgrd kkrtfplcfd dhdpavihen asqpevlvpi
  181 rldmeidgqk lrdaftwnmn eklmtpemfs eilcddldln pltfvpaias airqqiesyp
  241 tdsiledqsd qrviiklnih vgnislvdqf ewdmsekens pekfalklcs elglggefvt
  301 tiaysirgql swhqktyafs enplptveia irntgdadqw cplletltda emekkirdqd
  361 rntrrmrrla ntapaw
```

SEQ ID NO: 92 human SMARCE1 cDNA Sequence (NM_003079.4, CDS: 125-1360)

```
    1 gctccggacg cgaggggcgg ggcgagcgcg ggacaaaggg aagcgaagcc ggagctgcgg
   61 gcgcttttc tgcccgcggt gtctcagatt cattcttaag gaactgagaa cttaatcttc
  121 caaaatgtca aaaagaccat cttatgcccc acctcccacc ccagctcctg caacacaaat
  181 gcccagcaca ccagggtttg tgggatacaa tccatacagt catctcgcct acaacaacta
  241 caggctggga gggaacccgg gcaccaacag ccgggtcacg gcatcctctg gtatcacgat
  301 tccaaaaccc ccaaagccac cagataagcc gctgatgccc tacatgaggt acagcagaaa
  361 ggtctgggac caagtaaagg cttccaaccc tgacctaaag ttgtgggaga ttggcaagat
  421 tattggtggc atgtggcgag atctcactga tgaagaaaaa caagaatatt taaacgaata
  481 cgaagcagaa aagatagagt acaatgaatc tatgaaggcc tatcataatt cccccgcgta
  541 ccttgcttac ataaatgcaa aaagtcgtgc agaagctgct ttagaggaag aaagtcgaca
  601 gagacaatct cgcatggaga aaggagaacc gtacatgagc attcagcctg ctgaagatcc
  661 agatgattat gatgatggct tttcaatgaa gcatacagcc accgcccgtt tccagagaaa
  721 ccaccgcctc atcagtgaaa ttcttagtga gagtgtggtg ccagacgttc ggtcagttgt
  781 cacaacagct agaatgcagg tcctcaaacg gcaggtccag tccttaatgg ttcatcagcg
  841 aaaactagaa gctgaacttc ttcaaataga ggaacgacac caggagaaga agaggaaatt
  901 cctggaaagc acagattcat ttaacaatga acttaaaagg ttgtgcggtc tgaaagtaga
  961 agtggatatg gagaaaattg cagctgagat tgcacaggca gaggaacagg cccgcaaaag
 1021 gcaggaggaa agggagaagg aggccgcaga gcaagctgag cgcagtcaga gcagcatcgt
 1081 tcctgaggaa gaacaagcag ctaacaaagg cgaggagaag aaagacgacg agaacattcc
 1141 gatggagaca gaggagacac accttgaaga aacaacagag agccaacaga atggtgaaga
 1201 aggcacgtct actcctgagg acaaggagag tgggcaggag ggggtcgaca gtatggcaga
 1261 ggaaggaacc agtgatagta acactggctc ggagagcaac agtgcaacag tggaggagcc
 1321 accaacagat cccataccag aagatgagaa aaaagaataa gtgttgcctt gttttgtgtg
 1381 ttctaaatac tttttttaat gaaaaaatgt tttttggttt taatggtgtt acgtggtttg
 1441 tgtattaatt ttttttcttg tccatatcac accaccaaag gcttttggac catttagcat
 1501 catgagccta atggctcagt cagtcacctt tcttaagtgt tgtgaagatg gctcttttct
 1561 ttggatcttg tttctagccc tcaactgctg aaagcctcag aatttagatt aattgagaaa
 1621 acacccacct cttttagaga attatccttt gatgctgcag aatctactct tacaatgcct
 1681 tcctacagct cactggggtg cttaccaaag ccatagcttt aaacccttccc agtccccatc
 1741 agtagcttcc tgaaagtctc ctctcttgtt tacttctgca aagggtagct tcttaaaaac
 1801 gtgatcatgt atgagtatgt atttgttcac ttaccctttt ttacttttaa tcaatgtcag
 1861 ataccaagag ttgtgttaag ctgagtgtag tgtgtaacta actacacttg gatcttactg
 1921 atccagaaat agtccccata gttagagtag ttacttatga agtggttatt aaagtgaaca
```

TABLE 1-continued

```
1981 cagcacatat acattatcta tactgctttt tgttatgatt aatactgggt atgttctggt
2041 aaatccatcc ttattgtata gaaaaaaaat tacttttta ccaggttttc caaagacaga
2101 atagatcaca aagctcaagg aatttaatat tcttgtaatg gactagataa ttcaaactga
2161 ttagcccatt ccagaagaaa aacagctggg aattaagtta atccacttga aattgtttta
2221 caataatcag aacatccaaa cctcaaggct caggatccca tagaccagag cccacctttt
2281 tgataaactt agtaaagtct tggagactag aagcaagata gtttgtgaca cataagcttc
2341 ccaaaaacta gaatagattt ttactgaata gtggtatatc tgatggtata tgtttcttaa
2401 aggtccaaat gtaataaaaa aaaaa

SEQ ID NO: 93 human SMARCE1 Amino Acid Sequence (NP_003070.3)
   1 mskrpsyapp ptpapatqmp stpgfvgynp yshlaynnyr lggnpgtnsr vtassgitip
  61 kppkppdkpl mpymrysrkv wdqvkasnpd lklweigkii ggmwrdltde ekqeylneye
 121 aekieynesm kayhnspayl ayinaksrae aaleeesrqr qsrmekgepy msiqpaedpd
 181 dyddgfsmkh tatarfqrnh rliseilses vvpdvrsvvt tarmqvlkrq vqslmvhqrk
 241 leaellqiee rhqekkrkfl estdsfnnel krlcglkvev dmekiaaeia qaeegarkrq
 301 eerekeaaeq aersqssivp eeeqaankge ekkddenipm eteethleet tesqqngeeg
 361 tstpedkesg qegvdsmaee gtsdsntgse snsatveepp tdpipedekk e

SEQ ID NO: 94 Mouse SMARCE1 cDNA Sequence (NM_020618.4, CDS: 662-1897)
   1 ggcggaggca ggggagcccc gctgggcgcc agcaaggacc taaacgcagc gacccgggtc
  61 ctccccgcct acattctcca tcttctccat tcatacgtcc atcagcggag gactgaagac
 121 cagagcgaag ggaaaagcca gagtgcatgg tgtgtgggaa ctgcgtccca ccctctcccg
 181 ggagaggctc cggcgagcct ttcccctccg gcgcccgcct cacgcggcgg cgcccaccgc
 241 ctcagtgaag ccccgggcgc gcagtctgcg cagttcctgc cgccgggccg cgaaccaggg
 301 cccgcaacgc ggcccagcct tctccgccct cctcgccgtg acgaatcggc gcccgactgg
 361 gacgggatcc aaattggaag acttctgagg aaacccagga gcctgacgaa attttttta
 421 aaaatccttg gcgccctaag cctcgccgcg tgctcactgg aagggctgtt cgtctgccgg
 481 gagccggccg cggccggcag acaattcccg ggagcgtgtg gaaagtgcga gcgcggaagc
 541 tccggcgcga ggggcggggc gagcgcggga caaagggaag cgaagccgga gctgcgggcg
 601 cctgctcggc ccgcggtgtc tcagattcat tcttaaggaa ctgagaactt aatcttccaa
 661 aatgtcaaaa agaccatctt atgccccacc tcccacccca gctcctgcaa cacaaatgcc
 721 cagcacacca gggtttgtgg gatacaatcc atacagtcat ctcgcctaca acaactacag
 781 gctgggaggg aacccgggca ccaacagccg ggtcacggcg tcctctggca ttacgattcc
 841 aaagcctcca aagccaccag ataagccgct gatgccctac atgaggtaca gcagaaaggt
 901 ctgggaccaa gtaaaggctt ccaaccctga cctaaagttg tgggagattg gcaagattat
 961 tggtggcatg tggcgagatc tcactgatga agagaagcaa gaatatttaa acgaatacga
1021 agcagaaaag atagagtaca atgagtctat gaaggcctac cataattccc ctgcgtacct
1081 tgcctatatt aatgcaaaaa gtcgtgcgga agctgcatta gaggaagaaa gtcgacagag
1141 acagtctcgc atggagaaag gagaacctta catgagcatt cagcctgctg aggatccaga
1201 cgactatgat gatggctttt caatgaagca cacagccact gcccgtttcc agagaaacca
1261 ccgtctcatc agtgagatcc tcagtgagag tgtggtacct gatgtgcggt cggttgtcac
1321 aacagctaga atgcaggtcc tcaagcgaca ggtccagtct ttaatggttc atcagcggaa
1381 actagaagcc gagctccttc agatagagga acgacaccag gaaaagaaga ggaaattcct
1441 ggaaagcacg gactccttta acaatgaact taaaaggtta tgtggtctga aggtggaagt
1501 agacatggag aagattgcgg ctgagatcgc acaggcggag gaacaagccc gcaagaggca
1561 agaggagagg gagaaggagg cagcagagca ggctgagcgc agtcagagca gcatggcccc
1621 tgaggaagag caagtggcga acaaagccga ggagaagaaa gatgaggaga gcatcccgat
1681 ggagacagag gagacacacc ttgaagacac agcagagagc cagcagaatg gtgaagaagg
1741 cacgtctact cctgaggaca aggagagtgg gcaggagggg gttgacagca tggaggtgga
1801 agggaccagt gacagtaaca cgggctcaga gagcaacagc gccacagtgg aggagccgcc
1861 cacagaccca gtgccagaag acgagaagaa ggagtaaatg ttgccttgtt ttatgtgacc
1921 taaaactttt ttaaatgaaa aaaaaatgtg gttttttttt tggttttaat ggtgttatgt
1981 ggtctgtgta ttaattattt acttttccgt tgatacaaca tgaaggtctt tgaaccctca
2041 gcatcatagc ctaatgccag ccgctcacct ttcttagctc tcaacgtctg aaacctcaga
2101 gctgagatta atcaagacac ccatcattct ctgagaacta ccttggctgc tgcagaatcg
2161 actcttccaa atacctgcct tcagctcacg tggtgctcac caaagccata gctttaaacc
2221 cttccagccc atccacagct ttcccagtcc ctgtcttgtg tacttacaca gagtgccctc
2281 ttgaaatcat gagggggtct cttcactcac cctttctatg tcccatgtca gacaccagga
2341 gttctcttac agggtagggt gtagccagaa actggtgaga cacagatcac agagatgcct
2401 ctgggggcac tgggggtggg ggagcagggg gagtacagtt gttctttctg tggattcctt
2461 gttggtgaga gctgcgcctg cttatctaga gtgctgttca gtgtagtcga tctgggatgt
2521 gttctgggaa attcatcctt tttgtacagg ggaaagaaac acttttttt accagattgg
2581 ctttccaaag acacgataga tggcagagct taaggaatgg aatgttctta taatggacta
2641 cagacttcaa agtgattggc ccattccaaa aggaaaatgg gaatgctgtt catccatgtg
2701 agcatacttc acagtgatga aaacctcaag actcgagatc ccatagatca gagccgaacc
2761 tacttttttg ataaccccctg tagtggtctt agagactaga aacaagatag tttgtagtgt
2821 gtgctcccta aaatctagaa tagattttta ctgaatagtg gtatatatga tggtatatgt
2881 ttcttaaagg tccaaacata ataaagaaat taagacaaaa aaaaaaaaaa aaaaaaaaaa
2941 aaaaaaaaaa aaaaaaaaaa a

SEQ ID NO: 95 Mouse SMARCE1 Amino Acid Sequence (NP_065643.1)
   1 mskrpsyapp ptpapatqmp stpgfvgynp yshlaynnyr lggnpgtnsr vtassgitip
  61 kppkppdkpl mpymrysrkv wdqvkasnpd lklweigkii ggmwrdltde ekqeylneye
 121 aekieynesm kayhnspayl ayinaksrae aaleeesrqr gsrmekgepy msiqpaedpd
 181 dyddgfsmkh tatarfqrnh rliseilses vvpdvrsvvt tarmqvlkrq vqslmvhqrk
 241 leaellqiee rhqekkrkfl estdsfnnel krlcglkvev dmekiaaeia qaeeqarkrq
 301 eerekeaaeq aersqssmap eeeqvankae ekkdeesipm eteethledt aesqqngeeg
 361 tstpedkesg qegvdsmeve gtsdsntgse snsatveepp tdpvpedekk e
```

TABLE 1-continued

SEQ ID NO: 96 Human DPF1 cDNA Sequence Variant 1 (NM_001135155.2, CDS: 28-1272)

```
   1 gtgctcccgc cccccgggaa tgaatggatg ggcggcctca gcgcccgccc gaccgctggg
  61 aggaccgacc cggcggggac ctgctggggg caggacccgg ggagcaagat ggccactgtc
 121 atccctggcc ccctgagcct aggcgaggac ttctaccgcg aggccatcga gcactgccgc
 181 agttacaacg cgcgcctgtg cgccgagcgc agcctgcgac tgcccttcct cgactcgcag
 241 accggcgtgg cccagaacaa ctgctacatc tggatggaga agacccaccg cgggccgggt
 301 ttggccccgg gacagattta cacgtacccc gcccgctgtt ggaggaagaa acggagactc
 361 aacatcctgg aggaccccag actcaggccc tgcgagtaca agatcgactg tgaagcaccc
 421 ctgaagaagg agggtggcct cccggaaggg ccggtcctcg aggctctact gtgtgcagag
 481 acgggggaga agaagattga gctgaaggag gaggagacca ttatggactg tcagaaacag
 541 cagttgctgg agtttccgca tgacctcgag gtggaagact tggaggatga cattcccagg
 601 aggaagaaca gggccaaagg aaaggcatat ggcatcgggg gtctccggaa acgccaggac
 661 accgcttccc tggaggaccg agacaagccg tatgtctgtg atatctgtgg gaaacggtat
 721 aagaaccggc cggggctcag ctaccactac acccacaccc acctggccga ggaggagggg
 781 gaggagaacg ccgaacgcca cgccctgccc ttccaccgga aaaacaacca taaacagttt
 841 tacaaagaat tggcctgggt ccctgaggca caaaggaaac acacagccaa gaaggcgccc
 901 gacggcactg tcatccccaa cggctactgt gacttctgcc tgggggggctc caagaagacg
 961 gggtgtcccg aggacctcat ctcctgtgcg gactgtgggc gatcaggaca cccctcgtgt
1021 ttacaattca cggtgaacat gacggcagcc gtgcggacct accgctggca gtgcatcgag
1081 tgcaaatcct gcagcctgtg cggaacctcc gagaacgacg accagctgct gttttgtgat
1141 gactgcgatc ggggttacca catgtactgc ctgagtcccc ccatggcgga gcccccggaa
1201 gggagctgga gctgtcacct ctgtctccgg cacctgaagg aaaaggcttc tgcttacatc
1261 accctcacct aggccggctc ggctcgccgc gactctgggg tggtgctcgc ctacctgcct
1321 ctccgagctc ctcaattctc ccccaccctg aacatcccgc agggggaggg ggagaggggg
1381 aagccgagag ggggctgggc cacccccctcc cctctgtgca agtggaatgt ctgccctgtg
1441 ggtgggtggg cccggccagg gcctctccct ccctccctcc ctctctgtcc cttggcaaat
1501 ggacaccagg ggcttctccc ctcaaagcca taccccgcct ctgggcgggc atgggggggtg
1561 gtgggtgcca gccaggggca tggacagagc ctttttctaa agaaaaagac aaaaagttaa
1621 aaaaaaaaaa aagaagaaaa gaaaagaagt taatatatac aaagagtcct ccaaggcctg
1681 gctgggtgga ggggcgctgc tgagagtgtc caccgggcac ccgcctctgc cggccccccg
1741 ccgggcgccc caaccccaat ttctggagct gcagccgtcc cgcgccccac ccaaggtggg
1801 cgccttcccc tcttgtgccc agggcggtgg gcgtggtgtc cacccgcccc tcctggtgcc
1861 cacggtggat actgcatgat gtgaaccttg gttttgaact ctgttcctgc ccctccccga
1921 ccgccccagc ctgtgcccgc cccgtgcctg ccgtggctgg tgggtggcgg tggtggggcc
1981 gggtgggccc ccgcccagcg cctgctggaa tgagaagcac agactccgcc acggactcct
2041 tttctctccc tcctcccgcc ccgccaggcc tggcggcccc cgcccccctc gctggccatt
2101 ttgggggagt gagggggcgt ggttgtttct tgtggttgtg tgtgtttgtt gttcgggttt
2161 taaaaaaggg aaactgagac tgcaggtggg ggaggtggtg ggttttgggg ggatgtcccc
2221 taatccagga gtgccccctc acttgtcacc gagtctcctc tattgcctgc ctctgctgtg
2281 aattaacttg ttctgtgtat taaactgggc ctgacccctc tgcccacgaa aaaaaaaaaa
2341 aaaaaaaa
```

SEQ ID NO: 97 Human DPF1 Amino Acid Sequence Isoform A (NP_001128627.1)

```
   1 mgglsarpta grtdpagtcw gqdpgskmat vipgplslge dfyreaiehc rsynarlcae
  61 rslrlpflds qtgvaqnncy iwmekthrgp glapgqiyty parcwrkkrr lniledprlr
 121 pceykidcea plkkegglpe gpvleallca etgekkielk eeetimdcqk qqllefphdl
 181 evedleddip rrknrakgka ygigglrkrq dtasledrdk pyvcdicgkr yknrpglsyh
 241 yththlaeee geenaerhal pfhrknnhkq fykelawvpe aqrkhtakka pdgtvipngy
 301 cdfclggskk tgcpedlisc adcgrsghps clqftvnmta avrtyrwqci eckscslcgt
 361 senddqllfc ddcdrgyhmy clsppmaepp egswschlcl rhlkekasay itlt
```

SEQ ID NO: 98 Human DPF1 cDNA Sequence Variant 2 (NM_004647.3, CDS: 28-1170)

```
   1 gtgctcccgc cccccgggaa tgaatggatg ggcggcctca gcgcccgccc gaccgctggg
  61 aggaccgacc cggcggggac ctgctggggg caggacccgg ggagcaagat ggccactgtc
 121 atccctggcc ccctgagcct aggcgaggac ttctaccgcg aggccatcga gcactgccgc
 181 agttacaacg cgcgcctgtg cgccgagcgc agcctgcgac tgcccttcct cgactcgcag
 241 accggcgtgg cccagaacaa ctgctacatc tggatggaga agacccaccg cgggccgggt
 301 ttggccccgg gacagattta cacgtacccc gcccgctgtt ggaggaagaa acggagactc
 361 aacatcctgg aggaccccag actcaggccc tgcgagtaca agatcgactg tgaagcaccc
 421 ctgaagaagg agggtggcct cccggaaggg ccggtcctcg aggctctact gtgtgcagag
 481 acgggggaga agaagattga gctgaaggag gaggagacca ttatggactg tcagaaacag
 541 cagttgctgg agtttccgca tgacctcgag gtggaagact tggaggatga cattcccagg
 601 aggaagaaca gggccaaagg aaaggcatat ggcatcgggg gtctccggaa acgccaggac
 661 accgcttccc tggaggaccg agacaagccg tatgtctgtg ataagtttta caaagaattg
 721 gcctgggtcc ctgaggcaca aaggaaacac acagccaaga aggcgcccga cggcactgtc
 781 atccccaacg gctactgtga cttctgcctg gggggctcca agaagacggg gtgtcccgag
 841 gacctcatct cctgtgcgga ctgtgggcga tcaggacacc cctcgtgttt acaattcacg
 901 gtgaacatga cggcagccgt gcggacctac cgctggcagt gcatcgagtg caaatcctgc
 961 agcctgtgcg gaacctccga gaacgacggt gccagctggg cgggtctcac cccccaggac
1021 cagctgctgt tttgtgatga ctgcgatcgg ggttaccaca tgtactgcct gagtcccccc
1081 atggcggagc ccccggaagg gagctggagc tgtcacctct gtctccggca cctgaaggaa
1141 aaggcttctg cttacatcac cctcacctag gccggctcgg ctcgccgcga ctctggggtg
1201 gtgctcgcct acctgcctct ccgagctcct caattctccc ccaccctgaa catcccgcag
1261 ggggaggggg agagggggaa gccgagaggg ggctgggcca cccccctcccc tctgtgcaag
1321 tggaatgtct gccctgtggg tgggtgggcc cggccagggc ctctccctcc ctccctccct
1381 ctctgtccct tggcaaatgg acaccagggg cttctcccct caaagccata ccccgcctct
1441 gggcgggcat ggggggtggt gggtgccagc caggggcatg gacagagcct ttttctaaag
1501 aaaaagacaa aaagttaaaa aaaaaaaaaa gaagaaaaga aaagaagtta atatatacaa
```

TABLE 1-continued

```
1561 agagtcctcc aaggcctggc tgggtggagg ggcgctgctg agagtgtcca ccgggcaccc
1621 gcctctgccg gccccccgcc gggcgcccca accccaattt ctggagctgc agccgtcccg
1681 cgccccaccc aaggtgggcg ccttcccctc ttgtgcccag ggcggtgggc gtggtgtcca
1741 cccgcccctc ctggtgccca cggtggatac tgcatgatgt gaaccttggt tttgaactct
1801 gttcctgccc ctccccgacc gccccagcct gtgcccgccc cgtgcctgcc gtggctggtg
1861 ggtggcggtg gtggggccgg gtgggccccc gcccagcgcc tgctggaatg agaagcacag
1921 actccgccac ggactccttt tctctccctc ctcccgcccc gccaggcctg gcggcccccg
1981 ccccccctcgc tggccatttt gggggagtga gggggcgtgg ttgtttcttg tggttgtgtg
2041 tgtttgttgt tcgggtttta aaaaagggaa actgagactg caggtggggg aggtggtggg
2101 ttttgggggg atgtccccta atccaggagt gccccctcac ttgtcaccga gtctcctcta
2161 ttgcctgcct ctgctgtgaa ttaacttgtt ctgtgtatta aactgggcct gacccctctg
2221 cccacgaaaa aaaaaaaaaa aaaaaa
```

SEQ ID NO: 99 Human DPF1 Amino Acid Sequence Isoform B (NP_004638.2)

```
  1 mgglsarpta grtdpagtcw gqdpgskmat vipgplslge dfyreaiehc rsynarlcae
 61 rslrlpflds qtgvaqnncy iwmekthrgp glapgqiyty parcwrkkrr lniledprlr
121 pceykidcea plkkegglpe gpvleallca etgekkielk eeetimdcqk qqllefphdl
181 evedleddip rrknrakgka ygigglrkrq dtasledrdk pyvcdkfyke lawypeagrk
241 htakkapdgt vipngycdfc lggskktgcp edliscadcg rsghpsclqf tvnmtaavrt
301 yrwqciecks cslcgtsend gaswagltpq dqllfcddcd rgyhmyclsp pmaeppegsw
361 schlclrhlk ekasayitlt
```

SEQ ID NO: 100 Human DPF1 cDNA Sequence Variant 3 (NM_001135156.2, CDS: 288-1286)

```
   1 cgcagcccca agaatgaatg aaatcgtagc gcgctgggcg gcagagcggg cggcgcaggc
  61 cgggctgggc ccgcgcgcgg cggcagcggc gccccgggcc ggaggcggcc cagccgagcg
 121 ggccatggcc accgccattc agaacccgct caagtcgcga ggacttctac cgcgaggcca
 181 tcgagcactg ccgcagttac aacgcgcgcc tgtgcgccga gcgcagcctg cgactgccct
 241 tcctcgactc gcagaccggc gtggcccaga acaactgcta catctggatg gagaagaccc
 301 accgcgggcc gggtttggcc ccgggacaga tttacacgta ccccgcccgc tgttggagga
 361 agaaacggag actcaacatc ctggaggacc ccagactcag gccctgcgag tacaagatcg
 421 actgtgaagc acccctgaag aaggagggtg gcctcccgga agggccggtc ctcgaggctc
 481 tactgtgtgc agagacgggg gagaagaaga ttgagctgaa ggaggaggag accattatgg
 541 actgtcagaa acagcagttg ctggagtttc cgcatgacct cgaggtggaa gacttggagg
 601 atgacattcc caggaggaag aacagggcca aaggaaaggc atatggcatc gggggtctcc
 661 ggaaacgcca ggacaccgct tccctggagg accgagacaa gccgtatgtc tgtgatatct
 721 gtgggaaacg gtataagaac cggccggggc tcagctacca ctacacccac acccacctgg
 781 ccgaggagga gggggaggag aacgccgaac gccacgccct gcccttccac cggaaaaaca
 841 accataaaca gttttacaaa gaattggcct gggtccctga ggcacaaagg aaacacacag
 901 ccaagaaggc gcccgacggc actgtcatcc ccaacggcta ctgtgacttc tgcctggggg
 961 gctccaagaa gacggggtgt cccgaggacc tcatctcctg tgcggactgt gggcgatcag
1021 gacacccctc gtgtttacaa ttcacggtga acatgacggc agccgtgcgg acctaccgct
1081 ggcagtgcat cgagtgcaaa tcctgcagcc tgtgcggaac ctccgagaac gacgaccagc
1141 tgctgttttg tgatgactgc gatcggggtt accacatgta ctgcctgagt ccccccatgg
1201 cggagccccc ggaagggagc tggagctgtc acctctgtct ccggcacctg aaggaaaagg
1261 cttctgctta catcaccctc acctaggccg gctcggctcg ccgcgactct ggggtggtgc
1321 tcgcctacct gcctctccga gctcctcaat tctcccccac cctgaacatc ccgcaggggg
1381 agggggagag ggggaagccg agagggggct gggccacccc ctcccctctg tgcaagtgga
1441 atgtctgccc tgtgggtggg tgggcccggc cagggcctct ccctccctcc ctccctctct
1501 gtcccttggc aaatggacac caggggcttc tcccctcaaa gccatacccc gcctctgggc
1561 gggcatgggg ggtggtgggt gccagccagg ggcatggaca gagccttttt ctaaagaaaa
1621 agacaaaaag ttaaaaaaaa aaaaaagaag aaaagaaaag aagttaatat atacaaagag
1681 tcctccaagg cctggctggg tggagggggcg ctgctgagag tgtccaccgg gcacccgcct
1741 ctgccggccc cccgccgggc gccccaaccc caatttctgg agctgcagcc gtcccgcgcc
1801 ccacccaagg tgggcgcctt cccctcttgt gcccagggcg gtgggcgtgg tgtccacccg
1861 cccctcctgg tgcccacggt ggatactgca tgatgtgaac cttggttttg aactctgttc
1921 ctgcccctcc ccgaccgccc cagcctgtgc ccgccccgtg cctgccgtgg ctggtgggtg
1981 gcggtggtgg ggccgggtgg gcccccgccc agcgcctgct ggaatgagaa gcacagactc
2041 cgccacggac tccttttctc tccctcctcc cgccccgcca ggcctggcgg cccccgcccc
2101 cctcgctggc cattttgggg gagtgagggg gcgtggttgt ttcttgtggt tgtgtgtgtt
2161 tgttgttcgg gttttaaaaa agggaaactg agactgcagg tgggggaggt ggtgggtttt
2221 ggggggatgt cccctaatcc aggagtgccc cctcacttgt caccgagtct cctctattgc
2281 ctgcctctgc tgtgaattaa cttgttctgt gtattaaact gggcctgacc cctctgccca
2341 cgaaaaaaaa aaaaaaaaaa aa
```

SEQ ID NO: 101 Human DPF1 Amino Acid Sequence Isoform C (NP_001128628.1)

```
  1 mekthrgpgl apgqiytypa rcwrkkrrin iledprlrpc eykidceapl kkegglpegp
 61 vleallcaet gekkielkee etimdcqkqq llefphdlev edleddiprr knrakgkayg
121 iggrlrkrqdt asledrdkpy vcdicgkryk nrpglsyhyt hthlaeeege enaerhalpf
181 hrknnhkqfy kelawvpeaq rkhtakkapd gtvipngycd fclggskktg cpedliscad
241 cgrsghpscl qftvnmtaav rtyrwqciec kscslcgtse nddqllfcdd cdrgyhmycl
301 sppmaeppeg swschlclrh lkekasayit it
```

SEQ ID NO: 102 Human DPF1 cDNA Sequence Variant 4 (NM_001289978.1, CDS: 28-1302)

```
  1 gtgctcccgc cccccgggaa tgaatggatg ggcggcctca gcgcccgccc gaccgctggg
 61 aggaccgacc cggcggggac ctgctggggg caggacccgg ggagcaagat ggccactgtc
121 atccctggcc ccctgagcct aggcgaggac ttctaccgcg aggccatcga gcactgccgc
181 agttacaacg cgcgcctgtg cgccgagcgc agcctgcgac tgcccttcct cgactcgcag
241 accggcgtgg cccagaacaa ctgctacatc tggatggaga agacccaccg cgggccgggt
```

TABLE 1-continued 301 ttggccccgg gacagattta cacgtacccc gcccgctgtt ggaggaagaa acggagactc
361 aacatcctgg aggaccccag actcaggccc tgcgagtaca agatcgactg tgaagcaccc
421 ctgaagaagg agggtggcct cccggaaggg ccggtcctcg aggctctact gtgtgcagag
481 acgggggaga agaagattga gctgaaggag gaggagacca ttatggactg tcagaaacag
541 cagttgctgg agtttccgca tgacctcgag gtggaagact tggaggatga cattcccagg
601 aggaagaaca gggccaaagg aaaggcatat ggcatcgggg gtctccggaa acgccaggac
661 accgcttccc tggaggaccg agacaagccg tatgtctgtg atatctgtgg gaaacggtat
721 aagaaccggc cggggctcag ctaccactac acccacaccc acctggccga ggaggagggg
781 gaggagaacg ccgaacgcca cgccctgccc ttccaccgga aaaacaacca taaacagttt
841 tacaaagaat tggcctgggt ccctgaggca caaaggaaac acacagccaa gaaggcgccc
901 gacggcactg tcatccccaa cggctactgt gacttctgcc tgggggctc caagaagacg
961 gggtgtcccg aggacctcat ctcctgtgcg gactgtgggc gatcaggaca cccctcgtgt
1021 ttacaattca cggtgaacat gacggcagcc gtgcggacct accgctggca gtgcatcgag
1081 tgcaaatcct gcagcctgtg cggaacctcc gagaacgacg gtgccagctg ggcgggtctc
1141 accccccagg accagctgct gttttgtgat gactgcgatc ggggttacca catgtactgc
1201 ctgagtcccc ccatggcgga gcccccggaa gggagctgga gctgtcacct ctgtctccgg
1261 cacctgaagg aaaaggcttc tgcttacatc accctcacct aggccggctc ggctcgccgc
1321 gactctgggg tggtgctcgc ctacctgcct ctccgagctc ctcaattctc ccccaccctg
1381 aacatcccgc agggggaggg ggagaggggg aagccgagag gggctgggc cacccccctcc
1441 cctctgtgca agtggaatgt ctgccctgtg ggtgggtggg cccggccagg gcctctccct
1501 ccctccctcc ctctctgtcc cttggcaaat ggacaccagg ggcttctccc ctcaaagcca
1561 taccccgcct ctgggcgggc atggggggtg gtgggtgcca gccaggggca tggacagagc
1621 ctttttctaa agaaaaagac aaaaagttaa aaaaaaaaaa aagaagaaaa gaaaagaagt
1681 taatatatac aaagagtcct ccaaggcctg gctgggtgga ggggcgctgc tgagagtgtc
1741 caccgggcac ccgcctctgc cggccccccg ccgggcgccc caaccccaat ttctggagct
1801 gcagccgtcc cgcgccccac ccaaggtggg cgccttcccc tcttgtgccc agggcggtgg
1861 gcgtggtgtc cacccgcccc tcctggtgcc cacggtggat actgcatgat gtgaaccttg
1921 gttttgaact ctgttcctgc ccctccccga ccgccccagc ctgtgcccgc cccgtgcctg
1981 ccgtggctgg tgggtggcgg tggtggggcc gggtgggccc ccgcccagcg cctgctggaa
2041 tgagaagcac agactccgcc acggactcct tttctctccc tcctcccgcc ccgccaggcc
2101 tggcggcccc cgccccccctc gctggccatt ttgggggagt gagggggcgt ggttgtttct
2161 tgtggttgtg tgtgtttgtt gttcgggttt taaaaaaggg aaactgagac tgcaggtggg
2221 ggaggtggtg ggttttgggg ggatgtcccc taatccagga gtgccccctc acttgtcacc
2281 gagtctcctc tattgcctgc ctctgctgtg aattaacttg ttctgtgtat taaactgggc
2341 ctgacccctc tgcccacgaa aaaaaaaaaa aaaaaaaa SEQ ID NO: 103 Human DPF1 Amino Acid Sequence Isoform D (NP_001276907.1)
1 mgglsarpta grtdpagtcw gqdpgskmat vipgplslge dfyreaiehc rsynarlcae
61 rslrlpflds qtgvaqnncy iwmekthrgp glapgqiyty parcwrkkrr lniledprlr
121 pceykidcea plkkegglpe gpvleallca etgekkielk eeetimdcqk qqllefphdl
181 evedleddip rrknrakgka ygigglrkrq dtasledrdk pyvcdicgkr yknrpglsyh
241 yththlaeee geenaerhal pfhrknnhkq fykelawvpe aqrkhtakka pdgtvipngy
301 cdfclggskk tgcpedlisc adcgrsghps clqftvnmta avrtyrwqci eckscslcgt
361 sendgaswag ltpqdqllfc ddcdrgyhmy clsppmaepp egswschlcl rhlkekasay
421 itlt SEQ ID NO: 104 Human DPF1 cDNA Sequence Variant 5 (NM_001363579.1, CDS: 106-1272)
1 gaaatcgtag cgcgctgggc ggcagagcgg gcggcgcagg ccgggctggg cccgcgcgcg
61 gcggcagcgg cgccccgggc cggaggcggc ccagccgagc gggccatggc caccgccatt
121 cagaacccgc tcaagtccct aggcgaggac ttctaccgcg aggccatcga gcactgccgc
181 agttacaacg cgcgcctgtg cgccgagcgc agcctgcgac tgcccttcct cgactcgcag
241 accggcgtgg cccagaacaa ctgctacatc tggatggaga agacccaccg cgggccgggt
301 ttggccccgg gacagattta cacgtacccc gcccgctgtt ggaggaagaa acggagactc
361 aacatcctgg aggaccccag actcaggccc tgcgagtaca agatcgactg tgaagcaccc
421 ctgaagaagg agggtggcct cccggaaggg ccggtcctcg aggctctact gtgtgcagag
481 acgggggaga agaagattga gctgaaggag gaggagacca ttatggactg tcagaaacag
541 cagttgctgg agtttccgca tgacctcgag gtggaagact tggaggatga cattcccagg
601 aggaagaaca gggccaaagg aaaggcatat ggcatcgggg gtctccggaa acgccaggac
661 accgcttccc tggaggaccg agacaagccg tatgtctgtg atatctgtgg gaaacggtat
721 aagaaccggc cggggctcag ctaccactac acccacaccc acctggccga ggaggagggg
781 gaggagaacg ccgaacgcca cgccctgccc ttccaccgga aaaacaacca taaacagttt
841 tacaaagaat tggcctgggt ccctgaggca caaaggaaac acacagccaa gaaggcgccc
901 gacggcactg tcatccccaa cggctactgt gacttctgcc tgggggctc caagaagacg
961 gggtgtcccg aggacctcat ctcctgtgcg gactgtgggc gatcaggaca cccctcgtgt
1021 ttacaattca cggtgaacat gacggcagcc gtgcggacct accgctggca gtgcatcgag
1081 tgcaaatcct gcagcctgtg cggaacctcc gagaacgacg accagctgct gttttgtgat
1141 gactgcgatc ggggttacca catgtactgc ctgagtcccc ccatggcgga gcccccggaa
1201 gggagctgga gctgtcacct ctgtctccgg cacctgaagg aaaaggcttc tgcttacatc
1261 accctcacct aggccggctc ggctcgccgc gactctgggg tggtgctcgc ctacctgcct
1321 ctccgagctc ctcaattctc ccccaccctg aacatcccgc agggggaggg ggagaggggg
1381 aagccgagag gggctgggc cacccccctcc cctctgtgca agtggaatgt ctgccctgtg
1441 ggtgggtggg cccggccagg gcctctccct ccctccctcc ctctctgtcc cttggcaaat
1501 ggacaccagg ggcttctccc ctcaaagcca taccccgcct ctgggcgggc atggggggtg
1561 gtgggtgcca gccaggggca tggacagagc ctttttctaa agaaaaagac aaaaagttaa
1621 aaaaaaaaaa aagaagaaaa gaaaagaagt taatatatac aaagagtcct ccaaggcctg
1681 gctgggtgga ggggcgctgc tgagagtgtc caccgggcac ccgcctctgc cggccccccg
1741 ccgggcgccc caaccccaat ttctggagct gcagccgtcc cgcgccccac ccaaggtggg
1801 cgccttcccc tcttgtgccc agggcggtgg gcgtggtgtc cacccgcccc tcctggtgcc
1861 cacggtggat actgcatgat gtgaaccttg gttttgaact ctgttcctgc ccctccccga TABLE 1-continued

```
1921 ccgccccagc ctgtgcccgc cccgtgcctg ccgtggctgg tgggtggcgg tggtggggcc
1981 gggtgggccc ccgcccagcg cctgctggaa tgagaagcac agactccgcc acggactcct
2041 tttctctccc tcctcccgcc ccgccaggcc tggcggcccc cgccccccctc gctggccatt
2101 ttgggggagt gagggggcgt ggttgtttct tgtggttgtg tgtgtttgtt gttcgggttt
2161 taaaaaaggg aaactgagac tgcaggtggg ggaggtggtg ggttttgggg ggatgtcccc
2221 taatccagga gtgccccctc acttgtcacc gagtctcctc tattgcctgc ctctgctgtg
2281 aattaacttg ttctgtgtat taaactgggc ctgacccctc tgcccacga
```

SEQ ID NO: 105 Human DPF1 Amino Acid Sequence Isoform E (NP_001350508.1)

```
  1 mataiqnplk slgedfyrea iehcrsynar lcaerslrlp fldsqtgvaq nncyiwmekt
 61 hrgpglapgq iytyparcwr kkrriniled prlrpceyki dceaplkkeg glpegpvlea
121 llcaetgekk ielkeeetim dcqkqqllef phdlevedle ddiprrknra kgkaygiggl
181 rkrqdtasle drdkpyvcdi cgkryknrpg lsyhyththl aeeegeenae rhalpfhrkn
241 nhkqfykela wypeagrkht akkapdgtvi pngycdfclg gskktgcped liscadcgrs
301 ghpsclqftv nmtaavrtyr wqcieckscs lcgtsenddq llfcddcdrg yhmyclsppm
361 aeppegswsc hlclrhlkek asayitlt
```

SEQ ID NO: 106 Mouse DPF1 cDNA Sequence (NM_013874.2, CDS: 77-1243)

```
   1 gcaggccggg ctgggcccgc gctcagcggc agcagcagcg gcgccccggg ccggaggcgg
  61 cccagccgag cgggccatgg ccaccgccat tcagaacccg ctcaagtccc ttggcgagga
 121 cttctaccgg gaggccatcg agcactgtcg cagctacaac gcgcgcctgt gtgccgagcg
 181 cagcctgcgc ctgcctttcc tcgactcgca gaccggagtg gcccagaaca actgctacat
 241 ctggatggag aagacccacc gcgggcctgg tttggccccg ggacagatct acacttaccc
 301 cgcccgctgt tggaggaaga aacggagact caacatcctg gaggacccca ggctccggcc
 361 ctgcgagtac aagatcgatt gtgaggcacc tctgaagaag gagggtggcc tcccggaagg
 421 gccagtcctc gaggctctgc tgtgtgctga gactggagag aagaaagtgg agctgaagga
 481 ggaggagacc atcatggact gtcagaaaca gcagttgctg gagtttccgc atgatctcga
 541 ggtagaagac ttggaggaag acattcccag gaggaagaac agggcaagag gaaaggcata
 601 tggcattgga ggtctccgca aacgccagga caccgcatcc ctggaggacc gagacaagcc
 661 gtacgtctgt gatatctgtg ggaagagata taagaaccgg ccaggactca gctaccatta
 721 cacccacacc cacctggctg aggaggaggg ggaggagcac actgaacgcc acgccctgcc
 781 tttccaccgg aaaaacaacc ataaacagtt ttacaaagaa ttggcctggg tccccgaggc
 841 acagaggaaa cacacagcca agaaagcacc agatggcact gtcatcccca atggctactg
 901 tgacttttgc ctgggggggct ccaagaagac tgggtgtccc gaggacctca tctcctgtgc
 961 ggactgtggg cgatcaggac atccctcgtg tttacagttc acggtgaaca tgaccgcggc
1021 tgtgcggacc taccgctggc agtgcattga atgcaagtcc tgcagcctgt gtggcacctc
1081 ggagaatgac gaccagctgc tgttctgtga tgactgcgat cgaggttacc acatgtactg
1141 cctgagccct cccatggcgg agcccccgga agggagctgg agctgccacc tctgtctccg
1201 gcacttgaag gaaaaggcct ctgcttacat caccctgacc taggcccggc tctgcttccc
1261 caggatcttt gggtggtgct atctcctgcc tcttggagct cctggcgctc cccacccggt
1321 gtccccagtg gaagggatgg ggtgaagccc agagtggggg ggggcaaggt gttctccctc
1381 tgcaagtgga atgttaccct gtgggtggct gggtccaaca gggtccctcc tgtcccccct
1441 cttcatccct tgacaaatgg gcaccaggct tctgctctcc tcaaagccat acccccgcct
1501 ttgggcgggc atagaggggt agtggatgct agccagcagc acggaaagag ccttttttcta
1561 aagaaaaaga caaaacgtgg aaaaaaaagg gaaaaaaatt aatatataca aagagtccta
1621 taaagcctgg ctgggtggag aggcactgtt gagtgtctgc tggggacctg actttaccag
1681 tttcctgaat ggcgcctccc cacctcattt ctggagttgc aatggtctca actcccatct
1741 gaggtgggta ccacccccttc ctcagtaccc accgtggata ctgcatgtga actatggttt
1801 tgaactcttc ctcctcctcc ttgagagccc cgccctgcgc ccgcgtggtg cctgcctgcc
1861 aggcctgggg cgtgcagccg gggaggcggg tggggtgagg caggcaggca gccagccccc
1921 tgcagtgaga agcacagatt gcaatggact cagttttttt ttttttttt ttttttttc
1981 ctttctccct tcccacccct ttccttccct acccagccag gctgggctgc ctcctgcccc
2041 cctcgctagc catttggggg tggcaagggg gtgtggttgt ttctcgtggt tgtgtgtgtt
2101 tgttgttcgg gtttttaaaa ggggaaattg agactgcaag tgggggaggt ggagggtctg
2161 ggggagtctg cccccaatcc aggagtaccc cccttgccac caagtctcct ttattgcctg
2221 cctctgctgt gaattaactt gttctgtgta ttaaactggg cctgacccct ctgcccac
```

SEQ ID NO: 107 Mouse DPF1 Amino Acid Sequence (NP_038902.1)

```
  1 mataiqnplk slgedfyrea iehcrsynar lcaerslrlp fldsqtgvaq nncyiwmekt
 61 hrgpglapgq iytyparcwr kkrrlniled prlrpceyki dceaplkkeg glpegpvlea
121 llcaetgekk velkeeetim dcqkqqllef phdlevedle ediprrknra rgkaygiggl
181 rkrqdtasle drdkpyvcdi cgkryknrpg lsyhyththl aeeegeehte rhalpfhrkn
241 nhkqfykela wypeagrkht akkapdgtvi pngycdfclg gskktgcped liscadcgrs
301 ghpsclqftv nmtaavrtyr wqcieckscs lcgtsenddq llfcddcdrg yhmyclsppm
361 aeppegswsc hlclrhlkek asayitlt
```

SEQ ID NO: 108 Human DPF2 cDNA Sequence Variant 1 (NM_006268.4, CDS: 134-1309)

```
  1 agtgctcgct ctagtgcgcg cgcccggacg gcgcctgcgc agagggcaag gaacctggta
 61 ccccggtgcg gtcccggcgc ctgcgcgctg cggactgtgg ggcttctcgg cccgaggcag
121 aggaacaggg aagatggcgg ctgtggtgga gaatgtagtg aagctccttg gggagcagta
181 ctacaaagat gccatggagc agtgccacaa ttacaatgct cgcctctgtg ctgagcgcag
241 cgtgcgcctg cctttcttgg actcacagac cggagtagcc cagagcaatt gttacatctg
301 gatggaaaag cgacaccggg gtccaggatt ggcctccgga cagctgtact cctaccctgc
361 ccggcgctgg cggaaaaagc ggcgagccca tccccctgag gatccacgac tttccttccc
421 atctattaag ccagacacag accagaccct gaagaaggag gggctgatct ctcaggatgg
481 cagtagttta gaggctctgt tgcgcactga ccccctggag aagcgaggtg ccccggatcc
541 ccgagttgat gatgacagcc tgggcgagtt tcctgtgacc aacagtcgag cgcgaaagcg
601 gatcctagaa ccagatgact tcctggatga cctcgatgat gaagactatg aagaagatac
661 tcccaagcgt cggggaaagg ggaaatccaa gggtaagggt gtgggcagtg cccgtaagaa
```

TABLE 1-continued 721 gctggatgct tccatcctgg aggaccggga taagccctat gcctgtgaca tttgtggaaa
781 acgttacaag aaccgaccag gcctcagtta ccactatgcc cactccccact tggctgagga
841 ggagggcgag gacaaggaag actctcaacc acccactcct gtttcccaga ggtctgagga
901 gcagaaatcc aaaaagggtc ctgatggatt ggccttgccc aacaactact gtgacttctg
961 cctgggggac tcaaagatta acaagaagac gggacaaccc gaggagctgg tgtcctgttc
1021 tgactgtggc cgctcagggc atccatcttg cctccaattt acccccgtga tgatggcggc
1081 agtgaagaca taccgctggc agtgcatcga gtgcaaatgt tgcaatatct gcggcacctc
1141 cgagaatgac gaccagttgc tcttctgtga tgactgcgat cgtggctacc acatgtactg
1201 tctcaccccg tccatgtctg agccccctga aggaagttgg agctgccacc tgtgtctgga
1261 cctgttgaaa gagaaagctt ccatctacca gaaccagaac tcctcttgat gtggccaccc
1321 acctgctccc cgacatatct aaggctgttt ctctcctcca cttcatattt catacccatc
1381 tttcccttct tcctcctctc cttcacaaat ccagagaacc ttggggtggt tgtgccagcc
1441 tgcctttggc agctgcaagc tgaggtggca gctctgacca cctctggccc caggccctca
1501 gggagaaagg agcaacacac tgcccctagg cgtgcgtgtg gcccagtttc tctctgctct
1561 ccattaagtg cattcactct gcttgccttg ggcccagccc ctggtgatca cagggttcaa
1621 acagtgtcct cctagaaaga gtgggagagc agctcacttc tctgtgttct gcctcccctc
1681 tggtctccag agttttcctg tcctctagag gcaagccagg ccagggagct gggagcgagc
1741 aagctgaggc cacgtccaca aggagctttt catgcccctg tgccgcatag cctcacctct
1801 ttcctccaga gtggctctct gcggccctgt gttcctgcta cagagtgttc ttttctggag
1861 tcaggatgtt ctcggtcacc ctcctggttc tgccctgtcc cattccaccc caccccaggg
1921 ggaacagtag cttcaccttg ttattcccat tgctctcctg gctcactctt acggtcggtc
1981 tccagtgact gaagcattcc ccacccttgg aatttctcat cttctgcctc ccttcctact
2041 ccttttggtt ttgtggggag aggggaagga tcaggggggcc aggccagcag ctcgggggcc
2101 acaaggagat ggataatgtg cctgtttttt aacacaacaa aaaagcctac ctccaaaatc
2161 ccctttttgt tcttcctgga cctgggcatt cagcctcctg ctcttaactg aattgggagc
2221 ctctgccacc tgccccgtgt atcctggctc tcagctcatg ggaagccac atagacatcc
2281 ctttcttccc ttgcacgctc gctagcagct ggtaaggtct tcacaccctg attcctcaag
2341 ttttctgctt agtggcactg acattaagta gtgggggggac agtccatgcc aggacaccct
2401 ggagtagcct tccccccttgg ccgtgggcag gccctaactc actgtcgctt tggagttgag
2461 gtgtcttttt tttttctttc tttagttcct gtattctaaa cattagtaaa aataaatgtt
2521 tttacacaga aaaaaaaaaa aaaaa SEQ ID NO: 109 Human DPF2 Amino Acid Sequence Isoform 1 (NP_006259.1)

1 maavvenvvk llgeqyykda meqchnynar lcaersvrlp fldsqtgvaq sncyiwmekr
61 hrgpglasgq lysyparrwr kkrrahpped prlsfpsikp dtdqtlkkeg lisqdgssle
121 allrtdplek rgapdprvdd dslgefpvtn srarkrilep ddflddldde dyeedtpkrr
181 gkgkskgkgv gsarkkldas iledrdkpya cdicgkrykn rpglsyhyah shlaeeeged
241 kedsqpptpv sqrseeqksk kgpdglalpn nycdfclgds kinkktgqpe elvscsdcgr
301 sghpsclqft pvmmaavkty rwqcieckcc nicgtsendd qllfcddcdr gyhmycltps
361 mseppegsws chlcldllke kasiyqnqns s SEQ ID NO: 110 Human DPF2 cDNA Sequence Variant 2 (NM_001330308.1, CDS: 134-1351)

1 agtgctcgct ctagtgcgcg cgcccggacg gcgcctgcgc agagggcaag gaacctggta
61 ccccggtgcg gtcccggcgc ctgcgcgctg cggactgtgg ggcttctcgg cccgaggcag
121 aggaacaggg aagatggcgg ctgtggtgga gaatgtagtg aagctccttg gggagcagta
181 ctacaaagat gccatggagc agtgccacaa ttacaatgct cgcctctgtg ctgagcgcag
241 cgtgcgcctg cctttcttgg actcacagac cggagtagcc cagagcaatt gttacatctg
301 gatggaaaag cgacaccggg gtccaggatt ggcctccgga cagctgtact cctaccctgc
361 ccggcgctgg cggaaaaagc ggcgagccca tccccctgag gatccacgac tttccttccc
421 atctattaag ccagacacag accagaccct gaagaaggag gggctgatct ctcaggatgg
481 cagtagttta gaggctctgt tgcgcactga ccccctggag aagcgaggtg ccccggatcc
541 ccgagttgat gatgacagcc tgggcgagtt tcctgtgacc aacagtcgag cgcgaaagcg
601 gatcctagaa ccagatgact tcctggatga cctcgatgat gaagactatg aagaagatac
661 tcccaagcgt cggggaaagg ggaaatccaa gggtaagggt gtgggcagtg cccgtaagaa
721 gctggatgct tccatcctgg aggaccggga taagccctat gcctgtgaca atagtttcaa
781 acaaaagcat acctcgaaag cgccccagag agtttgtgga aaacgttaca agaaccgacc
841 aggcctcagt taccactatg cccactccca cttggctgag gaggagggcg aggacaagga
901 agactctcaa ccacccactc ctgtttccca gaggtctgag gagcagaaat ccaaaaaggg
961 tcctgatgga ttggccttgc ccaacaacta ctgtgacttc tgcctggggg actcaaagat
1021 taacaagaag acgggacaac ccgaggagct ggtgtcctgt tctgactgtg gccgctcagg
1081 gcatccatct tgcctccaat ttacccccgt gatgatggcg gcagtgaaga cataccgctg
1141 gcagtgcatc gagtgcaaat gttgcaatat ctgcggcacc tccgagaatg acgaccagtt
1201 gctcttctgt gatgactgcg atcgtggcta ccacatgtac tgtctcaccc cgtccatgtc
1261 tgagccccct gaaggaagtt ggagctgcca cctgtgtctg gacctgttga aagagaaagc
1321 ttccatctac cagaaccaga actcctcttg atgtggccac ccacctgctc cccgacatat
1381 ctaaggctgt ttctctcctc cacttcatat ttcataccca tctttccctt cttcctcctc
1441 tccttcacaa atccagagaa ccttggggtg gttgtgccag cctgcctttg gcagctgcaa
1501 gctgaggtgg cagctctgac cacctctggc cccaggccct cagggagaaa ggagcaacac
1561 actgccccta ggcgtgcgtg tggcccagtt tctctctgct ctccattaag tgcattcact
1621 ctgcttgcct tgggcccagc ccctggtgat cacagggttc aaacagtgtc ctcctagaaa
1681 gagtgggaga gcagctcact tctctgtgtt ctgcctcccc tctggtctcc agagttttcc
1741 tgtcctctag aggcaagcca ggccagggag ctgggagcga gcaagctgag gccacgtcca
1801 caaggagctt ttcatgcccc tgtgccgcat agcctcacct ctttcctcca gagtggctct
1861 ctgcggccct gtgttcctgc tacagagtgt tcttttctgg agtcaggatg ttctcggtca
1921 ccctcctggt tctgccctgt cccattccac cccaccccag gggaacagt agcttcacct
1981 tgttattccc attgctctcc tggctcactc ttacggtcgg tctccagtga ctgaagcatt
2041 ccccaccctt ggaatttctc atcttctgcc tcccttccta ctccttttgg ttttgtgggg
2101 agaggggaag gatcaggggg ccaggccagc agctcggggg ccacaaggag atggataatg
2161 tgcctgtttt ttaacacaac aaaaaagcct acctccaaaa tccccttttt gttcttcctg TABLE 1-continued

```
2221 gacctgggca ttcagcctcc tgctcttaac tgaattggga gcctctgcca cctgccccgt
2281 gtatcctggc tctcagctca tggggaagcc acatagacat ccctttcttc ccttgcacgc
2341 tcgctagcag ctggtaaggt cttcacaccc tgattcctca agttttctgc ttagtggcac
2401 tgacattaag tagtgggggg acagtccatg ccaggacacc ctggagtagc cttcccccctt
2461 ggccgtgggc aggccctaac tcactgtcgc tttggagttg aggtgtcttt ttttttttctt
2521 tctttagttc ctgtattcta aacattagta aaaataaatg tttttacaca gagccctctg
2581 ctggatggtt tatctcctgc ctttctccat taagaaggcc atttcatcct aagatttcca
2641 tgatggtggt tttttttttt aatgttttga aatacagctt ttttcccccc aaattaaaat
2701 tttttgtgg aaccccaata tgtaaagcga atataaaatt ggttattttg ttttgttaca
2761 taaattcaag tttataacaa ttctttgtta taaagaacaa tgaagctgtt ttgatcaata
2821 caaaatttgg gttaaaatca actttaacat ctatttttat gtttcagttg atttggagaa
2881 ttctcctagt cttggataca tagatggaag tgatgacagg tttataacag ttgaccttgc
2941 aatctcagac atttaaaaca ggaccagaag tttatataaa tataattaat aagcaaacta
3001 atgacatcac catgggacac acacaaaagt tcttgcagga gcagggtctg tgtggcttca
3061 gttgcctgca gcgctcccag gccagagcaa gtgctctagg atctgaactg cccgcagtgc
3121 agccctgcag cctttcccag ggcacgttga tgtgcacaca gtttccctga aggcaaagtg
3181 aacatgtgga gagcttacgt ggcagcgcgt atgtcttcag tgtgtgtttt agaagtccaa
3241 ctgttgtttt tatgttttta aaggaaagat ttgaatcaag cagttatggg ccccctgaag
3301 tatccttttt tctagaacat tctgaaagtc atccttgcct atgggaagcc taggccggcc
3361 tgcactgtta tgttcaataa ataagcaggg tgctctgggc tggggattgt gtgaggagca
3421 gagcgcagcc cgtcctcatg cttttccact gaagtaggcc aggcagagag ggagtacagc
3481 aatggatgcg ctttggcagc tgagtagtcc gagagccaga aaagaaatgt ggaaaataag
3541 aacgctgtag caggcctagg tgaggaaatt taggaagggt ttgcgggagg taggatttga
3601 gatgggtctt ggagagttgg acagtgtcag ccggtaggac gggggtgcgg acggaagcct
3661 gtgaggaagg cagaggatgc ggagctgtga gcggagggag cagcgaggct ggagagcagc
3721 tgggctgcgg gtcaagacgt ctgcgtttaa ttcgggactg aaggttagca gggaagggaa
3781 cgatgccaga tcttgagttt aagaacttga atcttgtaaa gtaccaaatc taataaaata
3841 ctcgtcctaa ataaaaaaaa aaaaaaaaaa aaaaaaaaaa aaaaaaaaaa aaaaaaa
```

SEQ ID NO: 111 Human DPF2 Amino Acid Sequence Isoform 2 (NP_001317237.1)

```
  1 maavvenvvk llgeqyykda meqchnynar lcaersvrlp fldsqtgvaq sncyiwmekr
 61 hrgpglasgq lysyparrwr kkrrahpped prlsfpsikp dtdqtlkkeg lisqdgssle
121 allrtdplek rgapdprvdd dslgefpvtn srarkrilep ddflddldde dyeedtpkrr
181 gkgkskgkgv gsarkkldas iledrdkpya cdnsfkqkht skapqrvcgk ryknrpglsy
241 hyahshlaee egedkedsqp ptpvsqrsee qkskkgpdgl alpnnycdfc lgdskinkkt
301 gqpeelvscs dcgrsghpsc lqftpvmmaa vktyrwqcie ckccnicgts enddqllfcd
361 dcdrgyhmyc ltpsmseppe gswschlcld llkekasiyq nqnss
```

SEQ ID NO: 112 Mouse DPF2 cDNA Sequence Variant 1 (NM_001291078.1, CDS: 100-1317)

```
   1 cctgcgcaga gggtcgagga ccctgtgtcc tgagaaggct tagcgcctgc gcgttgtagg
  61 tttcggggcc tcccggcctg agggagagga acagggaaga tggcggctgt ggtggagaat
 121 gtagtgaagc tccttggcga gcaatactac aaagatgcca tggaacagtg ccacaattat
 181 aacgcccgcc tctgtgctga acgtagtgtg cgcctgcctt tcctggactc acagactgga
 241 gtagcccaga gcaattgtta tatctggatg gaaaagcgac accggggacc aggattggcc
 301 tctggacagt tatactccta tcctgccaga cgctggcgga aaaagcgccg agcccaccca
 361 cctgaggatc ccaggctttc tttcccatcg attaaaccag acactgacca gactctgaag
 421 aaagaggggc ttatctctca ggatggcagc agtttagagg ctctgttgcg tactgatccc
 481 ctggagaaac ggggtgcccc agatccccga gttgacgatg acagcctggg cgagtttcct
 541 gttagcaaca gtcgagcacg gaagcggatc attgaacccg atgacttcct tgatgacctt
 601 gatgatgagg actatgaaga agatacgcca aagcgtcggg ggaaggggaa gtccaagagt
 661 aagggtgtga gcagtgcccg gaagaagctg gatgcttcca tcctggagga ccgggataag
 721 ccctatgcct gtgacaatag tttcaaacaa aagcatacct cgaaagcgcc ccagagagtt
 781 tgtggaaaac gttacaagaa ccgacctggc ctcagttacc actatgccca ctcccacctg
 841 gctgaagagg aaggagagga caaagaagac tcccgacccc ccactcctgt gtcccagagg
 901 tctgaggagc agaaatccaa gaaaggacct gatggattgg ccctgcctaa caactactgt
 961 gacttctgcc taggagactc aaaaatcaac aagaagacag ggcagcccga ggagctagtg
1021 tcctgttccg actgtggccg ctcagggcat ccgtcctgcc tgcagttcac ccctgtgatg
1081 atggcggccg tgaagaccta ccgctggcag tgcatcgaat gcaagtgctg caacctctgc
1141 ggcacgtcgg agaacgatga ccagctactt ttctgtgatg actgtgaccg tggctaccac
1201 atgtactgtc tcactccttc catgtctgag cctcctgaag gaagttggag ttgccacctg
1261 tgtctggatc tgctgaagga gaaagcatcc atctaccaga accagaactc ctcctgatgt
1321 gccacccagc tcccctgcat ctaaggccgt tgctctcctc tctaccttgg tttccattgc
1381 ccctctctcc tctttcactc tgtagtcctg ccaacctccg ttggcaacag cacagggagg
1441 tggcagctct gactgcctct agccccgagc cctcagggag taaggagcag cgtgctgctc
1501 cagggctgac ctgtgggtcc aacttctctc tgctctccaa gaagtgcatt cactctgcct
1561 gccttgggcc taagaccctg gtgattacag ggctcaaatg gggtcctctg agaaggaata
1621 tgagagcagc tcacttgtct caagccttgc ccacccctct tcccccaaac cccctttggt
1681 ttccagggtt ttgccccaga gatgagccag gctgggcctt tcctggaagc agctggagtg
1741 agctggctga gtggcacttg ccaggacctt ttcataccct agttctgctt ccctttgcct
1801 cctgccaaag cagtcccctg tcctctgtca tgctacatgg ggttctgtgc ttgagctaga
1861 atgttctcgg gcacctcctg gctctgccct gtcccacaaa gggacgagca gcttcaaacc
1921 tgtcctccct gtgcttggtg gcttgctcac aggtgcgctc tggctaccca gacatttcct
1981 atcctcagaa cttcccatct tctgccccca tccttagtcc ctttgctttt gtagggagag
2041 ggatagtgtc aggggctggg ccagcagctt gggggccaca gggagaagtt ggataatgtg
2101 cctgtttttt aactcgataa aaaagcctac ctccaaaatt cccttttttgt tcttcctgaa
2161 cctgggcatt cagcctcctg tccttaacta aattaggagc ctctgcctcc tgcctgtgta
2221 tcctggctcc caggacacag gatggtcccc tttccttgca cgctagctag tagctggtaa
2281 ggtcttcaca ccctgagttt tctgtttcct gcttagtggc actgacatta agtaggaggg
2341 gacagtcctc tgcagtactc tagagagtgg gcttcccccct tggctgtggg caggccctaa
```

TABLE 1-continued

```
2401 ctgttttctg caaagttgag ggcccccccct cgcatattta gttcctgtat tcaaaacatt
2461 agtaaaaata aacattttta cagagtcttc tgctggacag tttgtctctt gactccttgt
2521 tgaaaggttg tttcatttca aacttacgac aatagggttt tttgttggtg gtggttggtt
2581 gttttaaatt gaaacaactt tttctcccaa aatcaaagtt tttgttaaac tccaccatgt
2641 aaaattattt tgttagtttt gttatgtaaa ttcagattta taacaattta gtggtataaa
2701 ggatgaagct aattaataca aaaattgggt taaaatcaac tttagcattt tctctgtatc
2761 tgtgcttttg gctggttgga aagactttac tcggtgtgaa tatgtaggcg gaggtgcggc
2821 agatctatgg cactgcagtg tctcctggtt aaagtgaacc cagaagcttg tttgtgcttt
2881 aaactccaag gagttatgag ttaagcctgg agagagagcg cagcagagga gaggatgctc
2941 gttgttcttg cagagggcca agtttggttc ccagcactca aatccggtgg ctcacaacca
3001 cctgtagctc cagctccagg agctggggag gtcaactgtg ctcctgcaaa cacccacctg
3061 cccactcatc ttcatccatc tacaaaccta ccagtgtcat cgtagaacaa aagaagccga
3121 gaggagagta acctcagatc ctgtcatctg atgaaccttt tcattgcctg tcggattgct
3181 aagccaaagc agagttgcaa agccagaatt gtccacagtg cagggtgtca tgtgcagacc
3241 gtgagtgagt ttatatccag ccagattagt acttggatgt tatatagtgg atcttgtata
3301 gctcacttgg tatgtattaa cattttaact tttttctttt aaagatttat ttattt
```

SEQ ID NO: 113 Mouse DPF2 Amino Acid Sequence Isoform 1 (NP_001278007.1)

```
  1 maavvenvvk llgeqyykda meqchnynar lcaersvrlp fldsqtgvaq sncyiwmekr
 61 hrgpglasgq lysyparrwr kkrrahpped prlsfpsikp dtdqtlkkeg lisqdgssle
121 allrtdplek rgapdprvdd dslgefpvsn srarkriiep ddflddldde dyeedtpkrr
181 gkgkskskgv ssarkkldas iledrdkpya cdnsfkqkht skapqrvcgk ryknrpglsy
241 hyahshlaee egedkedsrp ptpvsqrsee qkskkgpdgl alpnnycdfc lgdskinkkt
301 gqpeelvscs dcgrsghpsc lqftpvmmaa vktyrwqcie ckccnlcgts enddqllfcd
361 dcdrgyhmyc ltpsmseppe gswschlcld llkekasiyq nqnss
```

SEQ ID NO: 114 Mouse DPF2 cDNA Sequence Variant 2 (NM_011262.5, CDS: 100-1275)

```
   1 cctgcgcaga gggtcgagga ccctgtgtcc tgagaaggct tagcgcctgc gcgttgtagg
  61 tttcggggcc tcccggcctg agggagagga acagggaaga tggcggctgt ggtggagaat
 121 gtagtgaagc tccttggcga gcaatactac aaagatgcca tggaacagtg ccacaattat
 181 aacgcccgcc tctgtgctga acgtagtgtg cgcctgcctt tcctggactc acagactgga
 241 gtagcccaga gcaattgtta tatctggatg gaaaagcgac accggggacc aggattggcc
 301 tctggacagt tatactccta tcctgccaga cgctggcgga aaaagcgccg agcccaccca
 361 cctgaggatc ccaggctttc tttcccatcg attaaaccag acactgacca gactctgaag
 421 aaagaggggc ttatctctca ggatggcagc agtttagagg ctctgttgcg tactgatccc
 481 ctggagaaac ggggtgcccc agatccccga gttgacgatg acagcctggg cgagtttcct
 541 gttagcaaca gtcgagcacg gaagcggatc attgaacccg atgacttcct tgatgacctt
 601 gatgatgagg actatgaaga agatacgcca aagcgtcggg ggaaggggaa gtccaagagt
 661 aagggtgtga gcagtgcccg gaagaagctg gatgcttcca tcctggagga ccgggataag
 721 ccctatgcct gtgacatttg tggaaaaacgt tacaagaacc gacctggcct cagttaccac
 781 tatgcccact cccacctggc tgaagaggaa ggagaggaca aagaagactc ccgacccccc
 841 actcctgtgt cccagaggtc tgaggagcag aaatccaaga aaggacctga tggattggcc
 901 ctgcctaaca actactgtga cttctgccta ggagactcaa aaatcaacaa gaagacaggg
 961 cagcccgagg agctagtgtc ctgttccgac tgtggccgct cagggcatcc gtcctgcctg
1021 cagttcaccc ctgtgatgat ggcggccgtg aagacctacc gctggcagtg catcgaatgc
1081 aagtgctgca acctctgcgg cacgtcggag aacgatgacc agctactttt ctgtgatgac
1141 tgtgaccgtg gctaccacat gtactgtctc actccttcca tgtctgagcc tcctgaagga
1201 agttggagtt gccacctgtg tctggatctg ctgaaggaga aagcatccat ctaccagaac
1261 cagaactcct cctgatgtgc cacccagctc ccctgcatct aaggccgttg ctctcctctc
1321 taccttggtt tccattgccc ctctctcctc tttcactctg tagtcctgcc aacctccgtt
1381 ggcaacagca cagggaggtg gcagctctga ctgcctctag ccccgagccc tcagggagta
1441 aggagcagcg tgctgctcca gggctgacct gtgggtccaa cttctctctg ctctccaaga
1501 agtgcattca ctctgcctgc cttgggccta agaccctggt gattacaggg ctcaaatggg
1561 gtcctctgag aaggaatatg agagcagctc acttgtctca agccttgccc acccctcttc
1621 ccccaaaccc cctttggttt ccagggtttt gccccagaga tgagccaggc tgggcctttc
1681 ctggaagcag ctggagtgag ctggctgagt ggcacttgcc aggacctttt catacccctag
1741 ttctgcttcc ctttgcctcc tgccaaagca gtcccctgtc ctctgtcatg ctacatgggg
1801 ttctgtgctt gagctagaat gttctcgggc acctcctggc tctgccctgt cccacaaagg
1861 gacgagcagc ttcaaacctg tcctccctgt gcttggtggc ttgctcacag gtgcgctctg
1921 gctacccaga catttcctat cctcagaact tcccatcttc tgccccccatc cttagtccct
1981 ttgcttttgt agggagaggg atagtgtcag gggctgggcc agcagcttgg gggccacagg
2041 gagaagttgg ataatgtgcc tgttttttaa ctcgataaaa aagcctacct ccaaaattcc
2101 ctttttgttc ttcctgaacc tgggcattca gcctcctgtc cttaactaaa ttaggagcct
2161 ctgcctcctg cctgtgtatc ctggctccca ggacacagga tggtcccctt tccttgcacg
2221 ctagctagta gctggtaagg tcttcacacc ctgagtttc tgtttcctgc ttagtggcac
2281 tgacattaag taggagggga cagtcctctg cagtactcta gagagtgggc ttccccccttg
2341 gctgtgggca ggccctaact gttttctgca aagttgaggg ccccccctcg catatttagt
2401 tcctgtattc aaaacattag taaaaataaa catttttaca gagtcttctg ctggacagtt
2461 tgtctcttga ctccttgttg aaaggttgtt tcatttcaaa cttacgacaa tagggttttt
2521 tgttggtggt ggttggttgt tttaaattga aacaactttt tctcccaaaa tcaaagtttt
2581 tgttaaactc caccatgtaa aattattttg ttagttttgt tatgtaaatt cagatttata
2641 acaatttagt ggtataaagg atgaagctaa ttaatacaaa aattgggtta aaatcaactt
2701 tagcattttc tctgtatctg tgcttttggc tggttggaaa gactttactc ggtgtgaata
2761 tgtaggcgga ggtgcggcag atctatggca ctgcagtgtc tcctggttaa agtgaaccca
2821 gaagcttgtt tgtgctttaa actccaagga gttatgagtt aagcctggag agagagcgca
2881 gcagaggaga ggatgctcgt tgttcttgca gagggccaag tttggttccc agcactcaaa
2941 tccggtggct cacaaccacc tgtagctcca gctccaggag ctggggaggt caactgtgct
3001 cctgcaaaca cccacctgcc cactcatctt catccatcta caaacctacc agtgtcatcg
3061 tagaacaaaa gaagccgaga ggagagtaac ctcagatcct gtcatctgat gaacctttc
```

TABLE 1-continued

```
3121 attgcctgtc ggattgctaa gccaaagcag agttgcaaag ccagaattgt ccacagtgca
3181 gggtgtcatg tgcagaccgt gagtgagttt atatccagcc agattagtac ttggatgtta
3241 tatagtggat cttgtatagc tcacttggta tgtattaaca ttttaacttt tttcttttaa
3301 agatttattt attt

SEQ ID NO: 115 Mouse DPF2 Amino Acid Sequence Isoform 2 (NP_035392.1)
   1 maavvenvvk llgeqyykda meqchnynar lcaersvrlp fldsqtgvaq sncyiwmekr
  61 hrgpglasgq lysyparrwr kkrrahpped prlsfpsikp dtdqtlkkeg lisqdgssle
 121 allrtdplek rgapdprvdd dslgefpvsn srarkriiep ddflddldde dyeedtpkrr
 181 gkgkskskgv ssarkkldas iledrdkpya cdicgkrykn rpglsyhyah shlaeeeged
 241 kedsrpptpv sqrseeqksk kgpdglalpn nycdfclgds kinkktgqpe elvscsdcgr
 301 sghpsclqft pvmmaavkty rwqcieckcc nlcgtsendd qllfcddcdr gyhmycltps
 361 mseppegsws chlcldllke kasiyqnqns s

SEQ ID NO: 116 Human DPF3 cDNA Sequence Variant 1 (NM_012074.4,
CDS: 29-1102)
   1 agacaatatt ctgttacatt gtagcaaaat ggcgactgtc attcacaacc ccctgaaagc
  61 gctcggggac cagttctaca aggaagccat tgagcactgc cggagttaca actcacggct
 121 gtgtgcagag cgcagcgtgc gtcttccctt cctggactca cagactgggg tggcccagaa
 181 caactgctac atctggatgg agaagaggca ccgaggccca ggccttgccc cgggccagct
 241 gtatacatac cctgcccgct gctggcgcaa gaagagacga ttgcacccac ctgaagatcc
 301 aaaactgcgg ctgctggaga taaaacctga agtggagctt cccctgaaga aggatgggtt
 361 cacctcagag agcaccacgc tggaagcctt gctccgtggc gagggggttg agaagaaggt
 421 ggatgccagg gaggaggaaa gcatccagga aatacagagg gttttggaaa atgatgaaaa
 481 tgtagaagaa gggaatgaag aagaggattt ggaagaggat attcccaagc gaaagaacag
 541 gactagagga cgggctcgcg gctctgcagg gggcaggagg aggcacgacg ccgcctctca
 601 ggaagaccac gacaaacctt acgtctgtga catctgtggc aagcgctaca agaaccgacc
 661 ggggctcagc taccactatg ctcacactca cctggccagc gaggaggggg atgaagctca
 721 agaccaggag actcggtccc cacccaacca cagaaatgag aaccacaggc cccagaaagg
 781 accggatgga acagtcattc ccaataacta ctgtgacttc tgcttggggg gctccaacat
 841 gaacaagaag agtgggcggc ctgaagagct ggtgtcctgc gcagactgtg gacgctctgc
 901 tcatttggga ggagaaggca ggaaggagaa ggaggcagcg gccgcagcac gtaccacgga
 961 ggacttattc ggttccacgt cagaaagtga cacgtcaact ttccacggct ttgatgagga
1021 cgatttggaa gagcctcgct cctgtcgagg acgccgcagt ggccggggtt cgcccacagc
1081 agataaaaag ggcagttgct aaacccacgg aacagactct ctgggcaatt agccatcccc
1141 ctctgacttt ggtcattgtg ctggttctga tatatatttt ttttaatgaa aggcaacttt
1201 agattttccc tctatccttg cttttttttcc cttcacctcc cacgtgtccc tccatccctc
1261 cccccacccc tctgttttgg gtatgtacaa cagaagcaca aactactgaa acaaaacaaa
1321 acagcagaat gagcgttctt ccgagagatg gcatcgtgat gcgctattta ttttccatag
1381 aaataggaag ttagacggat tgtctctttt ctgaggggag ggggtctttt tgacaggagc
1441 agagttgatg tcctcaattt tcatatttat tggcaaaagg aagagaagag gaactttggg
1501 ttggaaacaa agaaccaata acattaaaac attattattt atatattcta gctgttatta
1561 gaatcagact ttttttgcga gagagagaga gagagagaga gaagggaaat caaagaaatc
1621 gaagcaatat cctgtttaga ggcaagccgc ccggtgggga gaatttcctc aatgggagac
1681 ggttgcacta ttctgtgccc cacggagttt gcggctcccc gcggcagacc cctccctcat
1741 tctcctccct gacctttcca tcttcctctc tgcttgcgag aaaatgtcag tagttccaga
1801 gaagtcgggg tgcctatgcc tggcctccct ccacacctgg gccctgacca gccgcctcct
1861 gggctcctcc tcctccgtca gtagagctgc tgttttgtta ttgctggttt ttcctcactt
1921 tcctcctggc aaagaacgac ttccaaatgc agggatggaa tataagcaga acgtcatggg
1981 ctcagcagtg actccaccac ccgaggccga ggccgtgctt ctggaagata gaaggagaca
2041 tcatcgtgtg tttcccctcc ccttgcccct gttaagaaac gtatcaatac ccattggatg
2101 atcaaggcta ccgtatttct tctatttttt tttatagtgc ctgccaggca ctttgtttta
2161 tgtttccaat agcacttcct gaaataaacc aaagcaacac tgctcaaggc ccctggggcg
2221 atggagaagg ccacccacct cactgacagt cccaagaatg accggctgcg aggtcctagt
2281 caaaagtcaa cattatgacc tggggactcc agcatccttc aagcaagcca tttccgaaga
2341 aggtgaaaag aagccaggat gattggcacc tcctcctcct cctcctcttc ttcctcttcc
2401 cttgcccagc cccctcctgt gcgtgtgttt cagacaacac aggagccagc acaggagtgg
2461 aaaatcctgc agcgcaactc agctcagccc acagaagcct tgggaatggc ctcagtttgt
2521 gcaataagaa gatttttttt ttctttttaa atcttcatta tattttcttt gattgtctgt
2581 gagaaagtac ccaggtccgc ctggaattac tctacagtag aaataactga acacaaacaa
2641 actgatggaa aaaaagagtt aactatttta tttatttcaa tatttaaaag gaaaaaagtg
2701 ctgacatggc acagtatttt tgtttaaagt acctcctact tcaaaagtta agcgcaattt
2761 tgtgaagaca tgaaatcata agagtactta atgtaaaata aaagactgca tattaactct
2821 aaagaaaaat gccccacatt ttaaataaga aaataaagat caactctgct ctctcaggct
2881 ttttaaaaag ccattcatgt atgtgcttta ggtattttta tttctgcgag ttggatgtgg
2941 taagtgagga gtgctcagtt tttttttcct ccttcaaaag tctattgaaa gtgttggtga
3001 tgttaaatga ttgtgtgtta agatttgact gaaataactt agccacaaat cagcagtttc
3061 ccccaccctc attgcccccct caccccaggc aagccccttt tatctgaatg tcagaagcag
3121 cctgcctcct agttatcatg tctgatgagg tctagctcag gaaggaattc catctattga
3181 tggaatatat cccctcaagt tcaatagatt cgaacacaga gagctttgtt taaaataatg
3241 cagcaaaaaa aaaaaaaaaa aaaaagcaaa aataaaagca tcagctgagg tgatattagt
3301 tcagtcacct aacaactcct agaagagatg aggaaaggga accttctgct gagctggctt
3361 ctggggcctg agcttccaga gctgtcccca agggctagga aggccgacct gaaggatgag
3421 aacctcaaat tcagttgctg gtgggagcca aggaagacgg cgggtgttct aacatggccc
3481 tttctggctg agctggcgga agtgggcgtt ttggccgatg ggatgtatct cggcgctgtg
3541 tctgtggccc agcaaaggtg cagggctgac tggctgagcc actgggttct acccgcaggc
3601 tccccactgc actgggcttt cacacagcca tgctcttggg tttccctccc ttgtaagcag
3661 agtcataata acacacgaat agtctaaggc tgggtattct ggtcagcaga ggtccttgag
3721 tcacagtgtt actgaaatgg ttctgagcct gagaatctct ttggcctctg aaagggcagg
3781 gcaggtgggc accgacttcc tgccagtcct ttcaggtttc ctgttcaaag ccagtcctgt
```

TABLE 1-continued

```
3841 tggtggaggg gatcaccgag agtgtctgta tcattttgta gcccttttct ctgacgtttt
3901 ctggtagaaa atgtcccttg tcaaaatgct aataattatc ataataatct gctttccaac
3961 caactcccac aagtgacaac ctgtgtagaa ctgtgataaa ggtttgcata atgtagggtt
4021 tgtaccaagt gtgtgtaagt ttctgttaaa taaaaagtct gtttccaatg ctcctat
```

SEQ ID NO: 117 Human DPF3 Amino Acid Sequence Isoform 1 (NP_036206.3.)

```
  1 matvihnplk algdqfykea iehcrsynsr lcaersvrlp fldsqtgvaq nncyiwmekr
 61 hrgpglapgq lytyparcwr kkrrlhpped pklrlleikp evelplkkdg ftsesttlea
121 llrgegvekk vdareeesiq eiqrvlende nveegneeed leedipkrkn rtrgrargsa
181 ggrrrhdaas qedhdkpyvc dicgkryknr pglsyhyaht hlaseegdea qdgetrsppn
241 hrnenhrpqk gpdgtvipnn ycdfclggsn mnkksgrpee lvscadcgrs ahlggegrke
301 keaaaaartt edlfgstses dtstfhgfde ddleeprscr grrsgrgspt adkkgsc
```

SEQ ID NO: 118 Human DPF3 cDNA Sequence Variant 2 (NM_001280542.1, CDS: 29-1165)

```
   1 agacaatatt ctgttacatt gtagcaaaat ggcgactgtc attcacaacc ccctgaaagc
  61 gctcggggac cagttctaca aggaagccat tgagcactgc cggagttaca actcacggct
 121 gtgtgcagag cgcagcgtgc gtcttccctt cctggactca cagactgggg tggcccagaa
 181 caactgctac atctggatgg agaagaggca ccgaggccca ggccttgccc cgggccagct
 241 gtatacatac cctgcccgct gctggcgcaa gaagagacga ttgcacccac ctgaagatcc
 301 aaaactgcgg ctgctggaga taaaacctga agtggagctt cccctgaaga aggatgggtt
 361 cacctcagag agcaccacgc tggaagcctt gctccgtggc gagggggttg agaagaaggt
 421 ggatgccagg gaggaggaaa gcatccagga aatacagagg gttttggaaa atgatgaaaa
 481 tgtagaagaa gggaatgaag aagaggattt ggaagaggat attcccaagc gaaagaacag
 541 gactagagga cgggctcgcg gctctgcagg gggcaggagg aggcacgacg ccgcctctca
 601 ggaagaccac gacaaacctt acgtctgtga catctgtggc aagcgctaca agaaccgacc
 661 ggggctcagc taccactatg ctcacactca cctggccagc gaggaggggg atgaagctca
 721 agaccaggag actcggtccc cacccaacca cagaaatgag aaccacaggc cccagaaagg
 781 accggatgga acagtcattc ccaataacta ctgtgacttc tgcttggggg gctccaacat
 841 gaacaagaag agtgggcggc ctgaagagct ggtgtcctgc gcagactgtg gacgctctgg
 901 tcacccaacc tgcctgcagt ttaccctgaa catgaccgag gctgtcaaga cctacaagtg
 961 gcagtgcata gagtgcaaat cctgtatcct ctgtgggacc tcagagaatg atgaccagct
1021 actcttctgc gatgactgtg accgaggcta tcacatgtac tgtttaaatc cccggtggc
1081 tgagccccca gaaggaagct ggagctgcca cttatgctgg gaactgctca aagagaaagc
1141 ctcagccttt ggctgccagg cctagg
```

SEQ ID NO: 119 Human DPF3 Amino Acid Sequence Isoform 2 (NP_001267471.1)

```
  1 matvihnplk algdqfykea iehcrsynsr lcaersvrlp fldsqtgvaq nncyiwmekr
 61 hrgpglapgq lytyparcwr kkrrlhpped pklrlleikp evelplkkdg ftsesttlea
121 llrgegvekk vdareeesiq eiqrvlende nveegneeed leedipkrkn rtrgrargsa
181 ggrrrhdaas qedhdkpyvc dicgkryknr pglsyhyaht hlaseegdea qdgetrsppn
241 hrnenhrpqk gpdgtvipnn ycdfclggsn mnkksgrpee lvscadcgrs ghptclqftl
301 nmteavktyk wqciecksci lcgtsenddq llfcddcdrg yhmyclnppv aeppegswsc
361 hlcwellkek asafgcqa
```

SEQ ID NO: 120 Human DPF3 cDNA Sequence Variant 3 (NM_001280543.1, CDS: 143-1246)

```
   1 agacaatatt ctgttacatt gtagcaaaat ggcgactgtc attcacaacc ccctgaaagc
  61 gccctttcaa gaatcctatg aaagttgtgg atcatctccc cggaaaacac gcatatagat
 121 gtgaacatct gcctatggtt ttatggggtt cacagacctg gaagagccca tctctggatg
 181 ccctggaggc ccatgggctc tagggctcgg ggaccagttc tacaaggaag ccattgagca
 241 ctgccggagt tacaactcac ggctgtgtgc agagcgcagc gtgcgtcttc ccttcctgga
 301 ctcacagact ggggtggccc agaacaactg ctacatctgg atggagaaga ggcaccgagg
 361 cccaggcctt gccccgggcc agctgtatac ataccctgcc cgctgctggc gcaagaagag
 421 acgattgcac ccacctgaag atccaaaact gcggctgctg gagataaaac ctgaagtgga
 481 gcttcccctg aagaaggatg ggttcacctc agagagcacc acgctggaag ccttgctccg
 541 tggcgagggg gttgagaaga aggtggatgc cagggaggag gaaagcatcc aggaaataca
 601 gagggttttg gaaaatgatg aaaatgtaga agaagggaat gaagaagagg atttggaaga
 661 ggatattccc aagcgaaaga acaggactag aggacgggct cgcggctctg cagggggcag
 721 gaggaggcac gacgccgcct ctcaggaaga ccacgacaaa ccttacgtct gtgacatctg
 781 tggcaagcgc tacaagaacc gaccggggct cagctaccac tatgctcaca ctcacctggc
 841 cagcgaggag gggg atgaag ctcaagacca ggagactcgg tccccaccca accacagaaa
 901 tgagaaccac aggccccaga aaggaccgga tggaacagtc attcccaata actactgtga
 961 cttctgcttg gggggctcca acatgaacaa gaagagtggg cggcctgaag agctggtgtc
1021 ctgcgcagac tgtggacgct ctgctcattt gggaggagaa ggcaggaagg agaaggaggc
1081 agcggccgca gcacgtacca cggaggactt attcggttcc acgtcagaaa gtgacacgtc
1141 aactttccac ggctttgatg aggacgattt ggaagagcct cgctcctgtc gaggacgccg
1201 cagtggccgg ggttcgccca cagcagataa aaagggcagt tgctaaaccc acggaacaga
1261 ctctctgggc aattagccat ccccctctga ctttggtcat tgtgctggtt ctgatatata
1321 ttttttttaa tgaaaggcaa ctttagattt tccctctatc cttgcttttt ttcccttcac
1381 ctcccacgtg tccctccatc cctcccccca cccctctgtt ttgggtatgt acaacagaag
1441 cacaaactac tgaaacaaaa caaaacagca gaatgagcgt tcttccgaga gatggcatcg
1501 tgatgcgcta tttattttcc atagaaatag gaagttagac ggattgtctc ttttctgagg
1561 ggagggggtc tttttgacag gagcagagtt gatgtcctca attttcatat ttattggcaa
1621 aaggaagaga agaggaactt tgggttggaa acaaagaacc aataacatta aaacattatt
1681 atttatatat tctagctgtt attagaatca gacttttttt gcgagagaga gagagagaga
1741 gagagaaggg aaatcaaaga aatcgaagca atatcctgtt tagaggcaag ccgcccggtg
1801 gggagaattt cctcaatggg agacggttgc actattctgt gccccacgga gtttgcggct
1861 ccccgcggca gacccctccc tcattctcct ccctgacctt tccatcttcc tctctgcttg
1921 cgagaaaatg tcagtagttc cagagaagtc ggggtgccta tgcctggcct ccctccacac
```

TABLE 1-continued

```
1981 ctgggccctg accagccgcc tcctgggctc ctcctcctcc gtcagtagag ctgctgtttt
2041 gttattgctg gtttttcctc actttcctcc tggcaaagaa cgacttccaa atgcagggat
2101 ggaatataag cagaacgtca tgggctcagc agtgactcca ccacccgagg ccgaggccgt
2161 gcttctggaa gatagaagga gacatcatcg tgtgtttccc ctccccttgc ccctgttaag
2221 aaacgtatca atacccattg gatgatcaag gctaccgtat ttcttctatt tttttttata
2281 gtgcctgcca ggcactttgt tttatgtttc caatagcact tcctgaaata aaccaaagca
2341 acactgctca aggcccctgg ggcgatggag aaggccaccc acctcactga cagtcccaag
2401 aatgaccggc tgcgaggtcc tagtcaaaag tcaacattat gacctgggga ctccagcatc
2461 cttcaagcaa gccatttccg aagaaggtga aaagaagcca ggatgattgg cacctcctcc
2521 tcctcctcct cttcttcctc ttcccttgcc cagccccctc ctgtgcgtgt gtttcagaca
2581 acacaggagc cagcacagga gtggaaaatc ctgcagcgca actcagctca gcccacagaa
2641 gccttgggaa tggcctcagt ttgtgcaata agaagatttt ttttttcttt ttaaatcttc
2701 attatatttt ctttgattgt ctgtgagaaa gtacccaggt ccgcctggaa ttactctaca
2761 gtagaaataa ctgaacacaa acaaactgat ggaaaaaaag agttaactat tttatttatt
2821 tcaatattta aaaggaaaaa agtgctgaca tggcacagta tttttgttta aagtacctcc
2881 tacttcaaaa gttaagcgca attttgtgaa gacatgaaat cataagagta cttaatgtaa
2941 aataaaagac tgcatattaa ctctaaagaa aaatgcccca cattttaaat aagaaaataa
3001 agatcaactc tgctctctca ggctttttaa aaagccattc atgtatgtgc tttaggtatt
3061 tttatttctg cgagttggat gtggtaagtg aggagtgctc agttttttttt tcctccttca
3121 aaagtctatt gaaagtgttg gtgatgttaa atgattgtgt gttaagattt gactgaaata
3181 acttagccac aaatcagcag tttcccccac cctcattgcc ccctcacccc aggcaagccc
3241 cttttatctg aatgtcagaa gcagcctgcc tcctagttat catgtctgat gaggtctagc
3301 tcaggaagga attccatcta ttgatggaat atatcccctc aagttcaata gattcgaaca
3361 cagagagctt tgtttaaaat aatgcagcaa aaaaaaaaaa aaaaaaaaag caaaaataaa
3421 agcatcagct gaggtgatat tagttcagtc acctaacaac tcctagaaga gatgaggaaa
3481 gggaaccttc tgctgagctg gcttctgggg cctgagcttc cagagctgtc cccaagggct
3541 aggaaggccg acctgaagga tgagaacctc aaattcagtt gctggtggga gccaaggaag
3601 acggcgggtg ttctaacatg gccctttctg gctgagctgg cggaagtggg cgttttggcc
3661 gatgggatgt atctcggcgc tgtgtctgtg gcccagcaaa ggtgcagggc tgactggctg
3721 agccactggg ttctacccgc aggctcccca ctgcactggg ctttcacaca gccatgctct
3781 tgggtttccc tcccttgtaa gcagagtcat aataacacac gaatagtcta aggctgggta
3841 ttctggtcag cagaggtcct tgagtcacag tgttactgaa atggttctga gcctgagaat
3901 ctctttggcc tctgaaaggg cagggcaggt gggcaccgac ttcctgccag tcctttcagg
3961 tttcctgttc aaagccagtc ctgttggtgg aggggatcac cgagagtgtc tgtatcattt
4021 tgtagccctt ttctctgacg ttttctggta gaaaatgtcc cttgtcaaaa tgctaataat
4081 tatcataata atctgctttc caaccaactc ccacaagtga caacctgtgt agaactgtga
4141 taaaggtttg cataatgtag ggtttgtacc aagtgtgtgt aagtttctgt taaataaaaa
4201 gtctgtttcc aatgctccta t
```

SEQ ID NO: 121 Human DPF3 Amino Acid Sequence Isoform 3 (NP_001267472.1)

```
  1 mgftdleepi sgcpggpwal glgdqfykea iehcrsynsr lcaersvrlp fldsqtgvaq
 61 nncyiwmekr hrgpglapgq lytyparcwr kkrrlhpped pklrlleikp evelplkkdg
121 ftsesttlea llrgegvekk vdareeesiq eiqrvlende nveegneeed leedipkrkn
181 rtrgrargsa ggrrrhdaas qedhdkpyvc dicgkryknr pglsyhyaht hlaseegdea
241 qdqetrsppn hrnenhrpqk gpdgtvipnn ycdfclggsn mnkksgrpee lvscadcgrs
301 ahlggegrke keaaaaartt edlfgstses dtstfhgfde ddleeprscr grrsgrgspt
361 adkkgsc
```

SEQ ID NO: 123 Human DPF3 cDNA Sequence Variant 4 (NM_001280544.1, CDS: 307-1545)

```
   1 attctcgtct tcacccctgg ccactcctgg agttgaaaac caggttcgct cccggggacg
  61 gtagggggtt cctaacgcaa aggaatgcac agggagaatc ggacgtgttt gcgccagctc
 121 gtcgcccatc agaaataggg aaaggggtag gaaggcccca ggtttcaaat atatttatat
 181 gaaagctgcc gttaagagga cgttggaagc tgaggctgat cagataggag ctcctggctt
 241 cagttctggc tcggaagctc ggatacactg cgcttgaacg ccacagcgtt tcacccaaga
 301 aagaaaatgt tttatggcag aataaatggg cgtaacttcg ccgcatcctc gctgccggtt
 361 gctttcgctg caacaccgct gatgctgttt ctaccgaacc cacaactgat tttcagtttc
 421 cccatttcca gccgaaatca cataaccggg ctgatgccac ctggtaaact caagttagag
 481 aacctatttc acatgtgcac caggctcggg gaccagttct acaaggaagc cattgagcac
 541 tgccggagtt acaactcacg gctgtgtgca gagcgcagcg tgcgtcttcc cttcctggac
 601 tcacagactg ggtggcccca gaacaactgc tacatctgga tggagaagag gcaccgaggc
 661 ccaggccttg ccccgggcca gctgtataca taccctgccc gctgctggcg caagaagaga
 721 cgattgcacc cacctgaaga tccaaaactg cggctgctgg agataaaacc tgaagtggag
 781 cttcccctga agaaggatgg gttcacctca gagagcacca cgctggaagc cttgctccgt
 841 ggcgaggggg ttgagaagaa ggtggatgcc agggaggagg aaagcatcca ggaaatacag
 901 agggttttgg aaaatgatga aaatgtagaa gaagggaatg aagaagagga tttggaagag
 961 gatattccca agcgaaagaa caggactaga ggacgggctc gcggctctgc agggggcagg
1021 aggaggcacg acgccgcctc tcaggaagac cacgacaaac cttacgtctg tgacatctgt
1081 ggcaagcgct acaagaaccg accggggctc agctaccact atgctcacac tcacctggcc
1141 agcgaggagg gggatgaagc tcaagaccag gagactcggt ccccacccaa ccacagaaat
1201 gagaaccaca ggccccagaa aggaccggat ggaacagtca ttcccaataa ctactgtgac
1261 ttctgcttgg ggggctccaa catgaacaag aagagtgggc ggcctgaaga gctggtgtcc
1321 tgcgcagact gtggacgctc tgctcatttg ggaggagaag gcaggaagga gaaggaggca
1381 gcggccgcag cacgtaccac ggaggactta ttcggttcca cgtcagaaag tgacacgtca
1441 actttccacg gctttgatga ggacgatttg gaagagcctc gctcctgtcg aggacgccgc
1501 agtggccggg gttcgcccac agcagataaa aagggcagtt gctaaaccca cggaacagac
1561 tctctgggca attagccatc cccctctgac tttggtcatt gtgctggttc tgatatatat
1621 tttttttaat gaaaggcaac tttagatttt ccctctatcc ttgctttttt tcccttcacc
1681 tcccacgtgt ccctccatcc ctccccccac ccctctgttt tgggtatgta caacagaagc
1741 acaaactact gaaacaaaac aaaacagcag aatgagcgtt cttccgagag atggcatcgt
```

TABLE 1-continued 1801 gatgcgctat ttattttcca tagaaatagg aagttagacg gattgtctct tttctgaggg
1861 gagggggtct ttttgacagg agcagagttg atgtcctcaa ttttcatatt tattggcaaa
1921 aggaagagaa gaggaacttt gggttggaaa caaagaacca ataacattaa aacattatta
1981 tttatatatt ctagctgtta ttagaatcag actttttttg cgagagagag agagagagag
2041 agagaaggga aatcaaagaa atcgaagcaa tatcctgttt agaggcaagc cgcccggtgg
2101 ggagaatttc ctcaatggga gacggttgca ctattctgtg ccccacggag tttgcggctc
2161 cccgcggcag accectccct cattctcctc cctgaccttt ccatcttcct ctctgcttgc
2221 gagaaaatgt cagtagttcc agagaagtcg gggtgcctat gcctggcctc cctccacacc
2281 tgggccctga ccagccgcct cctgggctcc tcctcctccg tcagtagagc tgctgttttg
2341 ttattgctgg tttttcctca ctttcctcct ggcaaagaac gacttccaaa tgcagggatg
2401 gaatataagc agaacgtcat gggctcagca gtgactccac cacccgaggc cgaggccgtg
2461 cttctggaag atagaaggag acatcatcgt gtgtttcccc tccccttgcc cctgttaaga
2521 aacgtatcaa tacccattgg atgatcaagg ctaccgtatt tcttctattt ttttttatag
2581 tgcctgccag gcactttgtt ttatgtttcc aatagcactt cctgaaataa accaaagcaa
2641 cactgctcaa ggcccctggg gcgatggaga aggccaccca cctcactgac agtcccaaga
2701 atgaccggct gcgaggtcct agtcaaaagt caacattatg acctggggac tccagcatcc
2761 ttcaagcaag ccatttccga agaaggtgaa aagaagccag gatgattggc acctcctcct
2821 cctcctcctc ttcttcctct tcccttgccc agccccctcc tgtgcgtgtg tttcagacaa
2881 cacaggagcc agcacaggag tggaaaatcc tgcagcgcaa ctcagctcag cccacagaag
2941 ccttgggaat ggcctcagtt tgtgcaataa gaagattttt tttttctttt taaatcttca
3001 ttatattttc tttgattgtc tgtgagaaag tacccaggtc cgcctggaat tactctacag
3061 tagaaataac tgaacacaaa caaactgatg gaaaaaaaga gttaactatt ttatttattt
3121 caatatttaa aaggaaaaaa gtgctgacat ggcacagtat ttttgtttaa agtacctcct
3181 acttcaaaag ttaagcgcaa ttttgtgaag acatgaaatc ataagagtac ttaatgtaaa
3241 ataaaagact gcatattaac tctaaagaaa aatgccccac atttaaaata agaaaataaa
3301 gatcaactct gctctctcag gctttttaaa aagccattca tgtatgtgct ttaggtattt
3361 ttatttctgc gagttggatg tggtaagtga ggagtgctca gttttttttt cctccttcaa
3421 aagtctattg aaagtgttgg tgatgttaaa tgattgtgtg ttaagatttg actgaaataa
3481 cttagccaca aatcagcagt ttcccccacc ctcattgccc cctcacccca ggcaagcccc
3541 ttttatctga atgtcagaag cagcctgcct cctagttatc atgtctgatg aggtctagct
3601 caggaaggaa ttccatctat tgatggaata tatcccctca agttcaatag attcgaacac
3661 agagagcttt gtttaaaata atgcagcaaa aaaaaaaaaa aaaaaaaagc aaaaataaaa
3721 gcatcagctg aggtgatatt agttcagtca cctaacaact cctagaagag atgaggaaag
3781 ggaaccttct gctgagctgg cttctggggc ctgagcttcc agagctgtcc ccaagggcta
3841 ggaaggccga cctgaaggat gagaacctca aattcagttg ctggtgggag ccaaggaaga
3901 cggcgggtgt tctaacatgg ccctttctgg ctgagctggc ggaagtgggc gttttggccg
3961 atgggatgta tctcggcgct gtgtctgtgg cccagcaaag gtgcagggct gactggctga
4021 gccactgggt tctacccgca ggctccccac tgcactgggc tttcacacag ccatgctctt
4081 gggtttccct cccttgtaag cagagtcata ataacacacg aatagtctaa ggctgggtat
4141 tctggtcagc agaggtcctt gagtcacagt gttactgaaa tggttctgag cctgagaatc
4201 tctttggcct ctgaaagggc agggcaggtg ggcaccgact tcctgccagt cctttcaggt
4261 ttcctgttca aagccagtcc tgttggtgga ggggatcacc gagagtgtct gtatcatttt
4321 gtagcccttt tctctgacgt tttctggtag aaaatgtccc ttgtcaaaat gctaataatt
4381 atcataataa tctgctttcc aaccaactcc cacaagtgac aacctgtgta gaactgtgat
4441 aaaggtttgc ataatgtagg gtttgtacca agtgtgtgta agtttctgtt aaataaaaag
4501 tctgtttcca atgctcctat SEQ ID NO: 124 Human DPF3 Amino Acid Sequence Isoform 4 (NP_001267473.1)
1 mfygringrn faasslpvaf aatplmlflp npqlifsfpi ssrnhitglm ppgklklenl
61 fhmctrlgdg fykeaiehcr synsrlcaer svrlpfldsq tgvagnncyi wmekrhrgpg
121 lapgqlytyp arcwrkkrrl hppedpklrl leikpevelp lkkdgftses ttleallrge
181 gvekkvdare eesigeigry lendenveeg neeedleedi pkrknrtrgr argsaggrrr
241 hdaasqedhd kpyvcdicgk ryknrpglsy hyahthlase egdeagdget rsppnhrnen
301 hrpqkgpdgt vipnnycdfc lggsnmnkks grpeelvsca dcgrsahlgg egrkekeaaa
361 aarttedlfg stsesdtstf hgfdeddlee prscrgrrsg rgsptadkkg sc SEQ ID NO: 125 Mouse DPF3 cDNA Sequence Variant 1 (NM_001267625.1, CDS: 29-1165)
1 agacaatatt ctgttacatt gtagcaaaat ggcgactgtc attcacaacc ccctgaaagc
61 gcttggggac cagttctaca aggaagccat tgagcactgc cggagctaca actcgaggct
121 gtgcgcagag cggagcgtgc gtctcccctt cctggactcg cagactgggg tggctcagaa
181 caactgctac atctggatgg agaagaggca ccgcggccca ggcctcgctc cgggccagtt
241 gtacacatac cctgcccgct gctggcgcaa gaagcgacga ttgcacccac cagaggaccc
301 aaaactacga ctcctggaaa tcaaacccga agtagaactg cccctgaaga aagatggatt
361 tacctctgag agtaccacac tggaagcctt gcttcgcggc gagggagtag agaagaaggt
421 ggatgccaga gaagaggaaa gcatccagga gatacagagg gttttggaaa atgatgaaaa
481 cgtagaagaa gggaatgaag aggaggattt ggaagaagat gttcccaagc gcaagaacag
541 gaccagagga cgggctcgcg gctctgcagg cggaaggagg aggcatgatg ccgcctctca
601 ggaagaccac gacaaaccct acgtctgcga catctgtggc aagcgctaca agaaccggcc
661 aggactcagc taccactacg ctcatactca cctggccagc gaggagggag acgaagccca
721 agaccaggag acccgatccc cacccaacca cagaaatgag aaccacagac cccagaaagg
781 accagacggg acagtcattc ctaataacta ctgtgacttc tgcttggggg gctccaacat
841 gaacaagaag agtgggaggc ctgaagagct ggtgtcctgt gcagactgtg gacgctctgg
901 tcatccaact tgcctgcagt tcactctgaa catgactgag gcagttaaga cctacaagtg
961 gcagtgcata gagtgtaaat cctgtatcct gtgtgggacc tcggagaacg acgaccagct
1021 actcttctgt gatgactgcg atcgtggcta tcacatgtac tgtttaaatc ccccagtggc
1081 tgagccccca gaaggaagct ggagctgcca tttatgctgg gagctgctca aagagaaagc
1141 atcagccttt ggctgccagg cctagggctc cacccaggtc acagagtgca gcccaccact
1201 agagaggctg aactgaagcc ctgttcaacc cagatggagg tctcctcctg tatatgcaca
1261 cagaccaact acaaggaaaa cgaatagtta cagaagggaa cggagggagc aaggtctcca TABLE 1-continued 1321 ctcacttctc gccctaccca tgacctccca ccccacacat ccttcagcca gctcttcctc
1381 atttctacca gcgggaactt ggcacttttg aagaataatc cagccccggc tctgtggaaa
1441 cttcctcatg ttcactgtca caggcatctc tctttgttgc ttcttgtttt ggaggaagcc
1501 attttgtgac tgctcatcaa ccactcgtgt gttgcttggt ggggttcttg ttttgttgtc
1561 tattgtgttt caagaacttg tcacagagtg tcctcaccct tagcttaggc tcttcatcct
1621 gaaactcaca gaggaacaaa atgccgtggt ggggaagctc ctgcctatta cgagtctcac
1681 tggaagcatc catgtttgga ggccatcttg aagacagaac ttggaaaatg tcttggtttt
1741 cttagtctct gctgagaaga gaagttgtag catttgagcc ttggcagtag catccccagc
1801 tgcgatgacc ttgatccact gcactgccat ttgatcaggg gttcagaggg cctgggagat
1861 gggaggaaca cttggggccc tgctatagcc agccagtatt tgctgttcct caggagggac
1921 taggtggttc cttgaccttc agaactgtgg tgtccttgag gtgagacaac acagtctcta
1981 aacacagaaa agtgctgaag atcctgcccc caaccgaatt gaccgtgaag gtctggctca
2041 gtctctgggg ggtgggactc aagctctgga gaggtgggca aaggatgccc attcaacagt
2101 ccagggttgg ttagaagaga ctgtatgtag ctttgagaaa ctctcccagt attgatgcta
2161 cactatggat ttcttttctg ggcaatttct tccttccatg tagtatatgt ttgccaatga
2221 ccactgagat gtgactggaa attttagaat ggtgaagaga tgaacattac ttaaccagat
2281 cattgggcac agtgattact tgtgactggg tggcaatgat tcagagccct tgtccgttct
2341 tgcaccctaa gctcccccat atggaatggg ctctcgtttg aagcaaggtt tctagaagat
2401 gtaggaaggt ctagattctg agaactcttg tgtgtcagaa gagaagcctt gagggctgga
2461 gtgggctggg ctgcctttga cgcacggcac cagcatgata actgacacat ttctggaaaa
2521 atcgtttgcc caaagggcag gtctccgtga gcaggaccct cgcgcatgct cggcttccct
2581 ggattcagct ccatcgctgt ggtccagcag cttgcaacaa aggcctgggt tatttttagt
2641 cgtcagctcc tgaagaagcc cctggagacc tggctggctg gggcccctct gcccagcggc
2701 agcatggcct ctgccactcc acaggagtca tcctccccct ggctaattgc tcttggcacg
2761 tggacccagg gcagcctggc atggaaccaa gcagtgtgac ccccccctgca acttctttgc
2821 agagtgacct gtggcaagag agtgggggtc actttcctgc aggccctgtg gcctcagagc
2881 tagttccatg catacgaaat gatctcattt aaagggcccc tgtccagaga gcatctgtct
2941 cctcctctca agctctcttc ttcctcctgc tggttgctgt gcctgtgtgg attcaaaaga
3001 cccaagggag ggctggagga atggcccgtc tccacggagg ggtacattcc ctctccagac
3061 tctgcgggct ctctcgttcc acaaaaccca aagcagagta tcttcagaga ctaactactt
3121 gtttggggga tcatattaaa ttaatttcag aaggg SEQ ID NO: 126 Mouse DPF3 Amino Acid Sequence Isoform 1 (NP_001254554.1)
1 matvihnplk algdqfykea iehcrsynsr lcaersvrlp fldsqtgvaq nncyiwmekr
61 hrgpglapgq lytyparcwr kkrrlhpped pklrlleikp evelplkkdg ftsesttlea
121 llrgegvekk vdareeesiq eiqrvlende nveegneeed leedvpkrkn rtrgrargsa
181 ggrrrhdaas qedhdkpyvc dicgkryknr pglsyhyaht hlaseegdea qdgetrsppn
241 hrnenhrpqk gpdgtvipnn ycdfclggsn mnkksgrpee lvscadcgrs ghptclqftl
301 nmteavktyk wqciecksci lcgtsenddq llfcddcdrg yhmyclnppv aeppegswsc
361 hlcwellkek asafgcqa SEQ ID NO: 127 Mouse DPF3 cDNA Sequence Variant 2 (NM_001267626.1, CDS: 29-1102)
1 agacaatatt ctgttacatt gtagcaaaat ggcgactgtc attcacaacc ccctgaaagc
61 gcttggggac cagttctaca aggaagccat tgagcactgc cggagctaca actcgaggct
121 gtgcgcagag cggagcgtgc gtctcccctt cctggactcg cagactgggg tggctcagaa
181 caactgctac atctggatgg agaagaggca ccgcggccca ggcctcgctc cgggccagtt
241 gtacacatac cctgcccgct gctggcgcaa gaagcgacga ttgcacccac cagaggaccc
301 aaaactacga ctcctggaaa tcaaacccga agtagaactg cccctgaaga aagatggatt
361 tacctctgag agtaccacac tggaagcctt gcttcgcggc gagggagtag agaagaaggt
421 ggatgccaga gaagaggaaa gcatccagga gatacagagg gttttggaaa atgatgaaaa
481 cgtagaagaa gggaatgaag aggaggattt ggaagaagat gttcccaagc gcaagaacag
541 gaccagagga cgggctcgcg gctctgcagg cggaaggagg aggcatgatg ccgcctctca
601 ggaagaccac gacaaaccct acgtctgcga catctgtggc aagcgctaca agaaccggcc
661 aggactcagc taccactacg ctcatactca cctggccagc gaggagggag acgaagccca
721 agaccaggag acccgatccc cacccaacca cagaaatgag aaccacagac cccagaaagg
781 accagacggg acagtcattc ctaataacta ctgtgacttc tgcttggggg gctccaacat
841 gaacaagaag agtgggaggc ctgaagagct ggtgtcctgt gcagactgtg gacgctctgc
901 tcatttggga ggagaaggca ggaaggagaa ggaggcagcg gccgcagcac gtaccacgga
961 ggacttattc ggttccacgt cagaaagtga cacctcaact ttctacggct ttgatgagga
1021 cgatttggaa gagcctcgct cctgtcgagg acgccgcagt ggccggggtt cacccacagc
1081 agataaaaag ggcagctgct gagcacatgg gacagactgt gtggccaatt agccacccct
1141 ccccctgact ctggtcattg ttctagttct gatatatatt tttaaatgaa agacaacttg
1201 ggcatttccc ttaatccttg ccttttcctt ctgcctccca cgtgtccctc cctctcctag
1261 cttccttcta ttttgggtac aacagaagca cacactactg agaaccaggg aagagcagga
1321 tgagagtcct ctggggagcc atggcatcat ggcgggctct tatggactct tatccctaga
1381 agtaggagaa attaagagga ttttctgtca ctgggggagg gcatcttttt gatgtgagca
1441 gagttgattt cctgttttca agagaagagg aacatgaggt ttgaaaacaa ataacattaa
1501 caatatttat ttataaaaaa aaaaaaaaaa aa SEQ ID NO: 128 Mouse DPF3 Amino Acid Sequence Isoform 2 (NP_001254555.1)
1 matvihnplk algdqfykea iehcrsynsr lcaersvrlp fldsqtgvaq nncyiwmekr
61 hrgpglapgq lytyparcwr kkrrlhpped pklrlleikp evelplkkdg ftsesttlea
121 llrgegvekk vdareeesiq eiqrvlende nveegneeed leedvpkrkn rtrgrargsa
181 ggrrrhdaas qedhdkpyvc dicgkryknr pglsyhyaht hlaseegdea qdgetrsppn
241 hrnenhrpqk gpdgtvipnn ycdfclggsn mnkksgrpee lvscadcgrs ahlggegrke
301 keaaaaartt edlfgstses dtstfygfde ddleeprscr grrsgrgspt adkkgsc TABLE 1-continued SEQ ID NO: 129 Mouse DPF3 cDNA Sequence Variant 3 (NM_058212.2, CDS: 29-1099)

```
   1 agacaatatt ctgttacatt gtagcaaaat ggcgactgtc attcacaacc ccctgaaagc
  61 gcttggggac cagttctaca aggaagccat tgagcactgc cggagctaca actcgaggct
 121 gtgcgcagag cggagcgtgc gtctcccctt cctggactcg cagactgggg tggctcagaa
 181 caactgctac atctggatgg agaagaggca ccgcggccca ggcctcgctc cgggccagtt
 241 gtacacatac cctgcccgct gctggcgcaa gaagcgacga ttgcacccac cagaggaccc
 301 aaaactacga ctcctggaaa tcaaacccgt agaactgccc ctgaagaaag atggatttac
 361 ctctgagagt accacactgg aagccttgct tcgcggcgag ggagtagaga agaaggtgga
 421 tgccagagaa gaggaaagca tccaggagat acagagggtt ttggaaaatg atgaaaacgt
 481 agaagaaggg aatgaagagg aggatttgga agaagatgtt cccaagcgca agaacaggac
 541 cagaggacgg gctcgcggct ctgcaggcgg aaggaggagg catgatgccg cctctcagga
 601 agaccacgac aaaccctacg tctgcgacat ctgtggcaag cgctacaaga accggccagg
 661 actcagctac cactacgctc atactcacct ggccagcgag gagggagacg aagcccaaga
 721 ccaggagacc cgatccccac ccaaccacag aaatgagaac cacagacccc agaaaggacc
 781 agacgggaca gtcattccta ataactactg tgacttctgc ttggggggct ccaacatgaa
 841 caagaagagt gggaggcctg aagagctggt gtcctgtgca gactgtggac gctctgctca
 901 tttgggagga gaaggcagga aggagaagga ggcagcggcc gcagcacgta ccacggagga
 961 cttattcggt tccacgtcag aaagtgacac ctcaactttc tacggctttg atgaggacga
1021 tttggaagag cctcgctcct gtcgaggacg ccgcagtggc cggggttcac ccacagcaga
1081 taaaaagggc agctgctgag cacatgggac agactgtgtg gccaattagc cacccctccc
1141 cctgactctg gtcattgttc tagttctgat atatattttt aaatgaaaga caacttgggc
1201 atttccctta atccttgcct tttccttctg cctcccacgt gtccctccct ctcctagctt
1261 ccttctattt tgggtacaac agaagcacac actactgaga accagggaag agcaggatga
1321 gagtcctctg gggagccatg gcatcatggc gggctcttat ggactcttat ccctagaagt
1381 aggagaaatt aagaggattt tctgtcactg ggggagggca tctttttgat gtgagcagag
1441 ttgatttcct gttttcaaga gaagaggaac atgaggtttg aaaacaaata acattaacaa
1501 tatttattta taaaaaaaaa aaaaaaaaa
```

SEQ ID NO: 130 Mouse DPF3 Amino Acid Sequence Isoform 3 (NP_478119.1)

```
   1 matvihnplk algdqfykea iehcrsynsr lcaersvrlp fldsqtgvaq nncyiwmekr
  61 hrgpglapgq lytyparcwr kkrrlhpped pklrlleikp velplkkdgf tsesttleal
 121 lrgegvekkv dareeesiqe iqrvlenden veegneeedl eedvpkrknr trgrargsag
 181 grrrhdaasq edhdkpyvcd icgkryknrp glsyhyahth laseegdeaq dgetrsppnh
 241 rnenhrpqkg pdgtvipnny cdfclggsnm nkksgrpeel vscadcgrsa hlggegrkek
 301 eaaaaartte dlfgstsesd tstfygfded dleeprscrg rrsgrgspta dkkgsc
```

SEQ ID NO: 131 Human ACTL6A cDNA Sequence variant 1 (NM_004301.4, CDS: 214-1503)

```
   1 agacttaggc ctggacccta gtgattggct gataggagga gccagcaagt gtggctgagc
  61 tccggggtgt gtggacgccg ctttgttgcc tgaggtgggt ggcggtggaa gttaagggag
 121 tcaggggcta tcgctcctcg agactcgcag tcgcggccac tgcagtcact tcgccagtta
 181 gcccttaggg taggagtcgc gccggcagca gccatgagcg gcggcgtgta cgggggagat
 241 gaagttggag cccttgtttt tgacattgga tcctatactg tgagagctgg ttatgctggt
 301 gaggactgcc ccaaggtgga ttttcctaca gctattggta tggtggtaga aagagatgac
 361 ggaagcacat taatggaaat agatggcgat aaaggcaaac aaggcggtcc cacctactac
 421 atagatacta atgctctgcg tgttccgagg gagaatatgg aggccatttc acctctaaaa
 481 aatgggatgg ttgaagactg ggatagtttc caagctattt tggatcatac ctacaaaatg
 541 catgtcaaat cagaagccag tctccatcct gttctcatgt cagaggcacc gtggaatact
 601 agagcaaaga gagagaaact gacagagtta atgtttgaac actacaacat ccctgccttc
 661 ttcctttgca aaactgcagt tttgacagca tttgctaatg gtcgttctac tgggctgatt
 721 ttggacagtg gagccactca taccactgca attccagtcc acgatggcta tgtccttcaa
 781 caaggcattg tgaaatcccc tcttgctgga gactttatta ctatgcagtg cagagaactc
 841 ttccaagaaa tgaatattga attggttcct ccatatatga ttgcatcaaa agaagctgtt
 901 cgtgaaggat ctccagcaaa ctggaaaaga aaagagaagt tgcctcaggt tacgaggtct
 961 tggcacaatt atatgtgtaa ttgtgttatc caggattttc aagcttcggt acttcaagtg
1021 tcagattcaa cttatgatga acaagtggct gcacagatgc caactgttca ttatgaattc
1081 cccaatggct acaattgtga ttttggtgca gagcggctaa agattccaga aggattattt
1141 gacccttcca atgtaaaggg gttatcagga aacacaatgt taggagtcag tcatgttgtc
1201 accacaagtg ttgggatgtg tgatattgac atcagaccag gtctctatgg cagtgtaata
1261 gtggcaggag gaaacacact aatacagagt tttactgaca ggttgaatag agagctgtct
1321 cagaaaactc ctccaagtat gcggttgaaa ttgattgcaa ataatacaac agtggaacgg
1381 aggtttagct catggattgg cggctccatt ctagcctctt tgggtacctt tcaacagatg
1441 tggatttcca agcaagaata tgaagaagga gggaagcagt gtgtagaaag aaaatgccct
1501 tgagaaagag ttcccaagct tctaccttcc ttttgtcacc ttacgtttca tagctttagt
1561 atactcagga aaagaatgac catcttttgt agaatgttta tacatttttg catatttcaa
1621 tttccactta aattttttaa agctttaact ggctctataa attaagtttg tgctttcctt
1681 gaaatgcact tattcttatt acaagcattt tataattttg tataaatgtc tattttctct
1741 aaatattttg ctttcagtaa aatgctttcc aactctgttt agtgtattaa ttaccagtgg
1801 attggtagaa ctgcttttta ttgactagta aaagttactg cctatgcttt ttaccttagg
1861 cttacagaat taaataaaaa ttagccattc cagaaataaa aaaaaaaaaa aaaaaaaaaa
1921 aaaaaaaaaa aa
```

SEQ ID NO: 132 Human ACTL6A Amino Acid Sequence isoform 1 (NP_004292.1)

```
   1 msggvyggde vgalvfdigs ytvragyage dcpkvdfpta igmvverddg stlmeidgdk
  61 gkqggptyyi dtnalrvpre nmeaisplkn gmvedwdsfq aildhtykmh vkseaslhpv
 121 lmseapwntr akrekltelm fehynipaff lcktavltaf angrstglil dsgathttai
 181 pvhdgyvlqq givksplagd fitmqcrelf qemnielvpp ymiaskeavr egspanwkrk
```

TABLE 1-continued

```
241 eklpqvtrsw hnymcncviq dfgasvlqvs dstydeqvaa qmptvhyefp ngyncdfgae
301 rlkipeglfd psnvkglsgn tmlgvshvvt tsvgmcdidi rpglygsviv aggntliqsf
361 tdrinrelsq ktppsmrlkl iannttverr fsswiggsil aslgtfqqmw iskqeyeegg
421 kqcverkcp
```

SEQ ID NO: 133 Human ACTL6A cDNA Sequence variant 2 (NM_177989.3; CDS: 196-1359)

```
   1 agacttaggc ctggacccta gtgattggct gataggagga gccagcaagt gtggctgagc
  61 tccggggtgt gtggacgccg ctttgttgcc tgagatgaag ttggagccct tgtttttgac
 121 attggatcct atactgtgag agctggttat gctggtgagg actgccccaa ggtggatttt
 181 cctacagcta ttggtatggt ggtagaaaga gatgacggaa gcacattaat ggaaatagat
 241 ggcgataaag gcaaacaagg cggtcccacc tactacatag atactaatgc tctgcgtgtt
 301 ccgagggaga atatggaggc catttcacct ctaaaaaatg ggatggttga agactgggat
 361 agtttccaag ctattttgga tcatacctac aaaatgcatg tcaaatcaga agccagtctc
 421 catcctgttc tcatgtcaga ggcaccgtgg aatactagag caaagagaga gaaactgaca
 481 gagttaatgt ttgaacacta caacatccct gccttcttcc tttgcaaaac tgcagttttg
 541 acagcatttg ctaatggtcg ttctactggg ctgattttgg acagtggagc cactcatacc
 601 actgcaattc cagtccacga tggctatgtc cttcaacaag gcattgtgaa atcccctctt
 661 gctggagact ttattactat gcagtgcaga gaactcttcc aagaaatgaa tattgaattg
 721 gttcctccat atatgattgc atcaaaagaa gctgttcgtg aaggatctcc agcaaactgg
 781 aaaagaaaag agaagttgcc tcaggttacg aggtcttggc acaattatat gtgtaattgt
 841 gttatccagg attttcaagc ttcggtactt caagtgtcag attcaactta tgatgaacaa
 901 gtggctgcac agatgccaac tgttcattat gaattcccca atggctacaa ttgtgatttt
 961 ggtgcagagc ggctaaagat tccagaagga ttatttgacc cttccaatgt aaaggggtta
1021 tcaggaaaca caatgttagg agtcagtcat gttgtcacca caagtgttgg gatgtgtgat
1081 attgacatca gaccaggtct ctatggcagt gtaatagtgg caggaggaaa cacactaata
1141 cagagtttta ctgacaggtt gaatagagag ctgtctcaga aaactcctcc aagtatgcgg
1201 ttgaaattga ttgcaaataa tacaacagtg gaacggaggt ttagctcatg gattggcggc
1261 tccattctag cctctttggg tacctttcaa cagatgtgga tttccaagca agaatatgaa
1321 gaaggaggga agcagtgtgt agaaagaaaa tgcccttgag aaagagttcc caagcttcta
1381 ccttcctttt gtcaccttac gtttcatagc tttagtatac tcaggaaaag aatgaccatc
1441 ttttgtagaa tgtttataca tttttgcata tttcaatttc cacttaaatt ttttaaagct
1501 ttaactggct ctataaatta agtttgtgct ttccttgaaa tgcacttatt cttattacaa
1561 gcattttata attttgtata aatgtctatt ttctctaaat attttgcttt cagtaaaatg
1621 ctttccaact ctgtttagtg tattaattac cagtggattg gtagaactgc tttttattga
1681 ctagtaaaag ttactgccta tgctttttac cttaggctta cagaattaaa taaaaattag
1741 ccattccaga aataaaaaaa aaaaaaaaaa aaaaaaaaaa aaaaaaaa
```

SEQ ID NO: 134 Human ACTL6A cDNA Sequence variant 3 (NM_178042.3; CDS: 388-1551)

```
   1 agacttaggc ctggacccta gtgattggct gataggagga gccagcaagt gtggctgagc
  61 tccggggtgt gtggacgccg ctttgttgcc tgaggtgggt ggcggtggaa gttaagggag
 121 tcaggggcta tcgctcctcg agactcgcag tcgcggccac tgcagtcact tcgccagtta
 181 gcccttaggg taggagtcgc gccggcagca gccatgagcg gcggcgtgta cgggggaggt
 241 gagtgagtgc ggccggacga gagagcgcgc cttttcggcg tgtgggatga agttggagcc
 301 cttgtttttg acattggatc ctatactgtg agagctggtt atgctggtga ggactgcccc
 361 aaggtggatt ttcctacagc tattggtatg gtggtagaaa gagatgacgg aagcacatta
 421 atggaaatag atggcgataa aggcaaacaa ggcggtccca cctactacat agatactaat
 481 gctctgcgtg ttccgaggga gaatatggag gccatttcac ctctaaaaaa tgggatggtt
 541 gaagactggg atagtttcca agctattttg gatcatacct acaaaatgca tgtcaaatca
 601 gaagccagtc tccatcctgt tctcatgtca gaggcaccgt ggaatactag agcaaagaga
 661 gagaaactga cagagttaat gtttgaacac tacaacatcc ctgccttctt cctttgcaaa
 721 actgcagttt tgacagcatt tgctaatggt cgttctactg ggctgatttt ggacagtgga
 781 gccactcata ccactgcaat tccagtccac gatggctatg tccttcaaca aggcattgtg
 841 aaatcccctc ttgctggaga ctttattact atgcagtgca gagaactctt ccaagaaatg
 901 aatattgaat tggttcctcc atatatgatt gcatcaaaag aagctgttcg tgaaggatct
 961 ccagcaaact ggaaaagaaa agagaagttg cctcaggtta cgaggtcttg gcacaattat
1021 atgtgtaatt gtgttatcca ggattttcaa gcttcggtac ttcaagtgtc agattcaact
1081 tatgatgaac aagtggctgc acagatgcca actgttcatt atgaattccc caatggctac
1141 aattgtgatt ttggtgcaga gcggctaaag attccagaag gattatttga cccttccaat
1201 gtaaaggggt tatcaggaaa cacaatgtta ggagtcagtc atgttgtcac cacaagtgtt
1261 gggatgtgtg atattgacat cagaccaggt ctctatggca gtgtaatagt ggcaggagga
1321 aacacactaa tacagagttt tactgacagg ttgaatagag agctgtctca gaaaactcct
1381 ccaagtatgc ggttgaaatt gattgcaaat aatacaacag tggaacggag gtttagctca
1441 tggattggcg gctccattct agcctctttg ggtacctttc aacagatgtg gatttccaag
1501 caagaatatg aagaaggagg gaagcagtgt gtagaaagaa aatgcccttg agaaagagtt
1561 cccaagcttc taccttcctt ttgtcacctt acgtttcata gctttagtat actcaggaaa
1621 agaatgacca tcttttgtag aatgtttata catttttgca tatttcaatt tccacttaaa
1681 tttttaaag ctttaactgg ctctataaat taagtttgtg ctttccttga aatgcactta
1741 ttcttattac aagcatttta taattttgta taaatgtcta ttttctctaa atattttgct
1801 ttcagtaaaa tgctttccaa ctctgtttag tgtattaatt accagtggat tggtagaact
1861 gctttttatt gactagtaaa agttactgcc tatgcttttt accttaggct tacagaatta
1921 aataaaaatt agccattcca gaaataaaaa aaaaaaaaaa aaaaaaaaaa aaaaaaaaaa
```

SEQ ID NO: 135 Human ACTL6A Amino Acid Sequence isoform 2 (NP_817126.1 and NP_829888.1)

```
   1 mvverddgst lmeidgdkgk qggptyyidt nalrvprenm eaisplkngm vedwdsfqai
  61 ldhtykmhvk seaslhpvlm seapwntrak rekltelmfe hynipafflc ktavltafan
 121 grstglilds gathttaipv hdgyvlqqgi vksplagdfi tmqcrelfqe mnielvppym
 181 iaskeavreg spanwkrkek lpqvtrswhn ymcncvigdf qasvlqvsds tydeqvaaqm
```

TABLE 1-continued

```
 241 ptvhyefpng yncdfgaerl kipeglfdps nvkglsgntm lgvshvvtts vgmcdidirp
 301 glygsvivag gntliqsftd rlnrelsqkt ppsmrlklia nnttverrfs swiggsilas
 361 lgtfqqmwis kqeyeeggkq cverkcp
```

SEQ ID NO: 136 Mouse ACTL6A cDNA Sequence (NM_019673.2; CDS: 311-1600)

```
   1 cttcttctgt cgcttctccc tctccctgcc cctacggatg ccttccattg gctaagacgg
  61 ctaaaccgcg cggggatgca gcagcgccac actctgattg gctaatgact aagccggacc
 121 ctttgtcatt ggttgatacg agaaaccagc aagagtggct gtgcagcggg cgtgcggccg
 181 ctgctttgtt gccggagggg gcggcgttgg aagttgcagg cttgcggggc cggcgttctc
 241 agggagagga gtcacgccgc tgttatcttt cgtccggtag tcttcggcca gtccccgcca
 301 gacagtagcc atgagcggcg gcgtgtacgg cggagatgaa gttggcgctc ttgtttttga
 361 cattggatcg tacacagtga gggctggcta tgctggcgag gactgcccta aggttgattt
 421 ccccacggct atcggtgtgg tgctggagag agatgacgga agtacaatga tggagattga
 481 tggtgacaaa ggcaagcagg gcgggcccac ctactacata gacaccaatg ccctccgcgt
 541 gcccagggag aacatggagg ccatctcacc actcaagaat ggcatggttg aagactggga
 601 tagtttccag gccattttgg atcatacata caagatgcat gtcaaatccg aagccagcct
 661 gcatcctgtt ctcatgtcgg aagcaccgtg gaacaccagg gcgaagagag agaaactgac
 721 agagttgatg tttgagcact acagcatccc tgcattcttc ctttgcaaaa ctgcagtttt
 781 gacggcattt gctaatggtc gttctactgg gctgattttg gacagtggag ctacccacac
 841 cactgcgatt ccagtccacg atggctatgt tcttcaacaa ggcattgtga aatcccctct
 901 ggctggagac ttcattacca tgcagtgcag agaactcttc caggaaatga acatagaact
 961 cattcctcct tacatgattg catcaaaaga ggctgttcga gaaggttctc cagccaactg
1021 gaaaagaaaa gagaaactgc cccaggttac aaggtcttgg cacaattaca tgtgcaactg
1081 cgtcatccag gattttcaag cttccgttct tcaggtgtca gactccacct acgacgaaca
1141 agtggctgca cagatgccaa ccgtccacta cgaattcccc aatggctaca actgtgattt
1201 tggggcagag cggctgaaaa ttcctgaagg gttatttgac ccttccaacg taaagggact
1261 gtctgggaac acgatgctgg gagtcagtca cgttgtcaca accagcgtcg gaatgtgtga
1321 catcgacatc agaccaggtc tctacggcag tgtgatcgta gcaggaggaa acacgctaat
1381 acagagtttc actgacaggt taaatagaga gctttctcag aaaactccac caagtatgcg
1441 gttgaaactg attgcaaaca acacgacggt ggagcggagg ttcagctcat ggattggtgg
1501 ctctatccta gcatctttgg gtacctttca acagatgtgg atttctaaac aggaatatga
1561 agaaggaggg aagcagtgtg tagaaagaaa atgcccttga gggctccacc ctgcctgccc
1621 gtcacctcaa cgtctgtagc tttagtacac tcaggaaaag atgaccatct tttgtagaat
1681 gtttatacat gtttgcatat ttcaatttcc acttaaattt tttaaggctt taactggctc
1741 tataaattaa atgagtttgt gctttccttg aaatgcactt attcttatta caggcatttt
1801 ataattttgt atgaatgtct attttctcta aatattttgc tttcagtaag tactctccag
1861 ctctcctggg ggttggttgg tggaattact ctgtattgac aagtacaagt tactgcctat
1921 gctttgtacc ttaggctaca aaactaaata aaaatcacta ctgtcctag
```

SEQ ID NO: 137 Mouse ACTL6A Amino Acid Sequence (NP_062647.2)

```
   1 msggvyggde vgalvfdigs ytvragyage dcpkvdfpta igvvlerddg stmmeidgdk
  61 gkqggptyyi dtnalrvpre nmeaisplkn gmvedwdsfq aildhtykmh vkseaslhpv
 121 lmseapwntr akrekltelm fehysipaff lcktavltaf angrstglil dsgathttai
 181 pvhdgyvlqq givksplagd fitmqcrelf qemnielipp ymiaskeavr egspanwkrk
 241 eklpqvtrsw hnymcncviq dfgasvlqvs dstydeqvaa qmptvhyefp ngyncdfgae
 301 rlkipeglfd psnvkglsgn tmlgvshvvt tsvgmcdidi rpglygsviv aggntliqsf
 361 tdrinrelsq ktppsmilkl iannttverr fsswiggsil aslgtfqqmw iskqeyeegg
 421 kqcverkcp
```

SEQ ID NO: 138 Human β-Actin cDNA Sequence (NM_001101.4; CDS: 193-1320)

```
   1 gagtgagcgg cgcggggcca atcagcgtgc gccgttccga aagttgcctt ttatggctcg
  61 agcggccgcg gcggcgccct ataaaaccca gcggcgcgac gcgccaccac cgccgagacc
 121 gcgtccgccc cgcgagcaca gagcctcgcc tttgccgatc cgccgcccgt ccacacccgc
 181 cgccagctca ccatggatga tgatatcgcc gcgctcgtcg tcgacaacgg ctccggcatg
 241 tgcaaggccg gcttcgcggg cgacgatgcc ccccgggccg tcttcccctc catcgtgggg
 301 cgccccaggc accagggcgt gatggtgggc atgggtcaga aggattccta tgtgggcgac
 361 gaggcccaga gcaagagagg catcctcacc ctgaagtacc ccatcgagca cggcatcgtc
 421 accaactggg acgacatgga gaaaatctgg caccacacct tctacaatga gctgcgtgtg
 481 gctcccgagg agcaccccgt gctgctgacc gaggcccccc tgaaccccaa ggccaaccgc
 541 gagaagatga cccagatcat gtttgagacc ttcaacaccc cagccatgta cgttgctatc
 601 caggctgtgc tatccctgta cgcctctggc cgtaccactg gcatcgtgat ggactccggt
 661 gacggggtca cccacactgt gcccatctac gaggggtatg ccctccccca tgccatcctg
 721 cgtctggacc tggctggccg ggacctgact gactacctca tgaagatcct caccgagcgc
 781 ggctacagct tcaccaccac ggccgagcgg gaaatcgtgc gtgacattaa ggagaagctg
 841 tgctacgtcg ccctggactt cgagcaagag atggccacgg ctgcttccag ctcctccctg
 901 gagaagagct acgagctgcc tgacggccag gtcatcacca ttggcaatga gcggttccgc
 961 tgccctgagg cactcttcca gccttccttc ctgggcatgg agtcctgtgg catccacgaa
1021 actaccttca actccatcat gaagtgtgac gtggacatcc gcaaagacct gtacgccaac
1081 acagtgctgt ctggcggcac caccatgtac cctggcattg ccgacaggat gcagaaggag
1141 atcactgccc tggcacccag cacaatgaag atcaagatca ttgctcctcc tgagcgcaag
1201 tactccgtgt ggatcggcgg ctccatcctg gcctcgctgt ccaccttcca gcagatgtgg
1261 atcagcaagc aggagtatga cgagtccggc ccctccatcg tccaccgcaa atgcttctag
1321 gcggactatg acttagttgc gttacaccct ttcttgacaa aacctaactt gcgcagaaaa
1381 caagatgaga ttggcatggc tttatttgtt ttttttgttt tgttttggtt tttttttttt
1441 ttttggcttg actcaggatt taaaaactgg aacggtgaag gtgacagcag tcggttggag
1501 cgagcatccc ccaaagttca caatgtggcc gaggactttg attgcacatt gttgtttttt
1561 taatagtcat tccaaatatg agatgcgttg ttacaggaag tcccttgcca tcctaaaagc
1621 caccccactt ctctctaagg agaatggccc agtcctctcc caagtccaca caggggaggt
1681 gatagcattg ctttcgtgta aattatgtaa tgcaaaattt ttttaatctt cgccttaata
1741 ctttttttatt ttgttttatt ttgaatgatg agccttcgtg cccccccttc cccctttttt
```

TABLE 1-continued

```
1801 gtcccccaac ttgagatgta tgaaggcttt tggtctccct gggagtgggt ggaggcagcc
1861 agggcttacc tgtacactga cttgagacca gttgaataaa agtgcacacc ttaaaaatga
1921 ggaaaaaaaa aaaaaaaaaa
```

SEQ ID NO: 139 Human β-Actin Amino Acid Sequence (NP_001092.1)

```
  1 mdddiaalvv dngsgmckag fagddaprav fpsivgrprh qgvmvgmgqk dsyvgdeaqs
 61 krgiltlkyp iehgivtnwd dmekiwhhtf ynelrvapee hpvllteapl npkanrekmt
121 qimfetfntp amyvaiqavl slyasgrttg ivmdsgdgvt htvpiyegya lphailrldl
181 agrdltdylm kiltergysf tttaereivr dikeklcyva ldfeqemata assssleksy
241 elpdgqviti gnerfrcpea lfqpsflgme scgihettfn simkcdvdir kdlyantvls
301 ggttmypgia drmqkeital apstmkikii apperkysvw iggsilasls tfqqmwiskq
361 eydesgpsiv hrkcf
```

SEQ ID NO: 140 Mouse β-Actin cDNA Sequence (NM_007393.5; CDS: 110-1237)

```
   1 tataaaaccc ggcggcgcaa cgcgcagcca ctgtcgagtc gcgtccaccc gcgagcacag
  61 cttctttgca gctccttcgt tgccggtcca cacccgccac cagttcgcca tggatgacga
 121 tatcgctgcg ctggtcgtcg acaacggctc cggcatgtgc aaagccggct tcgcgggcga
 181 cgatgctccc cgggctgtat tcccctccat cgtgggccgc cctaggcacc agggtgtgat
 241 ggtgggaatg ggtcagaagg actcctatgt gggtgacgag gcccagagca agagaggtat
 301 cctgaccctg aagtacccca ttgaacatgg cattgttacc aactgggacg acatggagaa
 361 gatctggcac cacaccttct acaatgagct gcgtgtggcc cctgaggagc accctgtgct
 421 gctcaccgag gcccccctga accctaaggc caaccgtgaa aagatgaccc agatcatgtt
 481 tgagaccttc aacaccccag ccatgtacgt agccatccag gctgtgctgt ccctgtatgc
 541 ctctggtcgt accacaggca ttgtgatgga ctccggagac ggggtcaccc acactgtgcc
 601 catctacgag ggctatgctc tccctcacgc catcctgcgt ctggacctgg ctggccggga
 661 cctgacagac tacctcatga agatcctgac cgagcgtggc tacagcttca ccaccacagc
 721 tgagagggaa atcgtgcgtg acatcaaaga gaagctgtgc tatgttgctc tagacttcga
 781 gcaggagatg gccactgccg catcctcttc ctccctggag aagagctatg agctgcctga
 841 cggccaggtc atcactattg gcaacgagcg gttccgatgc cctgaggctc ttttccagcc
 901 ttccttcttg ggtatggaat cctgtggcat ccatgaaact acattcaatt ccatcatgaa
 961 gtgtgacgtt gacatccgta aagacctcta tgccaacaca gtgctgtctg gtggtaccac
1021 catgtaccca ggcattgctg acaggatgca gaaggagatt actgctctgg ctcctagcac
1081 catgaagatc aagatcattg ctcctcctga gcgcaagtac tctgtgtgga tcggtggctc
1141 catcctggcc tcactgtcca ccttccagca gatgtggatc agcaagcagg agtacgatga
1201 gtccggcccc tccatcgtgc accgcaagtg cttctaggcg gactgttact gagctgcgtt
1261 ttacaccctt tctttgacaa aacctaactt gcgcagaaaa aaaaaaaata agagacaaca
1321 ttggcatggc tttgtttttt taaatttttt ttaaagtttt tttttttttt tttttttttt
1381 tttttaagtt tttttgtttt gttttggcgc ttttgactca ggatttaaaa actggaacgg
1441 tgaaggcgac agcagttggt tggagcaaac atcccccaaa gttctacaaa tgtggctgag
1501 gactttgtac attgttttgt tttttttttt ttttggtttt gtcttttttt aatagtcatt
1561 ccaagtatcc atgaaataag tggttacagg aagtccctca ccctcccaaa agccaccccc
1621 actcctaaga ggaggatggt cgcgtccatg ccctgagtcc accccgggga aggtgacagc
1681 attgcttctg tgtaaattat gtactgcaaa aattttttta aatcttccgc cttaatactt
1741 cattttttgtt tttaatttct gaatggccca ggtctgaggc ctcccttttt tttgtccccc
1801 caacttgatg tatgaaggct ttggtctccc tgggaggggg ttgaggtgtt gaggcagcca
1861 gggctggcct gtacactgac ttgagaccaa taaaagtgca caccttacct tacacaaaca
1921 aaaaaaaaaa aaaaa
```

SEQ ID NO: 141 Mouse β-Actin Amino Acid Sequence (NP_031419.1)

```
  1 mdddiaalvv dngsgmckag fagddaprav fpsivgrprh qgvmvgmgqk dsyvgdeaqs
 61 krgiltlkyp iehgivtnwd dmekiwhhtf ynelrvapee hpvllteapl npkanrekmt
121 qimfetfntp amyvaigavl slyasgrttg ivmdsgdgvt htvpiyegya lphailrldl
181 agrdltdylm kiltergysf tttaereivr dikeklcyva ldfeqemata assssleksy
241 elpdgqviti gnerfrcpea lfqpsflgme scgihettfn simkcdvdir kdlyantvls
301 ggttmypgia drmqkeital apstmkikii apperkysvw iggsilasls tfqqmwiskq
361 eydesgpsiv hrkcf
```

SEQ ID NO: 142 Human BCL7A cDNA Sequence variant 1 (NM_020993.4;
CDS: 207-902)

```
   1 actgggccag gcgcgcggcg gccccgggct ttgtgtgtgt gtgtatgtgt gtgtgtgtgt
  61 gtgtgtgtgt gtgagtgtgt gcgtgtgaga gtgcgagtgt ctgtgcgcga gtgagtgagc
 121 ggcgggcggg cgcgagtgtg gccgccgcgg agcgcgagca ggacccggcg ggcgcgctcc
 181 ccagcctccg tctccccgcc ggaaccatgt cgggcaggtc ggttcgagcc gagacgagga
 241 gccgggccaa agatgatatc aagagggtca tggcggcgat cgagaaagtg cgcaaatggg
 301 agaagaaatg ggtgaccgtt ggtgacacat ccctacgaat ctacaaatgg gtccctgtga
 361 cggagcccaa ggttgatgac aaaaacaaga ataagaaaaa aggcaaggac gagaagtgtg
 421 gctcagaggt gaccactccg gagaacagtt cctccccagg gatgatggac atgcatgacg
 481 ataacagcaa ccagagctcc atcgcagatg cctcccccat caaacaggag aacagcagca
 541 actccagccc cgctccagag cccaactcgg ctgtgcccag cgacggcacc gaggccaagg
 601 tggatgaggc ccaggctgat gggaaggagc acccaggagc tgaagatgct tctgatgagc
 661 agaattcaca gtcctcgatg gaacattcga tgaacagctc agagaaagta gatcggcagc
 721 cgtctggaga ctcgggtctg gccgcagaga cgtctgcaat ctctcaggta cctcgctcga
 781 ggtctcagag gggcagccag atcggccggg agcccattgg gttgtcgggg gatttggaag
 841 gagtgccacc ctctaaaaag atgaaactgg aggcctctca acaaaactcc gaagagatgt
 901 agacgatgct ttaaagcctc cgatccatgt tccatggaag gtacatcagc aattaattct
 961 agagcaactt tgccccagcg attcctcttg ggtgcgaaca gaactactaa cgtttcaagt
1021 ttaccaagtg caaatccaag aagacccaga acggcgtcac ttctcagaca ctgaagaact
1081 ctgctgtgaa gcaaaacact caaacccttta agggactgtc cttggggagg caggcggggc
1141 tgacagctca ggagtgtctg cacactgtct cggaagccag gattccattt gtgttgctgc
1201 tgtattttcc ccccacttct ctatgtaacg atataagcta tcggagggtg gtaccgatca
```

TABLE 1-continued

```
1261 ggaacgcttt ttggcggggc tttccactgt tcaaccgatt ccttccgctt tcttttttg
1321 tgccttgtgc ccttgaggtg acctctggca tgtatcctgg tggttcttac atccccctct
1381 gcaaagtgcc ctcttggttt ggttcgggcg gcggctgcca ccctactcac cgctctcctc
1441 cctgccccag gacttcatcg gagcaggcag ggtggagcga aggagctcct tagcccacct
1501 ggtttgcagg tgcaggggga ccttaggcac gccccaagca ccaggcacca gggcccaagg
1561 acgcgcaggt gttggggcac agtccccaag ggctcggccc cttggatcag gctgggcact
1621 cgctgtgctc tcccctcctt ggggcgttta ggactgggcg tctccaagcc caccatggcc
1681 cagatggacg tgcaaagccc ttggaatttt ctggcacttc ctctctattg cccccaccac
1741 caccaccccc atcactgctt tctcccagac ctccgaatac gaaatggctt ctctggctga
1801 ctgcaaggct gtctccttaa ggcactgagt gggccgggga ggctgggagc cggcggcagg
1861 attagctggt gctgaacttt ctctcatagg acgtcgcttg gatttcaaat ccacggtcac
1921 ctgctgccct ttgcctcccc cgacgcccca gcctgtgccc cggagaggca ggatcgcagt
1981 ggtcagaatc cacgtgcttt cctattctca ggctgttctg actctgagcc aacagctgga
2041 ccgtgtctca tccccagaac atgccgtctg tccccaccgg ggagtgggcc ttgatggccg
2101 ggcctcgaag gccacaaaca aggcgtcgag gaattggaaa gatttgcaca ccctccagaa
2161 aggagagacg caatctcccc tccctcccat cccccacctt cgctggaaca gcttcctctc
2221 actgaacgga gacgccccct tggacgaact gcctaatcgt ttggttctga ggcctggttt
2281 gctcttaatt aatatatgaa ctcctcagac cttaaacctt ttcctaagct ttctttactg
2341 cactggagtt ctgactccct ttgagttgtg tgttactggg ggtggggtgg ggtcatgggt
2401 tttgttgttt ttgggggcta attggtgcat attcaggtac cacctttgac gtgtggctct
2461 ttctcctgac catcatggga agtgtctgct ggattccatt ttctaagagt ttctgagggt
2521 gaggctctta tttttttttt taagggatcc tgtctatttc ctgcacttcg agaagaatca
2581 aaatgttcct gaatttcaaa tacctcatgc aaaatgtctc ctgaaataag ggaaaaaaaa
2641 aaaaccacaa ctttgaaaat cttaatgttg aagttagcaa tgccgaaagg tttctgtctt
2701 aaaaaaaaaa atccttgtac ttatcaattt tgccccttag gcagtcagtt ttgttgagaa
2761 ctgtgtcctg catcctggcg cagaacctac ctgatgcggt tcctctccac gcatctcgag
2821 gcggcgttac ctccagattc cgtagagtta gagtcacatt tttctttgca gcgaaactcc
2881 atcttggtga gagatgaatt tggatattta tttccttctc tgtttttggg aaacgagagg
2941 ctacaaccaa gacagctgaa ggagaatgaa acacacacat ccacagaaac agagaggcgt
3001 aggtggccct gccgttgacc gcagcctctc tggacaggca aggggagttg gcgcaggtga
3061 ggactcagac gacgtccacc gtcccaaggc tgtcactagt atttctctga agtgcctgaa
3121 ggtaggaatg ggccggcgat tgggaccagc tgggccccac cacggccacg ccaggcaaag
3181 cgccagcagc cctgcactcc acgctggcca agaaggcctt ccacgcagaa tgacaagact
3241 gcaaaaatcc gatgtgcttc cttccctggc gcagtcgctc ctcgagccgc tgccccccac
3301 ccaccctgca cccctcgccc tccccccacc acagaatcta agacctttca gcttcgagcc
3361 agggggcggg ggatcccgag caaaagcctt ccgtggacat caggccccgt ggcctcaagg
3421 gctcccaggg caaacctaat tccccccaaa acgtgaagtc ggggaagctg cggctacaca
3481 ttccacaaag tgctggcact tacacccaca acccggaagg ctgtggaccg attcctctag
3541 ggtggtgacc tcccattagc aaacggtgtc atggtttgga atgttcatta tcgccaagaa
3601 cctggttaga ggcataaaga cctttttttca ccgttaccta attttttccc ctttcaagaa
3661 tttttttttt ttttggtgtg ttgtacagca gtataatttt tcacttattt attccatcag
3721 tagatatggt ttgtacaatg tacaattgtt tcatttcaga aaataaaaat ttcaaatcat
3781 gaa
```

SEQ ID NO: 143 Human BCL7A Amino Acid Sequence isoform A (NP_066273.1)

```
  1 msgrsvraet rsrakddikr vmaaiekvrk wekkwvtvgd tslriykwvp vtepkvddkn
 61 knkkkgkdek cgsevttpen ssspgmmdmh ddnsnqssia daspikqens snsspapepn
121 savpsdgtea kvdeaqadgk ehpgaedasd eqnsgssmeh smnssekvdr qpsgdsglaa
181 etsaisqvpr srsqrgsqig repiglsgdl egvppskkmk leasqqnsee m
```

SEQ ID NO: 144 Human BCL7A cDNA Sequence variant 2 (NM_001024808.2; CDS: 207-839)

```
   1 actgggccag gcgcgcggcg gccccgggct ttgtgtgtgt gtgtatgtgt gtgtgtgtgt
  61 gtgtgtgtgt gtgagtgtgt gcgtgtgaga gtgcgagtgt ctgtgcgcga gtgagtgagc
 121 ggcgggcggg cgcgagtgtg gccgccgcgg agcgcgagca ggacccggcg ggcgcgctcc
 181 ccagcctccg tctccccgcc ggaaccatgt cgggcaggtc ggttcgagcc gagacgagga
 241 gccgggccaa agatgatatc aagagggtca tggcggcgat cgagaaagtg cgcaaatggg
 301 agaagaaatg ggtgaccgtt ggtgacacat ccctacgaat ctacaaatgg gtccctgtga
 361 cggagcccaa ggttgatgac aaaaacaaga ataagaaaaa aggcaaggac gagaagtgtg
 421 gctcagaggt gaccactccg gagaacagtt cctccccagg gatgatggac atgcatgacg
 481 ataacagcaa ccagagctcc atcgcagatg cctccccccat caaacaggag aacagcagca
 541 actccagccc cgctccagag cccaactcgg ctgtgcccag cgacggcacc gaggccaagg
 601 tggatgaggc ccaggctgat gggaaggagc acccaggagc tgaagatgct tctgatgagc
 661 agaattcaca gtcctcgatg gaacattcga tgaacagctc agagaaagta gatcggcagc
 721 cgtctggaga ctcgggtctg gccgcagaga cgtctgcaat ctctcaggat ttggaaggag
 781 tgccaccctc taaaaagatg aaactggagg cctctcaaca aaactccgaa gagatgtaga
 841 cgatgcttta aagcctccga tccatgttcc atggaaggta catcagcaat taattctaga
 901 gcaactttgc cccagcgatt cctcttgggt gcgaacagaa ctactaacgt ttcaagttta
 961 ccaagtgcaa atccaagaag acccagaacg gcgtcacttc tcagacactg aagaactctg
1021 ctgtgaagca aaacactcaa acctttaagg gactgtcctt ggggaggcag gcggggctga
1081 cagctcagga gtgtctgcac actgtctcgg aagccaggat tccatttgtg ttgctgctgt
1141 attttccccc cacttctcta tgtaacgata taagctatcg gagggtggta ccgatcagga
1201 acgcttttttg gcggggcttt ccactgttca accgattcct tccgctttct tttttgtgc
1261 cttgtgccct tgaggtgacc tctggcatgt atcctggtgg ttcttacatc cccctctgca
1321 aagtgccctc ttggtttggt tcgggcggcg gctgccaccc tactcaccgc tctcctccct
1381 gccccaggac ttcatcggag caggcagggt ggagcgaagg agctccttag cccacctggt
1441 ttgcaggtgc agggggacct taggcacgcc ccaagcacca ggcaccaggg cccaaggacg
1501 cgcaggtgtt ggggcacagt ccccaagggc tcggcccctt ggatcaggct gggcactcgc
1561 tgtgctctcc cctccttggg gcgtttagga ctgggcgtct ccaagcccac catggcccag
1621 atggacgtgc aaagcccttg gaattttctg gcacttcctc tctattgccc ccaccaccac
```

TABLE 1-continued

```
1681 caccccccatc actgctttct cccagacctc cgaatacgaa atggcttctc tggctgactg
1741 caaggctgtc tccttaaggc actgagtggg ccggggaggc tgggagccgg cggcaggatt
1801 agctggtgct gaactttctc tcataggacg tcgcttggat ttcaaatcca cggtcacctg
1861 ctgccctttg cctcccccga cgccccagcc tgtgccccgg agaggcagga tcgcagtggt
1921 cagaatccac gtgctttcct attctcaggc tgttctgact ctgagccaac agctggaccg
1981 tgtctcatcc ccagaacatg ccgtctgtcc ccaccgggga gtgggccttg atggccgggc
2041 ctcgaaggcc acaaacaagg cgtcgaggaa ttggaaagat ttgcacaccc tccagaaagg
2101 agagacgcaa tctcccctcc ctcccatccc ccaccttcgc tggaacagct tcctctcact
2161 gaacggagac gccccccttgg acgaactgcc taatcgtttg gttctgaggc ctggtttgct
2221 cttaattaat atatgaactc ctcagacctt aaacctttttc ctaagctttc tttactgcac
2281 tggagttctg actccctttg agttgtgtgt tactgggggt ggggtggggt catgggtttt
2341 gttgtttttg ggggctaatt ggtgcatatt caggtaccac ctttgacgtg tggctctttc
2401 tcctgaccat catgggaagt gtctgctgga ttccattttc taagagtttc tgagggtgag
2461 gctcttattt ttttttttaa gggatcctgt ctatttcctg cacttcgaga agaatcaaaa
2521 tgttcctgaa tttcaaatac ctcatgcaaa atgtctcctg aaataaggga aaaaaaaaaa
2581 accacaactt tgaaaatctt aatgttgaag ttagcaatgc cgaaaggttt ctgtcttaaa
2641 aaaaaaaatc cttgtactta tcaattttgc cccttaggca gtcagttttg ttgagaactg
2701 tgtcctgcat cctggcgcag aacctacctg atgcggttcc tctccacgca tctcgaggcg
2761 gcgttacctc cagattccgt agagttagag tcacattttt ctttgcagcg aaactccatc
2821 ttggtgagag atgaatttgg atatttattt ccttctctgt ttttgggaaa cgagaggcta
2881 caaccaagac agctgaagga gaatgaaaca cacacatcca cagaaacaga gaggcgtagg
2941 tggccctgcc gttgaccgca gcctctctgg acaggcaagg ggagttggcg caggtgagga
3001 ctcagacgac gtccaccgtc ccaaggctgt cactagtatt tctctgaagt gcctgaaggt
3061 aggaatgggc cggcgattgg gaccagctgg gccccaccac ggccacgcca ggcaaagcgc
3121 cagcagccct gcactccacg ctggccaaga aggccttcca cgcagaatga caagactgca
3181 aaaatccgat gtgcttcctt ccctggcgca gtcgctcctc gagccgctgc cccccaccca
3241 ccctgcaccc ctcgccctcc ccccaccaca gaatctaaga cctttcagct tcgagccagg
3301 gggcggggga tcccgagcaa aagccttccg tggacatcag gccccgtggc ctcaagggct
3361 cccagggcaa acctaattcc ccccaaaacg tgaagtcggg gaagctgcgg ctacacattc
3421 cacaaagtgc tggcacttac acccacaacc cggaaggctg tggaccgatt cctctagggt
3481 ggtgacctcc cattagcaaa cggtgtcatg gtttggaatg ttcattatcg ccaagaacct
3541 ggttagaggc ataaagacct tttttcaccg ttacctaatt ttttcccctt tcaagaattt
3601 tttttttttt tggtgtgttg tacagcagta taatttttca cttatttatt ccatcagtag
3661 atatggtttg tacaatgtac aattgtttca tttcagaaaa taaaaatttc aaatcatgaa
```

SEQ ID NO: 145 Human BCL7A Amino Acid Sequence isoform B (NP_001019979.1)

```
  1 msgrsvraet rsrakddikr vmaaiekvrk wekkwvtvgd tslriykwvp vtepkvddkn
 61 knkkkgkdek cgsevttpen ssspgmmdmh ddnsnqssia daspikqens snsspapepn
121 savpsdgtea kvdeaqadgk ehpgaedasd eqnsgssmeh smnssekvdr qpsgdsglaa
181 etsaisqdle gvppskkmkl easqqnseem
```

SEQ ID NO: 146 Mouse BCL7A cDNA Sequence (NM_029850.3; CDS: 183-815)

```
   1 ttgcgcactg ggccccgggc gcgcggcggc accaggcttt gtgtgtgcgc gtatgtgtgt
  61 gagtgtgtgt ctgtgcgcga gtgagagagc gggcgagtgt ggcgagcagg acccggcggg
 121 cgcgctcccc cagcctccct ctctctctct ctttcctctc tctctccctc cccgccagaa
 181 ccatgtcggg caggtcggtt cgagccgaga ccaggagccg ggccaaagat gatatcaaga
 241 gggtcatggc ggctatcgag aaagtgcgca aatgggagaa gaaatgggtg accgttggcg
 301 atacatccct acgaatctac aagtgggtcc ctgtgacgga gccaaaggtt gatgataaaa
 361 acaagaacaa gaagaaaggc aaggacgaga agtgtggctc ggaggtgacc actccagaga
 421 acagctcgtc tcctgggatg atggacatgc acgatgataa cagcaaccag agctccatag
 481 cagacgcctc cccatcaag caagagaaca gcagcaactc cagccctgcc ccagagacca
 541 acccacccgt gcccagcgat ggcaccgaag ccaaggctga tgaggcgcag gccgatggaa
 601 aagagcaccc tggagctgaa gatgcatccg aggagcaaaa ttcacagtct tcgatggaaa
 661 actcggtgaa cagctccgag aaggcagaac ggcagccatc tgcagaatca gggttagcgg
 721 cagaaacgtc ggcagtctct caggatttgg aaggagtgcc gccgtctaaa aagatgaagc
 781 tggaagcctc tcaacagaac tcagaagaga tgtagacggc ccggcggaac cttctggtcc
 841 atgtttcatg gcaggtacat cggcaggctt aattctagaa acacggccca agcgactcct
 901 cttgggcgcg agcagaacta acgtttcaag tttactaaag tgcaaatcca agaagaacct
 961 agagcggcgg cggcagcgga acttcgcaga cacttgacgg actctgccgt gaaaccgaaa
1021 cactcgaacc ttcaagtgac tgccctctgg gaggtgggtc gacagctcag gagtgtgtgc
1081 gcactgtctc ggaagccaag attacatttg tgttgctgct gtatccccct cccctcactt
1141 ctctatttaa cgatataagc tattcgaggg tggtaccaat caggaatttg ctttccatag
1201 gggcttttgg ctcttcaacc aattccttct gctttctttt tttgtgcctt gtaccctaga
1261 ggtgacctcc ggcatgcttc ctggtttttg catctctcct ggcaaagtgc ccacttgttt
1321 tggttggctg ctgcccccac ccccacccct tattgcctct ctcctccctg ccccaagact
1381 gcttcaaagc aagcagggta gagcggcggg agaccaggca cctttcagtg accccccttgg
1441 ttcaggtgag cagtgtttgg gcacaccctg agccccaact tccagggccc ctggggctac
1501 aagtttgcgg gggccggttt cccgagggct ggcctccttg gtcaggacac gccctcacct
1561 tttggagcca tggaggctag gcgtttgcaa ggcaaggtag cccagattga catgcaaaag
1621 cctttagatt tttctggcac ttccacccta tctcccctcc gccccctaac ctcacacccc
1681 gactctggcc acaactggca ctgcgctctc caggtcctcc gaagacgaaa tgaccaactg
1741 agcttgtctc cttaggatag taaagggctg ggaggttggg agccggcggc cggcaggaat
1801 agctggtgct gaactaactc tcccatagga cattgcttgg atttcaaatc catggtaacc
1861 tgctgccctt tgtccctgtc tcctatccac cgcaccccaa gccccccaaa accccaggca
1921 ggatgcgcct ggtatggcct gactctgaga ggctacaggt ggatggagac ccattcccag
1981 taccgcgctg ttggtctcct ctggggaccg gaccttaacc attgggcctc aggccagaag
2041 caaggcacag aggaaccggg aagatttgca cacagatttg cccccccaga aaggagcctc
2101 cgaggcactt ccttcccctg ctcttccttg cacggagaca gctctctctc actcagtgga
2161 gacgccactt ggacagacgg actgctcagc tgttgatttc tgaggcctgg tttgctctta
2221 atccctttgc tggacccctc agatctgaaa accttcccct atgctttctt actgcactgg
```

TABLE 1-continued

```
2281 agttcgaact ccctatgagt tgtgtgttgg ggggaggggc gggcggggtg ggttttgttt
2341 ttttgttgtt cttgtttcgt tttgtttcgt ttgctaattg gtgcatattc aggtaccacc
2401 ttttgacgtg tggatctttc tccaaaccac cacaagaagt gtctgccggg ctccgttttc
2461 taagagtttc tgaggggaca gctcccattt cttttttggg tttcaaggga gctgtctatt
2521 tcctatactt caagaagaat caaaatgttc ctgaatttta aatacctcat gcaaaaatat
2581 ctcctgaaat aagggaaaaa aaaaaaactt tgaaaaatcg taatgttgaa gttagcgatg
2641 ctaaaatgtt tctgtcttaa aaaacaaaaa aattgttgta atacttagcg attttgcccc
2701 tcaggcggtc agttctgtcc agaactgtgt tctgcgtctt ggcccggaag caaccggatg
2761 catgacctct gaacggatct caaggccaag gcatctttac ctccagattc tagagttagg
2821 gcaacaacag ttttcttttg cagcaaaact ccgttctggt gaaagatgaa tttggatatt
2881 tatttctttt tctgggaaac aagaggttaa acaacgtaag cagctgaggg agaacccaac
2941 acgggcatcc acggaaccag cgggcgcggc cagggccgcc tatacctctt ctaccctccg
3001 cagcctctct ggacagtcag gaggagtcga tacagttgag aaagaagaca acgatgaggt
3061 tcgaggtacc gaggctgtca ttagtttttc tctgaagtgc ctgaacgtag gaatgggccg
3121 tcgacggagg ggaccattcg gatgttcccc cacctcgcga cggccgcgcc aggcaaagag
3181 ccagcagccc tgcactccac actggccagg aaaagccttc cacgaggagc ggtcagactg
3241 caaaatccaa tgtgcttcct tccccgccac ggtcctctct ctctctcggg gagccgatgg
3301 tccccgtccc tgaacccccct agcccgcatc cccaccacag aatctaagac ctttcatctg
3361 gccgagccag gggcaaaggg gatcctaagc aaatgccttc cgtggacaac aggccccacg
3421 gcctaaaggg ctcccagggc aaactttccc ccaacacttg aagggggtg gggggatgg
3481 cggctacaca ttccactaag tgcagcactc gcacccacaa cccggaagga aggctcttaa
3541 gcgattctca gagggtggtg actgcccatc atcgtcagac ggtgtcgtgg tttggaatgt
3601 taattatcgc agaggacctg gtagaggtat aaagaccttt tttcactgtt acctaatttt
3661 ttttttcctc ttacaatttt ttttttggtg tgttgtacag cagtataatt tttcacttat
3721 ttattccatc ggtagatatt gtttgtacaa tgtacaatgg tttcatttca gaaaataata
3781 ataataaaaa aaaaagttct gatcatgag
```

SEQ ID NO: 147 Mouse BCL7A Amino Acid Sequence (NP_084126.1)

```
  1 msgrsvraet rsrakddikr vmaaiekvrk wekkwvtvgd tslriykwvp vtepkvddkn
 61 knkkkgkdek cgsevttpen sssipgmmdmh ddnsnqssia daspikqens snsspapetn
121 ppvpsdgtea kadeaqadgk ehpgaedase eqnsgssmen svnsssekaer qpsaesglaa
181 etsaysqdle gvppskkmkl easqqnseem
```

SEQ ID NO: 148 Human BCL7B cDNA Sequence variant 1 (NM_001707.3; CDS: 158-766)

```
   1 gcgggcgggt gcgcgcgctt tctcgcgcac gcgcgcacgg agggggcgac ggccgctgtg
  61 acgctgcggc ggcggcgggc gggcggcggc gcgtgaggcg cgcgatcccc ggtgtcttgg
 121 gagcagtgcc ccggcccccg ccgctcccgc cgccgccatg tcgggccggt cggtccgggc
 181 ggagacccgc agccgggcca aggacgacat caagaaggtg atggcggcca tcgagaaagt
 241 gcggaaatgg gagaagaagt gggtgactgt gggtgacacg tccctgagga tatttaagtg
 301 ggttcctgtg acagacagca aggagaaaga aaagtcaaaa tcgaacagtt cagcagcccg
 361 agaacctaat ggctttcctt ctgatgcctc agccaattcc tctctccttc ttgaattcca
 421 ggacgaaaac agcaaccaga gttccgtgtc tgacgtctat cagcttaagg tggacagcag
 481 caccaactca agccccagcc cccagcagag tgagtccctg agcccagcac acacctccga
 541 cttccgcacg gatgactccc agcccccaac gctgggccag gagatcctgg aggagccctc
 601 cctgccctcc tcggaagttg ctgatgaacc tcctaccctc accaaggaag aaccagttcc
 661 actagagaca caggtcgttg aggaagagga agactcaggt gccccgcccc tgaagcgctt
 721 ctgtgtggac caacccacag tgccgcagac ggcgtcagaa agctagcacc atcccggccc
 781 tccgcctcct ggccctgcct ctatttattg cattctggtt ctggccgcgc cgcgttgctg
 841 gggtaagggc aagcactggg gtcaagagcc tgcacacatg agccttccgg gctggaaggc
 901 tggcgtagga cttggggctg tagcatcatc ttcctgaccc tggcacctgt gtctacttgc
 961 tcccgagaag aggagcgctc atgtcttttt tgcaccccaa gttggctgga gcatcggcca
1021 ccccaagatt catctgtgac ctccaggcag cagtctctgc tccagaatct ctggacggag
1081 ctgctggcag cttctgcgag aagagagaga tgtggaaggc accttctaga agagagcgtg
1141 cctcaggtta cttgaacttg aacggagact gtagactccc ggactttccc ctaggactgg
1201 gggccctgta ggctgctgtt ggaggactgg gtagagacat tggagggaag ggaagggctt
1261 ttctccacac aagggcagag agtccgtcta gatttcttgc tgtcctgcca gctctgccca
1321 tgcctgaggt ggtcctacct ctcacgggca ccctagctgc tgacagccct ttgtggccgc
1381 cgtccccatc ccctgccctc agcacacaca tctgcacaca cgcagctttg ttctcacctc
1441 tacctgtcat tccagcatcc ctgcctcttg tcacaaactg ccccagcaag aatttgaggt
1501 tctgacaaca gtacccatcc cccacagtac cccttcagct cagtttctag aaagctccct
1561 tttctttgaa atctgcatgt tgaattgaac tttgtgattt tattttttgt ttcaaaaaag
1621 tttaagaaaa tggaaatggg caacagtgag tgaagacata ttttagcact gaatagaata
1681 tttttaaaat taaactattt gaaatatgtc caaaaaaaaa aaaaaaaaa
```

SEQ ID NO: 149 Human BCL7B Amino Acid Sequence isoform 1 (NP_001698.2)

```
  1 msgrsvraet rsrakddikk vmaaiekvrk wekkwvtvgd tslrifkwvp vtdskekeks
 61 ksnssaarep ngfpsdasan sslllefqde nsnqssysdv yqlkvdsstn sspspqqses
121 lspahtsdfr tddsqpptlg qeileepslp ssevadeppt ltkeepvple tqvveeeeds
181 gapplkrfcv dqptvpqtas es
```

SEQ ID NO: 150 Human BCL7B cDNA Sequence variant 2 (NM_001197244.1; CDS: 158-595)

```
  1 gcgggcgggt gcgcgcgctt tctcgcgcac gcgcgcacgg agggggcgac ggccgctgtg
 61 acgctgcggc ggcggcgggc gggcggcggc gcgtgaggcg cgcgatcccc ggtgtcttgg
121 gagcagtgcc ccggcccccg ccgctcccgc cgccgccatg tcgggccggt cggtccgggc
181 ggagacccgc agccgggcca aggacgacat caagaaggtg atggcggcca tcgagaaagt
241 gcggaaatgg gagaagaagt gggtgactgt gggtgacacg tccctgagga tatttaagtg
301 ggttcctgtg acagacagca aggagaaaga aaagtcaaaa tcgaacagtt cagcagcccg
361 agaacctaat ggctttcctt ctgatgcctc agccaattcc tctctccttc ttgaattcca
```

TABLE 1-continued

```
 421 ggagccctcc ctgccctcct cggaagttgc tgatgaacct cctaccctca ccaaggaaga
 481 accagttcca ctagagacac aggtcgttga ggaagaggaa gactcaggtg ccccgcccct
 541 gaagcgcttc tgtgtggacc aacccacagt gccgcagacg gcgtcagaaa gctagcacca
 601 tcccggccct ccgcctcctg gccctgcctc tatttattgc attctggttc tggccgcgcc
 661 gcgttgctgg ggtaagggca agcactgggg tcaagagcct gcacacatga gccttccggg
 721 ctggaaggct ggcgtaggac ttggggctgt agcatcatct tcctgaccct ggcacctgtg
 781 tctacttgct cccgagaaga ggagcgctca tgtctttttt gcaccccaag ttggctggag
 841 catcggccac cccaagattc atctgtgacc tccaggcagc agtctctgct ccagaatctc
 901 tggacggagc tgctggcagc ttctgcgaga agagagagat gtggaaggca ccttctagaa
 961 gagagcgtgc ctcaggttac ttgaacttga acggagactg tagactcccg gactttcccc
1021 taggactggg ggccctgtag gctgctgttg gaggactggg tagagacatt ggagggaagg
1081 gaagggcttt tctccacaca agggcagaga gtccgtctag atttcttgct gtcctgccag
1141 ctctgcccat gcctgaggtg gtcctacctc tcacgggcac cctagctgct gacagccctt
1201 tgtggccgcc gtccccatcc cctgccctca gcacacacat ctgcacacac gcagctttgt
1261 tctcacctct acctgtcatt ccagcatccc tgcctcttgt cacaaactgc cccagcaaga
1321 atttgaggtt ctgacaacag tacccatccc ccacagtacc ccttcagctc agtttctaga
1381 aagctccctt ttctttgaaa tctgcatgtt gaattgaact ttgtgatttt attttttgtt
1441 tcaaaaaagt ttaagaaaat ggaaatgggc aacagtgagt gaagacatat tttagcactg
1501 aatagaatat ttttaaaatt aaactatttg aaatatgtcc aaaaaaaaaa aaaaaaa
```

SEQ ID NO: 151 Human BCL7B Amino Acid Sequence isoform 2 (NP_001184173.1)

```
  1 msgrsvraet rsrakddikk vmaaiekvrk wekkwvtvgd tslrifkwvp vtdskekeks
 61 ksnssaarep ngfpsdasan sslllefgep slpssevade pptltkeepv pletqvveee
121 edsgapplkr fcvdqptvpq tases
```

SEQ ID NO: 152 Human BCL7B cDNA Sequence variant 3 (NM_001301061.1; CDS: 247-888)

```
   1 gcgggcgggt gcgcgcgctt tctcgcgcac gcgcgcacgg agggggcgac ggccgctgtg
  61 acgctgcggc ggcggcgggc gggcggcggc gcgtgaggcg cgcgatcccc ggtgtcttgg
 121 gagcagtgcc ccggcccccg ccgctcccgc cgccgccatg tcgggccggt cggtccgggc
 181 ggagacccgc agccgggcca aggacgacat caagaaggtg atggcggcca tcgagaaagt
 241 gcggaaatga cggaatctcg ctctgtcacc caggctggag tgcattggcg caatctcggc
 301 tcactgcaac ctctgcctct caggttcaag caattctcct gcctcagcct cctgagtagc
 361 tgggactaca gggagaagaa gtgggtgact gtgggtgaca cgtccctgag gatatttaag
 421 tgggttcctg tgacagacag caaggagaaa gaaaagtcaa aatcgaacag ttcagcagcc
 481 cgagaaccta atggctttcc ttctgatgcc tcagccaatt cctctctcct tcttgaattc
 541 caggacgaaa acagcaacca gagttccgtg tctgacgtct atcagcttaa ggtggacagc
 601 agcaccaact caagccccag cccccagcag agtgagtccc tgagcccagc acacacctcc
 661 gacttccgca cggatgactc ccagccccca acgctgggcc aggagatcct ggaggagccc
 721 tccctgccct cctcggaagt tgctgatgaa cctcctaccc tcaccaagga agaaccagtt
 781 ccactagaga cacaggtcgt tgaggaagag gaagactcag gtgccccgcc cctgaagcgc
 841 ttctgtgtgg accaacccac agtgccgcag acggcgtcag aaagctagca ccatcccggc
 901 cctccgcctc ctggccctgc ctctatttat tgcattctgg ttctggccgc gccgcgttgc
 961 tggggtaagg gcaagcactg gggtcaagag cctgcacaca tgagccttcc gggctggaag
1021 gctggcgtag gacttggggc tgtagcatca tcttcctgac cctggcacct gtgtctactt
1081 gctcccgaga agaggagcgc tcatgtcttt tttgcacccc aagttggctg gagcatcggc
1141 caccccaaga ttcatctgtg acctccaggc agcagtctct gctccagaat ctctggacgg
1201 agctgctggc agcttctgcg agaagagaga gatgtggaag gcaccttcta gaagagagcg
1261 tgcctcaggt tacttgaact tgaacggaga ctgtagactc ccggactttc ccctaggact
1321 gggggccctg taggctgctg ttggaggact gggtagagac attggaggga agggaagggc
1381 ttttctccac acaagggcag agagtccgtc tagatttctt gctgtcctgc cagctctgcc
1441 catgcctgag gtggtcctac ctctcacggg caccctagct gctgacagcc ctttgtggcc
1501 gccgtcccca tcccctgccc tcagcacaca catctgcaca cacgcagctt tgttctcacc
1561 tctacctgtc attccagcat ccctgcctct tgtcacaaac tgccccagca agaatttgag
1621 gttctgacaa cagtacccat cccccacagt accccttcag ctcagtttct agaaagctcc
1681 cttttctttg aaatctgcat gttgaattga actttgtgat tttatttttt gtttcaaaaa
1741 agtttaagaa aatggaaatg ggcaacagtg agtgaagaca tattttagca ctgaatagaa
1801 tatttttaaa attaaactat ttgaaatatg tccaaaaaaa aaaaaaaaaa a
```

SEQ ID NO: 153 Human BCL7B Amino Acid Sequence isoform 3 (NP_001287990.1)

```
  1 mtesrsvtqa gvhwrnlgsl gplplrfkqf sclsllsswd yrekkwvtvg dtslrifkwv
 61 pvtdskekek sksnssaare pngfpsdasa nsslllefqd ensnqssysd vyqlkvdsst
121 nsspspqqse slspahtsdf rtddsqpptl ggeileepsl pssevadepp tltkeepvpl
181 etqvveeeed sgapplkrfc vdqptvpqta ses
```

SEQ ID NO: 154 Mouse BCL7B cDNA Sequence (NM_009745.2; CDS: 136-744)

```
  1 acgcgcgcac ggaggggggg cgacggccgc ggtgacgtgc tgcggtggca gcgggtggac
 61 ggcgacgcgt gaggcgcgtg atatcccgcg tcttgggagc actgtcccgg cccccagcca
121 ctccccgccg ccgccatgtc cggccgttcg gtccgggccg agacccgtag ccgggctaaa
181 gatgacatca agaaggtgat ggcggccatc gagaaagtgc ggaaatggga gaagaaatgg
241 gtgactgtgg gtgatacctc cctgaggata ttcaaatggg tgcctgtgac agatagcaag
301 gagaaagaaa agtcaaaatc gaataataca gcagcccggg aacctaatgg ctttccctct
361 gacgcctcag ccaattcctc cctcctcctt gaattccagg atgagaacag caaccagagc
421 tctgtgtcgg atgtctatca actcaaggtg gacagcagca ccaactcaag tcccagcccc
481 cagcagagcg agtccctgag cccagcacac acctcagact tccgcactga tgactcccag
541 ccccccacat tgggccagga gatcctggag gaaccttcgc tgcctgcatc tgaagttgca
601 gatgaacctc ccacactcac aaaggaagag ccagtgccgg tggagacaca gaccactgag
661 gaagaggagg actctggtgc tccgcccttg aagagattct gtgtggacca acctgtagta
721 ccgcagacca cgtcggaaag ctagcaccgt cctggcccct cgcctcctgg cccctgcctc
781 tatttattgc attctggtct ggccgagctc tgatgctggg gtccgggcaa gcactagggt
```

TABLE 1-continued

```
 841 ccagagcctg tgcgtgggag ccctctgggc tagaaggctg atggagggcg tggggtcgtc
 901 gcaccatctt cttgttcctg acacttgtgt ctgcttgctc ttgagcaaag gagcgctcac
 961 atcttttctg tagcccaagt aggccagagc atcagggttc atttctcacc tccagaacca
1021 ctgcacggag ctgctggcgc cgccacgggg agaaaggtgt ggaaggcgcc cacctgagag
1081 aagagtgcct aggattactt gaattgaatg gagactgtgg agtatggact ttgccacagg
1141 gccaggccct gcaggctgct gctgggagag ggactgaccg gtagagatgt ggagaacacc
1201 ggagagaggc tcttccggga cggaggggct ttcgccacct ttgggcagaa gacccatggg
1261 agatgcatcc tgtgcctgag gcagacctgc ctctgttgga tgccccagct gctcccagcc
1321 ctgtgcctgc cagaaccttc tgctgcatcc tcacactcac taagcacacc tgaagctttc
1381 tattcacccg tcctttcatt ccaacgtccc cacctcctcc tgcagaaaac cccagccatg
1441 attggaggtt ctgaccacag tacctgcccc agtactcctt cagctcagac tttctagaaa
1501 gttccttttt ctttaaaatc tgcatgttta attaaacttt atgattttat tttttgtctg
1561 aaaaaagaaa agtttaagaa aatggaaatg ggtaacagca agtgaagacc tattttagca
1621 ctgaatagag tatttttaaa attaaacttt gaaatatgtc ttgttaaaaa aaaaaaaa
```

SEQ ID NO: 155 Mouse BCL7B Amino Acid Sequence (NP_033875.2)

```
   1 msgrsvraet rsrakddikk vmaaiekvrk wekkwvtvgd tslrifkwvp vtdskekeks
  61 ksnntaarep ngfpsdasan sslllefqde nsnqssysdv yqlkvdsstn sspspqqses
 121 lspahtsdfr tddsqpptlg qeileepslp asevadeppt ltkeepvpve tqtteeeeds
 181 gapplkrfcv dqpvvpqtts es
```

SEQ ID NO: 156 Human BCL7C cDNA Sequence variant 1 (NM_001286526.1; CDS: 359-1087)

```
   1 tccgtcccca actcgcgcgt ccgtccccaa ctcccgctct cggcggcggg cagggggcgc
  61 tgagcgtcca ggcgctccaa gggggcgggc ccgggtcggg gcggggccgg ccgggcttcc
 121 aggcctgggc tctggccgcc cgcgccaccg ggccgctccg gggacaggcc ggggcggggc
 181 gcggcggcag gaaacggggc ggggacttgc ggaggcgttg gggacgagag agggcgcggc
 241 caactccagg ggggacggca ggccgagagc gcggcgcccg ggcctggcgc ggagcctgag
 301 cccgccggac gggaggcggc cccgccgcgg gctcggcccc ggccccagcc ccgccagcat
 361 ggccggccgg actgtacggg ccgagacccg gagccgggcc aaggatgaca tcaagaaggt
 421 gatggcgacc atcgagaagg tccggagatg ggagaagcga tgggtgactg tgggcgacac
 481 ttcccttcgt atcttcaagt gggtgccagt ggtggatccc caggaggagg agcgaaggcg
 541 ggcaggtggc ggggcagaga gatcccgtgg ccgggaacgt cggggcaggg gcgccagtcc
 601 ccgagggggt ggccctctca tcctgctgga tcttaatgat gagaacagca accagagttt
 661 ccattcggaa ggttccctgc aaaagggcac agagcccagt cctgggggca ccccccagcc
 721 cagccgccct gtgtcacctg ccggaccccc agaaggggtc cctgaggagg ctcagccccc
 781 acggctgggc caagagagag atcccggggg cataactgct ggcagcaccg acgaaccccc
 841 aatgctgacc aaggaggagc ctgttccaga actgctggaa gctgaggatt cgggagtgag
 901 aatgacgagg agagcccttc acgagaaggg gctgaagaca gagcccctca ggaggctcct
 961 gcccaggagg ggcctccgga caaatgtccg gcccagttcc atggcggtgc cggacaccag
1021 agctcccggg ggaggcagca aggccccgag ggcacccaga acaatccccc agggtaaggg
1081 gaggtgagtg ggctccccaa gcaagccaag acccctaaag cctcccttgg ctgccccaag
1141 atccagccac tacctgtgcc ccgagggcgg aaagagcttc ccagctcacc caccgcggta
1201 acatcggagg gcgagcggcc ccacacctgc ccgaacctaa ggccacagca cccatctggc
1261 tcgccactgg cgcccgaatg catgggaagg gcttagggca gaactcggac cacatccagt
1321 gcctgaggcc gccttgctag aggcctaggg gaggggtgca ctgggctgcc tcgcccacct
1381 cctcacgcac ccatgcggcc accctcccag cggtctgagt gtgccatgcg aggcgcctgc
1441 caccccggga gaggcgccga gtcccgagtc ctgccggcac tgagcctccg ggtccacagc
1501 gggcaagggc cgtggcgggg acaagcgcag gggacccgcc ggcctcccgc cttctgcagc
1561 accacgagat gcccacgtgg cacctggacg tccatgcata tgttgaggcc cgtgcacgcg
1621 cagagacccc agcgcagaag ccgccccgca cgccagggct tatgtatgcc agcgctggga
1681 gacctccagc gcccgaggac atacggcaag tggttccacc agggtgtcag cctagcaggc
1741 caacctggga acccatgtgg acaagcggcc tttcagccca ggcgcccgcc tcgggtggag
1801 gcgtggagac ttctggcgca gccctgagct ggtggcctaa cctacctgga aaatcctagc
1861 ccgagaagca gcgcgagtga gccttttggg tggttccaag gcccttcacc aagctctcac
1921 ttcctgactt caccgttggg tctgttgtac taggaaataa taacgcctcc catttatcaa
1981 gggtttactc tgtaaaaa
```

SEQ ID NO: 157 Human BCL7C Amino Acid Sequence isoform 1 (NP_001273455.1)

```
   1 magrtvraet rsrakddikk vmatiekvrr wekrwvtvgd tslrifkwvp vvdpqeeerr
  61 ragggaersr grerrgrgas prgggplill dlndensnqs fhsegslqkg tepspggtpq
 121 psrpvspagp pegvpeeaqp prlggerdpg gitagstdep pmltkeepvp elleaedsgv
 181 rmtrralhek glkteplrrl lprrglrtnv rpssmavpdt rapgggskap raprtipqgk
 241 gr
```

SEQ ID NO: 158 Human BCL7C cDNA Sequence variant 2 (NM_004765.3; CDS: 359-1012)

```
   1 tccgtcccca actcgcgcgt ccgtccccaa ctcccgctct cggcggcggg cagggggcgc
  61 tgagcgtcca ggcgctccaa gggggcgggc ccgggtcggg gcggggccgg ccgggcttcc
 121 aggcctgggc tctggccgcc cgcgccaccg ggccgctccg gggacaggcc ggggcggggc
 181 gcggcggcag gaaacggggc ggggacttgc ggaggcgttg gggacgagag agggcgcggc
 241 caactccagg ggggacggca ggccgagagc gcggcgcccg ggcctggcgc ggagcctgag
 301 cccgccggac gggaggcggc cccgccgcgg gctcggcccc ggccccagcc ccgccagcat
 361 ggccggccgg actgtacggg ccgagacccg gagccgggcc aaggatgaca tcaagaaggt
 421 gatggcgacc atcgagaagg tccggagatg ggagaagcga tgggtgactg tgggcgacac
 481 ttcccttcgt atcttcaagt gggtgccagt ggtggatccc caggaggagg agcgaaggcg
 541 ggcaggtggc ggggcagaga gatcccgtgg ccgggaacgt cggggcaggg gcgccagtcc
 601 ccgagggggt ggccctctca tcctgctgga tcttaatgat gagaacagca accagagttt
 661 ccattcggaa ggttccctgc aaaagggcac agagcccagt cctgggggca ccccccagcc
 721 cagccgccct gtgtcacctg ccggaccccc agaaggggtc cctgaggagg ctcagccccc
```

TABLE 1-continued

```
 781 acggctgggc caagagagag atcccggggg cataactgct ggcagcaccg acgaaccccc
 841 aatgctgacc aaggaggagc ctgttccaga actgctggaa gctgaggccc ccgaagctta
 901 ccctgtcttt gagccagtgc cacctgtccc tgaggcagcc cagggtgaca cagaggactc
 961 ggagggtgcc cccccactca agcgcatctg cccaaatgcc cctgacccct gagaagccgg
1021 cctgcctgtc ctgttgcccc aggggcccct ttggcttttt acaaataaag accctttttgt
1081 aaaaaaaaaa aaaaaaaaaa a
```

SEQ ID NO: 159 Human BCL7C Amino Acid Sequence isoform 2 (NP_004756.2)

```
  1 magrtvraet rsrakddikk vmatiekvrr wekrwvtvgd tslrifkwvp vvdpqeeerr
 61 ragggaersr grerrgrgas prgggplill dlndensnqs fhsegslqkg tepspggtpq
121 psrpvspagp pegvpeeaqp prlggerdpg gitagstdep pmltkeepvp elleaeapea
181 ypvfepvppv peaaqgdted segapplkri cpnapdp
```

SEQ ID NO: 160 Mouse BCL7C cDNA Sequence variant 1 (NM_001347652.1; CDS: 240-965)

```
   1 ggccggggct ctagcagccc gcgccgcccg ggccgctccg gggacgggcc ggggcggggc
  61 gcggtcttag gaagccaggc ggggacgcgc ggaggcgttg gggagcgagg gagggcgcgg
 121 ccaactcccg gagggacggc aggccgaaag agcggcgctg gggcctggcg ctcagcctga
 181 gatcgccgga ccacaggccg ccccgccacg ggctctgtcc cggccccagc cccgccagca
 241 tggccggccg gaccgtgcgg gccgagaccc ggagccgggc caaagatgac atcaagaagg
 301 tgatggcgac catcgagaag gtccggagat gggagaagcg ctgggtgact gtgggagaca
 361 cttcccttcg aatcttcaag tgggtgcctg tggtggatcc ccaggaggag gagaggcggc
 421 gggcaggagg cggggcagag agatcccgtg gccgggagag acgtggtagg ggcaccagtc
 481 ccagaggggg aggccccctc atcctactgg atctcaatga tgagaacagc aaccagagtt
 541 tccattctga aggttcattg caaaagggtg ctgagcccag ccctgggggg acgccccagc
 601 ccagccgccc tggatcacca actggacccc cagaagtgat tactgaagat actcagcccc
 661 cacaattggg tcaggagaga gatccagggg ggacacctgc aggcggtact gatgaacccc
 721 caaagctgac caaggaggag cctgttccag aattgctaga agctgaggat tccggcgtga
 781 gactcaccag gagagccctt caagagaaag gcctgaaaac cgagcccctc aggaggcttc
 841 tccccaggag aggcctccgg acaaattctc ggccaacttc cacggttccg gaacccagag
 901 ctcccggaag tgggagcaag gcccagaggg cacccaggac gataccacaa gggaagggga
 961 ggtgagcggg ttccaccaca caaggggagg cccttaggtc ttccttagct gcctcaagat
1021 ccagtcattt acccacaccg tttaagggtg gagagggctt tggagctggg cacccgcagc
1081 cagcaatgga ggtcggcagc cagctctctg cttgtccctg tccctaaatt atggatccat
1141 cctgcttgct gtgggtccaa aactactggg ccagagcagg tcccagacag ggaatgtctg
1201 gggacatctc taggtgatgc ctagaagcaa cttgaataca caaaatggtg gatcctatgc
1261 caacttggtc acctcctcac acacttaggg cagccatcca ccaaagggcc aggcatggcc
1321 cctggaggtg accttcgacc tttggaacta cagtatctac actggtgagg ggccctacca
1381 gcaagacttg agcagcgagc aacccctgaa gcactgggca aaaggtaatg ccacagcttg
1441 tgaatggtgt gaagattcaa ttgcccgtgt gtagagacac cactccagca agcacctggc
1501 agcctcaccc gcttccacga gcctatggac tctgggcctg ctaattaacc cttggctcca
1561 gaagacatgt gccaaccagg gtgccaacct tgcctcaggt caatcgaggg gtgcacatgg
1621 cccagtgacc tttcagacca ggccacagcc tcctgcccca ggaatggatg gagacatgtg
1681 gtccagcact gccaaatcta cctggaaact acccactttg agaaactcat ggcagatgag
1741 ccatctgagt gattccaagg gctttcatca acctcttgcc tccgacttga caactcactt
1801 ggccaggagg tagtgtctcc tgtaccacag agagctaact gtactacata ttgcaacttg
1861 tgggacttat ttaatgcagc actcctgtca tagatcctgt tactttcaca ttttacagat
1921 atagaaaaca agcaaccagg aggttaaaga gcttgcccca agtcacacag cctgtctgtg
1981 gcagagccag cattcacatc cagtctaccc acctgactcc acagtccctg ctagtgtacc
2041 actttttgtg ctgggcatgc aggtgggctg cagctgtgag ctttgttgag gcgttcattg
2101 aaggaacatc cattttctc agtggcaaat tacaaaggac ttttaatttt aactttcttc
2161 tgcctgacct accttccttc cttccttcct tccttccttc cttccttcct tccttccttc
2221 cttccttcct tcctttcttc ctctgctggc catgaaccca ctagaccagg ccagtcttga
2281 actcacagag gtctgtctat ctctgcctct ccagtgctgg gattaaaggt gagcgacacc
2341 atacccagct taggccttct ttgtttgttt gtttgttgtt ttttgagtaa taaggtaagc
2401 agatgttctg tgtccataac tgagatgaca tggacattga gtggtaaggg acttgagctc
2461 agcccctggg tccctcagat tcctctctgg agtgccattg atacaggaag catcatctag
2521 gcccagctcc tgattggcga cttcccagaa gccatgggct gtcatgccaa gtgactgggg
2581 aacttcaagt aacaaacatt tattaattag acttctgaac taccaatggg gcagaagttt
2641 tcacgtttca aacacagata ctagttttca agattcagaa atgaaacata ggaattctgg
2701 ggaggtccag aaagtcctac tttgtatttt tcataactct ctgtatctta aaagctaaga
2761 aactcacagt tcatcgtagt ttaaaagagc tgcaagcctt aaatattcaa aaggtagaaa
2821 ctgccagtgt gtgtcactgg gtagtagttg aataacaaaa tgtttacgga tccaattaga
2881 ttcatggtac tccagagtca tgagttgaaa tcgcggatat aaagacttat ttccaatgca
2941 tcatttctca gaacaccctg ggatttgtat aaaacacacg atgcatgtga acgcattcat
3001 gtttatctta tttctgagaa tcattctaca ggcgggggag cacgcataca tttttaatgt
3061 cagggctaca gaagactggc ctggcacggc tcccctcagt tcttggttcc caaattctaa
3121 ggatgtctgc cttcgtttca tgtgtcagcc tttcctgctc tcggacctga cacagtggct
3181 ccgtacagcg aggactcctc tgtgctgatg aacttcggct gttagaggac tgttagtatg
3241 tttcctgttt cgccaattta tttgctgatt ggttttgtga ttcaaaaaac aaacaagcaa
3301 gcaaacaaac aaaaacaaaa gcagggacca ggcgtggtgg cgcacgcctt taatcttgga
3361 ggcagaggca ggcggatttc tgagttcgag gccaacctga tctacaaagt gagttccagg
3421 acagccaggg ctatacagag aaaccctgtc tcaaaaacaa acaaacaaaa acaaacaaaa
3481 aaacaaaagc agacaaaatc accaccagca gcagcaacaa tcccaggttt cccaataatg
3541 tcagcaagga attctgaaca gacaaagtcc gtggggctga gcagggacgg tgaataagtg
3601 agctcgtgtt tatgaagccc agtgatctgc tccttgcagc cagaacgctc cagctcagcc
3661 aggccctggc acgagccctc ggctgaagca ctcacctctg agcttcagtt tagtgagtag
3721 catcctccct agaaagtaat attcttgctt catacggtga tatggtggaa gggttaccag
3781 catggctttg gagtcagaca gactgtggtt caaatcttag ctacacgact ttctacctct
3841 ttgatttggg gcaagttcta accgctggct tttctcttc tgtaaaatga ggacatggaa
```

TABLE 1-continued

```
3901 tctatttcac agggctgtgg cttcagtgag atcacatatg acccgcttaa gtcaaagcgg
3961 gtccacggta tgtgtttgat cccacgtagg cattacccgc tgtatctacc tcacagggca
4021 gttgtgagga tgaagggtag agggaaatgc tttccaaact gtgaagtgat ctgtgtttac
4081 ctctctcctc tggagatgga gagataggaa gttgctgtca gacactagtg ggatgcccat
4141 ggagagggcc tagtatgctt ctgtgcacac agtgtggctg ggctgaaggg gaggtgctgt
4201 gttgtgcagt ggtgcacagc gggggcgtgc cctccggtga gggttgctgc actgaagtgg
4261 ggaagttcag tgcctatggc tacactgttg ggagcaggga gagcgcaggt cctatcttaa
4321 gaaggatgct agatgggggc taaagtagat gagtgtttgc ctagcatgag caagggccat
4381 ggatttcgta tctagcacct caggaaaaac acaacaaaca aacaaacaaa caaacccctc
4441 ttcttgttta aagattctgg ataaagaaca gtgttgtgaa cgtgtgtatc cactgtttgt
4501 ctttttaaat acaactcaaa tagcaggaag gcctgtgtgc acaagaggtg acaagtgact
4561 gcaagtgttt ccatcgctgg cagccatgca ccctcctacc acgagtacag atttcattct
4621 ggagtgtgca gaccaaatgc aggtcagagg gccctcccgg ggcaactcgc caagatcctg
4681 accaaagcct agcctcacaa agtaatccct agcccagtta gcagatcagg ggttggggct
4741 tgggaacgtc atgtccaatg tccaaggctg cacaggtcct gtggggacag aatccaagcc
4801 cttcacctgg attggggttc ctccgcctgc cagtctcaga tctctgatct tgaacaagga
4861 tagcatgcag aagagtaagg ttccatgcct aagtgacctc ctctggacct cagacgcagt
4921 tcttgctcct gacctcatgc ctcgtctcca gacatcactc cccagcttag cccttaggtc
4981 aggctcctct gggcaccatc cttagattca acccaaagga gggtcctctc attctaacca
5041 gactgtctct ccaaatacca ccctagtcag ctccttggct tctcagtgtc cccttggaga
5101 acatggggta taggttccca gctagttcag tggcattcca cagcccatct cttgtgaggt
5161 cccactcctt aacaatggtc tttcagtttc aaacgcatgc ggccagcggg cagtctaggg
5221 acccttcaaa gtcaatgctt cttgattaaa ttatcgagac taatgtttaa ctttgagata
5281 cgtttctga gagttgctaa ccggttggag atgaacttag agaatagggt tcacctttt
5341 cgtctgtcag cgggttatcg agtgcccagt ggtgtgccag attcagcagc tggtgcagga
5401 gatacattcg tgagcaaaac agatctgagc cctgacttcg ggaggcctcc tcctaacaac
5461 tagggcagat ataaccagtg ttccctgaat acaaacgcct agcctggcat ggtggcacac
5521 acctatgatg tcagccctta ggagccggag gtaagaagat caggagttca gctatctttg
5581 gccaacctgg gctacataag accgtgtctt aaaaaaaaaa aaaaaaatcc aaacaaaata
5641 cacactataa ctgtgagaaa tgttgtgaag agaaaggtcc aaatgcagtg aaagagctca
5701 gtaaaaaaag tgtggggtgt gttaggacag tgacaacatg tgcccgtatg tggagaagag
5761 aatcctgggt aatgggagga gcttactgta ttggaatcgg cagcagcagt gaggtctgct
5821 gctggacgga gcctgccccc caggctgggt ggggaaggtg tcacggacct tgcagaccac
5881 ggtaaggaac ttgcattctg gtgtttaact ttttatttgg agaccatttc aaagtgactg
5941 gaaccttatg agagtggcac aaaagatgtc tgcatacttt ggctgcagcc tccccgactg
6001 acctgtaaac gttctgttcc ccgagtcacc acccgtgtct ccctgtgatg tgtactcata
6061 gcctgtagtc cgaactctga gaatgagttg catacattgt gtctgtttac acttaaaaca
6121 cagtggagac cccctacagt aatgcctcgc ccgcctccgc ctgccacact gggtttatcg
6181 ctggttggtg gctccacact gtttgttggt cgtctctcta gtcaccttca ttagcatctt
6241 ccctttagga caagtcacgt ctgcgaatga tgtggaccat gcgttgtgct ttcttgctcg
6301 tatcttttaa tgtggcgtag tttctttcct ctctgtttga atagactatt tctcctttg
```

SEQ ID NO: 161 Mouse BCL7C Amino Acid Sequence isoform 1 (NP_001334581.1)

```
  1 magrtvraet rsrakddikk vmatiekvrr wekrwvtvgd tslrifkwvp vvdpqeeerr
 61 ragggaersr grerrgrgts prgggplill dlndensnqs fhsegslqkg aepspggtpq
121 psrpgsptgp pevitedtqp pqlggerdpg gtpaggtdep pkltkeepvp elleaedsgv
181 rltrralgek glkteplrrl lprrglrtns rptstvpepr apgsgskaqr aprtipqgkg
241 r
```

SEQ ID NO: 162 Mouse BCL7C cDNA Sequence variant 2 (NM_009746.2; CDS: 240-893)

```
  1 ggccggggct ctagcagccc gcgccgcccg ggccgctccg gggacgggcc ggggcggggc
 61 gcggtcttag gaagccaggc ggggacgcgc ggaggcgttg gggagcgagg gagggcgcgg
121 ccaactcccg gagggacggc aggccgaaag agcggcgctg gggcctggcg ctcagcctga
181 gatcgccgga ccacaggccg ccccgccacg ggctctgtcc cggccccagc cccgccagca
241 tggccggccg gaccgtgcgg gccgagaccc ggagccgggc caaagatgac atcaagaagg
301 tgatggcgac catcgagaag gtccggagat gggagaagcg ctgggtgact gtgggagaca
361 cttcccttcg aatcttcaag tgggtgcctg tggtggatcc ccaggaggag gagaggcggc
421 gggcaggagg cggggcagag agatcccgtg gccgggagag acgtggtagg ggcaccagtc
481 ccagaggggg aggccccctc atcctactgg atctcaatga tgagaacagc aaccagagtt
541 tccattctga aggttcattg caaaagggtg ctgagcccag ccctgggggg acgccccagc
601 ccagccgccc tggatcacca actggacccc cagaagtgat tactgaagat actcagcccc
661 cacaattggg tcaggagaga gatccagggg ggacacctgc aggcggtact gatgaacccc
721 caaagctgac caaggaggag cctgttccag aattgctaga agctgaggcc cccgaagctt
781 accctgtctt tgagccagtg ccatctgtcc ctgaggcagc ccagggtgac acagaggact
841 cggagggcgc ccccccactc aagcgcatct gtccaaatgc ccctgacccc tgagaagccg
901 cctgcctcct gtcctgttgc tccaggggcc cctttggctt tttataaata aagaccettt
961 tgtaaaaaaa aaaaaaaaaa a
```

SEQ ID NO: 163 Mouse BCL7C Amino Acid Sequence isoform 2 (NP_033876.1)

```
  1 magrtvraet rsrakddikk vmatiekvrr wekrwvtvgd tslrifkwvp vvdpqeeerr
 61 ragggaersr grerrgrgts prgggplill dlndensnqs fhsegslqkg aepspggtpq
121 psrpgsptgp pevitedtqp pqlggerdpg gtpaggtdep pkltkeepvp elleaeapea
181 ypvfepvpsv peaaqgdted segapplkri cpnapdp
```

SEQ ID NO: 164 Human SMARCA2 Amino Acid Sequence Isoform A (NP_001276325.1 and NP_003061.3)

```
  1 mstptdpgam phpgpspgpg pspgpilgps pgpgpspgsv hsmmgpspgp psyshpmptm
 61 gstdfpgegm hqmhkpidgi hdkgivedih cgsmkgtgmr pphpgmgppq spmdqhsqgy
121 msphpsplga pehvsspmsg ggptppqmpp sqpgalipgd pqamsqpnrg pspfspvglh
```

TABLE 1-continued

```
 181 qlragilayk mlargqplpe tlglavqgkr tlpglqqqqq qqqqqqqqqq qqqqqqqqpq
 241 qqppqpqtqq qqqpalvnyn rpsgpgpels gpstpqklpv papggrpspa ppaaaqppaa
 301 avpgpsvpqp apgqpspvlq lqqkqsrisp iqkpqgldpv eilgereyrl gariahrige
 361 lenlpgslpp dlrtkatvel kalrllnfqr qlrgevvacm rrdttletal nskaykrskr
 421 qtlrearmte klekqqkieq erkrrqkhqe ylnsilqhak dfkeyhrsva gkiqklskav
 481 atwhantere qkketeriek ermrrlmaed eegyrklidq kkdrrlayll qqtdeyvanl
 541 tnlvwehkqa qaakekkkrr rrkkkaeena eggesalgpd gepidessqm sdlpvkvtht
 601 etgkvlfgpe apkasqldaw lemnpgyeva prsdseesds dyeeedeeee ssrqeteeki
 661 lldpnseevs ekdakqiiet akqdvddeys mgysargsgs yytvahaise rvekqsalli
 721 ngtlkhyqlq glewmvslyn nnlngilade mglgktiqti alitylmehk ringpyliiv
 781 plstlsnwty efdkwapsvv kisykgtpam rrslvpqlrs gkfnvlltty eyiikdkhil
 841 akirwkymiv deghrmknhh ckltqvinth yvaprrillt gtplqnklpe lwallnfllp
 901 tifkscstfe qwfnapfamt gervdlneee tiliirrlhk vlrpfllrrl kkevesqlpe
 961 kveyvikcdm salqkilyrh mqakgilltd gsekdkkgkg gaktlmntim qlrkicnhpy
1021 mfqhieesfa ehlgysngvi ngaelyrasg kfelldrilp klratnhrvl lfcgmtslmt
1081 imedyfafrn flylrldgtt ksedraallk kfnepgsqyf ifllstragg lglnlqaadt
1141 vvifdsdwnp hqdlqaqdra hrigqgnevr vlrlctvnsv eekilaaaky klnvdqkviq
1201 agmfdqksss herraflqai leheeeneee devpddetln qmiarreeef dlfmrmdmdr
1261 rredarnpkr kprlmeedel pswiikddae verltceeee ekifgrgsrq rrdvdysdal
1321 tekqwlraie dgnleemeee vrlkkrkrrr nvdkdpaked vekakkrrgr ppaeklspnp
1381 pkltkqmnai idtvinykdr cnvekvpsns qleiegnssg rqlsevfiql psrkelpeyy
1441 elirkpvdfk kikerirnhk yrslgdlekd vmllchnaqt fnlegsqiye dsivlqsvfk
1501 sarqkiakee esedesneee eeedeeeses eaksvkvkik lnkkddkgrd kgkgkkrpnr
1561 gkakpvvsdf dsdeeqdere qsegsgtdde
```

SEQ ID NO: 165 Human SMARCA2 cDNA Sequence Variant 1 (NM_003070.4, CDS: 223-4995)

```
   1 gcgtcttccg gcgcccgcgg aggaggcgag ggtgggacgc tgggcggagc ccgagtttag
  61 gaagaggagg ggacggctgt catcaatgaa gtcatattca taatctagtc ctctctccct
 121 ctgtttctgt actctgggtg actcagagag ggaagagatt cagccagcac actcctcgcg
 181 agcaagcatt actctactga ctggcagaga caggagaggt agatgtccac gcccacagac
 241 cctggtgcga tgccccaccc agggccttcg ccggggcctg ggccttcccc tgggccaatt
 301 cttgggccta gtccaggacc aggaccatcc ccaggttccg tccacagcat gatggggcca
 361 agtcctggac ctccaagtgt ctcccatcct atgccgacga tggggtccac agacttccca
 421 caggaaggca tgcatcaaat gcataagccc atcgatggta tacatgacaa ggggattgta
 481 gaagacatcc attgtggatc catgaagggc actggtatgc gaccacctca cccaggcatg
 541 ggccctcccc agagtccaat ggatcaacac agccaaggtt atatgtcacc acacccatct
 601 ccattaggag ccccagagca cgtctccagc cctatgtctg gaggaggccc aactccacct
 661 cagatgccac caagccagcc gggggccctc atcccaggtg atccgcaggc catgagccag
 721 cccaacagag gtccctcacc tttcagtcct gtccagctgc atcagcttcg agctcagatt
 781 ttagcttata aaatgctggc ccgaggccag cccctccccg aaacgctgca gcttgcagtc
 841 caggggaaaa ggacgttgcc tggcttgcag caacaacagc agcagcaaca gcagcagcag
 901 cagcagcagc agcagcagca gcagcagcaa cagcagccgc agcagcagcc gccgcaacca
 961 cagacgcagc aacaacagca gccggccctt gttaactaca acagaccatc tggcccgggg
1021 ccggagctga gcggcccgag caccccgcag aagctgccgg tgcccgcgcc cggcggccgg
1081 ccctcgcccg cgccccccgc agccgcgcag ccgcccgcgg ccgcagtgcc cgggccctca
1141 gtgccgcagc cggccccggg gcagccctcg cccgtcctcc agctgcagca gaagcagagc
1201 cgcatcagcc ccatccagaa accgcaaggc ctggaccccg tggaaattct gcaagagcgg
1261 gaatacagac ttcaggcccg catagctcat aggatacaag aactggaaaa tctgcctggc
1321 tctttgccac cagatttaag aaccaaagca accgtggaac taaaagcact tcggttactc
1381 aatttccagc gtcagctgag acaggaggtg gtggcctgca tgcgcaggga cacgaccctg
1441 gagacggctc tcaactccaa agcatacaaa cggagcaagc gccagactct gagagaagct
1501 cgcatgaccg agaagctgga gaagcagcag aagattgagc aggagaggaa acgccgtcag
1561 aaacaccagg aatacctgaa cagtattttg caacatgcaa aagattttaa ggaatatcat
1621 cggtctgtgg ccggaaagat ccagaagctc tccaaagcag tggcaacttg gcatgccaac
1681 actgaaagag agcagaagaa ggagacagag cggattgaaa aggagagaat gcggcgactg
1741 atggctgaag atgaggaggg ttatagaaaa ctgattgatc aaaagaaaga caggcgttta
1801 gcttaccttt tgcagcagac cgatgagtat gtagccaatc tgaccaatct ggtttgggag
1861 cacaagcaag cccaggcagc caaagagaag aagaagagga ggaggaggaa gaagaaggct
1921 gaggagaatg cagagggtgg ggagtctgcc ctgggaccgg atggagagcc catagatgag
1981 agcagccaga tgagtgacct ccctgtcaaa gtgactcaca cagaaaccgg caaggttctg
2041 ttcggaccag aagcacccaa agcaagtcag ctggacgcct ggctggaaat gaatcctggt
2101 tatgaagttg cccctagatc tgacagtgaa gagagtgatt ctgattatga ggaagaggat
2161 gaggaagaag agtccagtag gcaggaaacc gaagagaaaa tactcctgga tccaaatagc
2221 gaagaagttt ctgagaagga tgctaagcag atcattgaga cagctaagca agacgtggat
2281 gatgaataca gcatgcagta cagtgccagg ggctcccagt cctactacac cgtggctcat
2341 gccatctcgg agagggtgga gaaacagtct gccctcctaa ttaatgggac cctaaagcat
2401 taccagctcc agggcctgga atggatggtt tccctgtata ataacaactt gaacggaatc
2461 ttagccgatg aaatggggct tggaaagacc atacagacca ttgcactcat cacttatctg
2521 atggagcaca aaagactcaa tggcccctat ctcatcattg ttccccttc gactctatct
2581 aactggacat atgaatttga caaatgggct ccttctgtgg tgaagatttc ttacaagggt
2641 actcctgcca tgcgtcgctc ccttgtcccc cagctacgga gtggcaaatt caatgtcctc
2701 ttgactactt atgagtatat tataaaagac aagcacattc ttgcaaagat tcggtggaaa
2761 tacatgatag tggacgaagg ccaccgaatg aagaatcacc actgcaagct gactcaggtc
2821 ttgaacactc actatgtggc ccccagaagg atcctcttga ctgggacccc gctgcagaat
2881 aagctccctg aactctgggc cctcctcaac ttcctcctcc caacaatttt taagagctgc
2941 agcacatttg aacaatggtt caatgctcca tttgccatga ctggtgaaag ggtggactta
3001 aatgaagaag aaactatatt gatcatcagg cgtctacata aggtgttaag accattttta
3061 ctaaggagac tgaagaaaga agttgaatcc cagcttcccg aaaaagtgga atatgtgatc
3121 aagtgtgaca tgtcagctct gcagaagatt ctgtatcgcc atatgcaagc caaggggatc
```

TABLE 1-continued

```
3181 cttctcacag atggttctga gaaagataag aaggggaaag gaggtgctaa gacacttatg
3241 aacactatta tgcagttgag aaaaatctgc aaccacccat atatgtttca gcacattgag
3301 gaatcctttg ctgaacacct aggctattca aatggggtca tcaatggggc tgaactgtat
3361 cgggcctcag ggaagtttga gctgcttgat cgtattctgc caaaattgag agcgactaat
3421 caccgagtgc tgcttttctg ccagatgaca tctctcatga ccatcatgga ggattatttt
3481 gcttttcgga acttccttta cctacgcctt gatggcacca ccaagtctga agatcgtgct
3541 gctttgctga agaaattcaa tgaacctgga tcccagtatt tcattttctt gctgagcaca
3601 agagctggtg gcctgggctt aaatcttcag gcagctgata cagtggtcat ctttgacagc
3661 gactggaatc ctcatcagga tctgcaggcc caagaccgag ctcaccgcat cgggcagcag
3721 aacgaggtcc gggtactgag gctctgtacc gtgaacagcg tggaggaaaa gatcctcgcg
3781 gccgcaaaat acaagctgaa cgtggatcag aaagtgatcc aggcgggcat gtttgaccaa
3841 aagtcttcaa gccacgagcg gagggcattc ctgcaggcca tcttggagca tgaggaggaa
3901 aatgaggaag aagatgaagt accggacgat gagactctga accaaatgat tgctcgacga
3961 gaagaagaat ttgacctttt tatgcggatg gacatggacc ggcggaggga agatgcccgg
4021 aacccgaaac ggaagccccg tttaatggag gaggatgagc tgccctcctg gatcattaag
4081 gatgacgctg aagtagaaag gctcacctgt gaagaagagg aggagaaaat atttgggagg
4141 gggtcccgcc agcgccgtga cgtggactac agtgacgccc tcacggagaa gcagtggcta
4201 agggccatcg aagacggcaa tttggaggaa atggaagagg aagtacggct taagaagcga
4261 aaaagacgaa gaaatgtgga taaagatcct gcaaaagaag atgtggaaaa agctaagaag
4321 agaagaggcc gccctcccgc tgagaaactg tcaccaaatc cccccaaact gacaaagcag
4381 atgaacgcta tcatcgatac tgtgataaac tacaaagata ggtgtaacgt ggagaaggtg
4441 cccagtaatt ctcagttgga aatagaagga aacagttcag ggcgacagct cagtgaagtc
4501 ttcattcagt taccttcaag gaaagaatta ccagaatact atgaattaat taggaagcca
4561 gtggatttca aaaaaataaa ggaaaggatt cgtaatcata agtaccggag cctaggcgac
4621 ctggagaagg atgtcatgct tctctgtcac aacgctcaga cgttcaacct ggagggatcc
4681 cagatctatg aagactccat cgtcttacag tcagtgttta agagtgcccg gcagaaaatt
4741 gccaaagagg aagagagtga ggatgaaagc aatgaagagg aggaagagga agatgaagaa
4801 gagtcagagt ccgaggcaaa atcagtcaag gtgaaaatta agctcaataa aaaagatgac
4861 aaaggccggg acaaagggaa aggcaagaaa aggccaaatc gaggaaaagc caaacctgta
4921 gtgagcgatt ttgacagcga tgaggagcag gatgaacgtg aacagtcaga aggaagtggg
4981 acggatgatg agtgatcagt atggaccttt ttccttggta gaactgaatt ccttcctccc
5041 ctgtctcatt tctacccagt gagttcattt gtcatatagg cactgggttg tttctatatc
5101 atcatcgtct ataaactagc tttaggatag tgccagacaa acatatgata tcatggtgta
5161 aaaaacacac acatacacaa atatttgtaa catattgtga ccaaatgggc ctcaaagatt
5221 cagattgaaa caaacaaaaa gcttttgatg gaaaatatgt gggtggatag tatatttcta
5281 tgggtgggtc taatttggta acggtttgat tgtgcctggt tttatcacct gttcagatga
5341 gaagattttt gtcttttgta gcactgataa ccaggagaag ccattaaaag ccactggtta
5401 ttttattttt catcaggcaa ttttcgaggt ttttatttgt tcggtattgt ttttttacac
5461 tgtggtacat ataagcaact ttaataggtg ataaatgtac agtagttaga tttcacctgc
5521 atatacattt ttccatttta tgctctatga tctgaacaaa agctttttga attgtataag
5581 atttatgtct actgtaaaca ttgcttaatt tttttgctct tgatttaaaa aaaagttttg
5641 ttgaaagcgc tattgaatat tgcaatctat atagtgtatt ggatggcttc ttttgtcacc
5701 ctgatctcct atgttaccaa tgtgtatcgt ctccttctcc ctaaagtgta cttaatcttt
5761 gctttctttg cacaatgtct ttggttgcaa gtcataagcc tgaggcaaat aaaattccag
5821 taatttcgaa gaatgtggtg ttggtgcttt cctaataaag aaataattta gcttgacaaa
5881 aaaaaaaaaa aa
```

SEQ ID NO: 166 Human SMARCA2 cDNA Sequence Variant 3 (NM_001289396.1, CDS: 210-4982)

```
   1 tcagaagaaa gccccgagat cacagagacc cggcgagatc acagagaccc ggcctgaagg
  61 aacgtggaaa gaccaatgta cctgttttga ccggttgcct ggagcaagaa gttccagttg
 121 gggagaattt tcagaagata aagtcggaga ttgtggaaag acttgacttg cagcattact
 181 ctactgactg gcagagacag gagaggtaga tgtccacgcc cacagaccct ggtgcgatgc
 241 cccacccagg gccttcgccg gggcctgggc cttcccctgg gccaattctt gggcctagtc
 301 caggaccagg accatcccca ggttccgtcc acagcatgat ggggccaagt cctggacctc
 361 caagtgtctc ccatcctatg ccgacgatgg ggtccacaga cttcccacag gaaggcatgc
 421 atcaaatgca taagcccatc gatggtatac atgacaaggg gattgtagaa gacatccatt
 481 gtggatccat gaagggcact ggtatgcgac cacctcaccc aggcatgggc cctccccaga
 541 gtccaatgga tcaacacagc caaggttata tgtcaccaca cccatctcca ttaggagccc
 601 cagagcacgt ctccagccct atgtctggag gaggcccaac tccacctcag atgccaccaa
 661 gccagccggg ggccctcatc ccaggtgatc cgcaggccat gagccagccc aacagaggtc
 721 cctcaccttt cagtcctgtc cagctgcatc agcttcgagc tcagatttta gcttataaaa
 781 tgctggcccg aggccagccc ctccccgaaa cgctgcagct tgcagtccag gggaaaagga
 841 cgttgcctgg cttgcagcaa caacagcagc agcaacagca gcagcagcag cagcagcagc
 901 agcagcagca gcagcaacag cagccgcagc agcagccgcc gcaaccacag acgcagcaac
 961 aacagcagcc ggcccttgtt aactacaaca gaccatctgg cccggggccg gagctgagcg
1021 gcccgagcac cccgcagaag ctgccggtgc ccgcgcccgg cggccggccc tcgcccgcgc
1081 cccccgcagc cgcgcagccg cccgcggccg cagtgcccgg gccctcagtg ccgcagccgg
1141 ccccggggca gccctcgccc gtcctccagc tgcagcagaa gcagagccgc atcagcccca
1201 tccagaaacc gcaaggcctg gaccccgtgg aaattctgca agagcgggaa tacagacttc
1261 aggcccgcat agctcatagg atacaagaac tggaaaatct gcctggctct ttgccaccag
1321 atttaagaac caaagcaacc gtggaactaa aagcacttcg gttactcaat ttccagcgtc
1381 agctgagaca ggaggtggtg gcctgcatgc gcagggacac gaccctggag acggctctca
1441 actccaaagc atacaaacgg agcaagcgcc agactctgag agaagctcgc atgaccgaga
1501 agctggagaa gcagcagaag attgagcagg agaggaaacg ccgtcagaaa caccaggaat
1561 acctgaacag tattttgcaa catgcaaaag attttaagga atatcatcgg tctgtggccg
1621 gaaagatcca gaagctctcc aaagcagtgg caacttggca tgccaacact gaaagagagc
1681 agaagaagga gacagagcgg attgaaaagg agagaatgcg gcgactgatg gctgaagatg
1741 aggagggtta tagaaaactg attgatcaaa agaaagacag gcgtttagct taccttttgc
1801 agcagaccga tgagtatgta gccaatctga ccaatctggt ttgggagcac aagcaagccc
```

TABLE 1-continued

```
1861 aggcagccaa agagaagaag aagaggagga ggaggaagaa gaaggctgag gagaatgcag
1921 agggtgggga gtctgccctg ggaccggatg gagagcccat agatgagagc agccagatga
1981 gtgacctccc tgtcaaagtg actcacacag aaaccggcaa ggttctgttc ggaccagaag
2041 cacccaaagc aagtcagctg gacgcctggc tggaaatgaa tcctggttat gaagttgccc
2101 ctagatctga cagtgaagag agtgattctg attatgagga agaggatgag gaagaagagt
2161 ccagtaggca ggaaaccgaa gagaaaatac tcctggatcc aaatagcgaa gaagtttctg
2221 agaaggatgc taagcagatc attgagacag ctaagcaaga cgtggatgat gaatacagca
2281 tgcagtacag tgccaggggc tcccagtcct actacaccgt ggctcatgcc atctcggaga
2341 gggtggagaa acagtctgcc ctcctaatta atgggaccct aaagcattac cagctccagg
2401 gcctggaatg gatggtttcc ctgtataata acaacttgaa cggaatctta gccgatgaaa
2461 tggggcttgg aaagaccata cagaccattg cactcatcac ttatctgatg gagcacaaaa
2521 gactcaatgg cccctatctc atcattgttc ccctttcgac tctatctaac tggacatatg
2581 aatttgacaa atgggctcct tctgtggtga agatttctta caagggtact cctgccatgc
2641 gtcgctccct tgtcccccag ctacggagtg gcaaattcaa tgtcctcttg actacttatg
2701 agtatattat aaaagacaag cacattcttg caaagattcg gtggaaatac atgatagtgg
2761 acgaaggcca ccgaatgaag aatcaccact gcaagctgac tcaggtcttg aacactcact
2821 atgtggcccc cagaaggatc ctcttgactg ggaccccgct gcagaataag ctccctgaac
2881 tctgggccct cctcaacttc ctcctcccaa caatttttaa gagctgcagc acatttgaac
2941 aatggttcaa tgctccattt gccatgactg gtgaaagggt ggacttaaat gaagaagaaa
3001 ctatattgat catcaggcgt ctacataagg tgttaagacc atttttacta aggagactga
3061 agaaagaagt tgaatcccag cttcccgaaa aagtggaata tgtgatcaag tgtgacatgt
3121 cagctctgca gaagattctg tatcgccata tgcaagccaa ggggatcctt ctcacagatg
3181 gttctgagaa agataagaag gggaaaggag gtgctaagac acttatgaac actattatgc
3241 agttgagaaa aatctgcaac cacccatata tgtttcagca cattgaggaa tcctttgctg
3301 aacacctagg ctattcaaat ggggtcatca atggggctga actgtatcgg gcctcaggga
3361 agtttgagct gcttgatcgt attctgccaa aattgagagc gactaatcac cgagtgctgc
3421 ttttctgcca gatgacatct ctcatgacca tcatggagga ttattttgct tttcggaact
3481 tcctttacct acgccttgat ggcaccacca agtctgaaga tcgtgctgct ttgctgaaga
3541 aattcaatga acctggatcc cagtatttca ttttcttgct gagcacaaga gctggtggcc
3601 tgggcttaaa tcttcaggca gctgatacag tggtcatctt tgacagcgac tggaatcctc
3661 atcaggatct gcaggcccaa gaccgagctc accgcatcgg gcagcagaac gaggtccggg
3721 tactgaggct ctgtaccgtg aacagcgtgg aggaaaagat cctcgcggcc gcaaaataca
3781 agctgaacgt ggatcagaaa gtgatccagg cgggcatgtt tgaccaaaag tcttcaagcc
3841 acgagcggag ggcattcctg caggccatct tggagcatga ggaggaaaat gaggaagaag
3901 atgaagtacc ggacgatgag actctgaacc aaatgattgc tcgacgagaa gaagaatttg
3961 accttttat gcggatggac atggaccggc ggagggaaga tgcccggaac ccgaaacgga
4021 agccccgttt aatggaggag gatgagctgc cctcctggat cattaaggat gacgctgaag
4081 tagaaaggct cacctgtgaa gaagaggagg agaaaatatt tgggaggggg tcccgccagc
4141 gccgtgacgt ggactacagt gacgccctca cggagaagca gtggctaagg gccatcgaag
4201 acggcaattt ggaggaaatg gaagaggaag tacggcttaa gaagcgaaaa agacgaagaa
4261 atgtggataa agatcctgca aaagaagatg tggaaaaagc taagaagaga agaggccgcc
4321 ctcccgctga gaaactgtca ccaaatcccc ccaaactgac aaagcagatg aacgctatca
4381 tcgatactgt gataaactac aaagataggt gtaacgtgga gaaggtgccc agtaattctc
4441 agttggaaat agaaggaaac agttcagggc gacagctcag tgaagtcttc attcagttac
4501 cttcaaggaa agaattacca gaatactatg aattaattag gaagccagtg gatttcaaaa
4561 aaataaagga aaggattcgt aatcataagt accggagcct aggcgacctg gagaaggatg
4621 tcatgcttct ctgtcacaac gctcagacgt tcaacctgga gggatcccag atctatgaag
4681 actccatcgt cttacagtca gtgtttaaga gtgcccggca gaaaattgcc aaagaggaag
4741 agagtgagga tgaaagcaat gaagaggagg aagaggaaga tgaagaagag tcagagtccg
4801 aggcaaaatc agtcaaggtg aaaattaagc tcaataaaaa agatgacaaa ggccgggaca
4861 aagggaaagg caagaaaagg ccaaatcgag gaaaagccaa acctgtagtg agcgatttg
4921 acagcgatga ggagcaggat gaacgtgaac agtcagaagg aagtgggacg gatgatgagt
4981 gatcagtatg gaccttttc cttggtagaa ctgaattcct tcctcccctg tctcatttct
5041 acccagtgag ttcatttgtc atataggcac tgggttgttt ctatatcatc atcgtctata
5101 aactagcttt aggatagtgc cagacaaaca tatgatatca tggtgtaaaa aacacacaca
5161 tacacaaata tttgtaacat attgtgacca aatgggcctc aaagattcag attgaaacaa
5221 acaaaaagct tttgatggaa aatatgtggg tggatagtat atttctatgg gtgggtctaa
5281 tttggtaacg gtttgattgt gcctggtttt atcacctgtt cagatgagaa gatttttgtc
5341 ttttgtagca ctgataacca ggagaagcca ttaaaagcca ctggttattt tatttttcat
5401 caggcaattt tcgaggtttt tatttgttcg gtattgtttt tttacactgt ggtacatata
5461 agcaacttta ataggtgata aatgtacagt agttagattt cacctgcata tacatttttc
5521 cattttatgc tctatgatct gaacaaaagc tttttgaatt gtataagatt tatgtctact
5581 gtaaacattg cttaattttt ttgctcttga tttaaaaaaa agttttgttg aaagcgctat
5641 tgaatattgc aatctatata gtgtattgga tggcttcttt tgtcaccctg atctcctatg
5701 ttaccaatgt gtatcgtctc cttctcccta aagtgtactt aatctttgct ttctttgcac
5761 aatgtctttg gttgcaagtc ataagcctga ggcaaataaa attccagtaa tttcgaagaa
5821 tgtggtgttg gtgctttcct aataaagaaa taatttagct tgacaaaaaa aaaaaaaaa
```

SEQ ID NO: 167 Human SMARCA2 Amino Acid Sequence Isoform B (NP_620614.2)

```
  1 mstptdpgam phpgpspgpg pspgpilgps pgpgpspgsv hsmmgpspgp psyshpmptm
 61 gstdfpqegm hqmhkpidgi hdkgivedih cgsmkgtgmr pphpgmgppq spmdqhsqgy
121 msphpsplga pehvsspmsg ggptppqmpp sqpgalipgd pqamsqpnrg pspfspvglh
181 qlraqilayk mlargqplpe tlglavqgkr tlpglqqqqq qqqqqqqqqq qqqqqqqqpq
241 qqppqpqtqq qqqpalvnyn rpsgpgpels gpstpqklpv papggrpspa ppaaaqppaa
301 avpgpsvpqp apgqpspvlq lqqkqsrisp iqkpqgldpv eilqereyrl qariahriqe
361 lenlpgslpp dlrtkatvel kalrllnfqr qlrgevvacm rrdttletal nskaykrskr
421 qtlrearmte klekqqkieq erkrrqkhqe ylnsilqhak dfkeyhrsva gkiqklskav
481 atwhantere qkketeriek ermrrlmaed eegyrklidq kkdrrlayll qqtdeyvanl
541 tnlvwehkqa qaakekkkrr rrkkkaeena eggesalgpd gepidessqm sdlpvkvtht
601 etgkvlfgpe apkasqldaw lemnpgyeva prsdseesds dyeeedeeee ssrqeteeki
```

TABLE 1-continued

```
 661 lldpnseevs ekdakqiiet akqdvddeys mgysargsgs yytvahaise rvekqsalli
 721 ngtlkhyqlq glewmvslyn nnlngilade mglgktiqti alitylmehk rlngpyliiv
 781 plstlsnwty efdkwapsvv kisykgtpam rrslvpqlrs gkfnvlltty eyiikdkhil
 841 akirwkymiv deghrmknhh ckltqvinth yvaprrillt gtplqnklpe lwallnfllp
 901 tifkscstfe qwfnapfamt gervdlneee tiliirrlhk vlrpfllrrl kkevesqlpe
 961 kveyvikcdm salqkilyrh mqakgilltd gsekdkkgkg gaktlmntim qlrkicnhpy
1021 mfqhieesfa ehlgysngvi ngaelyrasg kfelldrilp klratnhrvl lfcqmtslmt
1081 imedyfafrn flylrldgtt ksedraallk kfnepgsqyf ifllstragg lglnlqaadt
1141 vvifdsdwnp hqdlqaqdra hrigqgnevr vlrlctvnsv eekilaaaky klnvdqkviq
1201 agmfdqksss herraflqai leheeeneee devpddetln qmiarreeef dlfmrmdmdr
1261 rredarnpkr kprlmeedel pswiikddae verltceeee ekifgrgsrq rrdvdysdal
1321 tekqwlraie dgnleemeee vrlkkrkrrr nvdkdpaked vekakkrrgr ppaeklspnp
1381 pkltkqmnai idtvinykds sgrqlsevfi qlpsrkelpe yyelirkpvd fkkikerirn
1441 hkyrslgdle kdvmllchna qtfnlegsqi yedsivlqsv fksarqkiak eeesedesne
1501 eeeeedeees eseaksvkvk iklnkkddkg rdkgkgkkrp nrgkakpvvs dfdsdeecide
1561 reqsegsgtd de
```

SEQ ID NO: 168 Human SMARCA2 cDNA Sequence Variant 2 (NM_139045.3, CDS: 223-4941)

```
   1 gcgtcttccg gcgcccgcgg aggaggcgag ggtgggacgc tgggcggagc ccgagtttag
  61 gaagaggagg ggacggctgt catcaatgaa gtcatattca taatctagtc ctctctccct
 121 ctgtttctgt actctgggtg actcagagag ggaagagatt cagccagcac actcctcgcg
 181 agcaagcatt actctactga ctggcagaga caggagaggt agatgtccac gcccacagac
 241 cctggtgcga tgccccaccc agggccttcg ccggggcctg ggccttcccc tgggccaatt
 301 cttgggccta gtccaggacc aggaccatcc ccaggttccg tccacagcat gatggggcca
 361 agtcctggac ctccaagtgt ctcccatcct atgccgacga tggggtccac agacttccca
 421 caggaaggca tgcatcaaat gcataagccc atcgatggta tacatgacaa ggggattgta
 481 gaagacatcc attgtggatc catgaagggc actggtatgc gaccacctca cccaggcatg
 541 ggccctcccc agagtccaat ggatcaacac agccaaggtt atatgtcacc acacccatct
 601 ccattaggag ccccagagca cgtctccagc cctatgtctg gaggaggccc aactccacct
 661 cagatgccac caagccagcc gggggccctc atcccaggtg atccgcaggc catgagccag
 721 cccaacagag gtccctcacc tttcagtcct gtccagctgc atcagcttcg agctcagatt
 781 ttagcttata aaatgctggc ccgaggccag cccctccccg aaacgctgca gcttgcagtc
 841 caggggaaaa ggacgttgcc tggcttgcag caacaacagc agcagcaaca gcagcagcag
 901 cagcagcagc agcagcagca gcagcagcaa cagcagccgc agcagcagcc gccgcaacca
 961 cagacgcagc aacaacagca gccggccctt gttaactaca acagaccatc tggcccgggg
1021 ccggagctga gcggcccgag caccccgcag aagctgccgg tgcccgcgcc cggcggccgg
1081 ccctcgcccg cgccccccgc agccgcgcag ccgcccgcgg ccgcagtgcc cgggccctca
1141 gtgccgcagc cggccccggg gcagccctcg cccgtcctcc agctgcagca gaagcagagc
1201 cgcatcagcc ccatccagaa accgcaaggc ctggaccccg tggaaattct gcaagagcgg
1261 gaatacagac ttcaggcccg catagctcat aggatacaag aactggaaaa tctgcctggc
1321 tctttgccac cagatttaag aaccaaagca accgtggaac taaaagcact tcggttactc
1381 aatttccagc gtcagctgag acaggaggtg gtggcctgca tgcgcaggga cacgaccctg
1441 gagacggctc tcaactccaa agcatacaaa cggagcaagc gccagactct gagagaagct
1501 cgcatgaccg agaagctgga gaagcagcag aagattgagc aggagaggaa acgccgtcag
1561 aaacaccagg aatacctgaa cagtattttg caacatgcaa aagattttaa ggaatatcat
1621 cggtctgtgg ccggaaagat ccagaagctc tccaaagcag tggcaacttg gcatgccaac
1681 actgaaagag agcagaagaa ggagacagag cggattgaaa aggagagaat gcggcgactg
1741 atggctgaag atgaggaggg ttatagaaaa ctgattgatc aaaagaaaga caggcgttta
1801 gcttaccttt tgcagcagac cgatgagtat gtagccaatc tgaccaatct ggtttgggag
1861 cacaagcaag cccaggcagc caaagagaag aagaagagga ggaggaggaa gaagaaggct
1921 gaggagaatg cagagggtgg ggagtctgcc ctgggaccgg atggagagcc catagatgag
1981 agcagccaga tgagtgacct ccctgtcaaa gtgactcaca cagaaaccgg caaggttctg
2041 ttcggaccag aagcacccaa agcaagtcag ctggacgcct ggctggaaat gaatcctggt
2101 tatgaagttg cccctagatc tgacagtgaa gagagtgatt ctgattatga ggaagaggat
2161 gaggaagaag agtccagtag gcaggaaacc gaagagaaaa tactcctgga tccaaatagc
2221 gaagaagttt ctgagaagga tgctaagcag atcattgaga cagctaagca agacgtggat
2281 gatgaataca gcatgcagta cagtgccagg ggctcccagt cctactacac cgtggctcat
2341 gccatctcgg agagggtgga gaaacagtct gccctcctaa ttaatgggac cctaaagcat
2401 taccagctcc agggcctgga atggatggtt tccctgtata ataacaactt gaacggaatc
2461 ttagccgatg aaatggggct tggaaagacc atacagacca ttgcactcat cacttatctg
2521 atggagcaca aaagactcaa tggcccctat ctcatcattg ttcccctttc gactctatct
2581 aactggacat atgaatttga caaatgggct ccttctgtgg tgaagatttc ttacaagggt
2641 actcctgcca tgcgtcgctc ccttgtcccc cagctacgga gtggcaaatt caatgtcctc
2701 ttgactactt atgagtatat tataaaagac aagcacattc ttgcaaagat tcggtggaaa
2761 tacatgatag tggacgaagg ccaccgaatg aagaatcacc actgcaagct gactcaggtc
2821 ttgaacactc actatgtggc ccccagaagg atcctcttga ctgggacccc gctgcagaat
2881 aagctccctg aactctgggc cctcctcaac ttcctcctcc caacaatttt taagagctgc
2941 agcacatttg aacaatggtt caatgctcca tttgccatga ctggtgaaag ggtggactta
3001 aatgaagaag aaactatatt gatcatcagg cgtctacata aggtgttaag accattttta
3061 ctaaggagac tgaagaaaga agttgaatcc cagcttcccg aaaaagtgga atatgtgatc
3121 aagtgtgaca tgtcagctct gcagaagatt ctgtatcgcc atatgcaagc caaggggatc
3181 cttctcacag atggttctga gaaagataag aaggggaaag gaggtgctaa gacacttatg
3241 aacactatta tgcagttgag aaaaatctgc aaccacccat atatgtttca gcacattgag
3301 gaatcctttg ctgaacacct aggctattca aatggggtca tcaatggggc tgaactgtat
3361 cgggcctcag ggaagtttga gctgcttgat cgtattctgc caaaattgag agcgactaat
3421 caccgagtgc tgcttttctg ccagatgaca tctctcatga ccatcatgga ggattatttt
3481 gcttttcgga acttccttta cctacgcctt gatggcacca ccaagtctga agatcgtgct
3541 gctttgctga agaaattcaa tgaacctgga tcccagtatt tcatttctt gctgagcaca
3601 agagctggtg gcctgggctt aaatcttcag gcagctgata cagtggtcat ctttgacagc
```

TABLE 1-continued

```
3661 gactggaatc ctcatcagga tctgcaggcc caagaccgag ctcaccgcat cgggcagcag
3721 aacgaggtcc gggtactgag gctctgtacc gtgaacagcg tggaggaaaa gatcctcgcg
3781 gccgcaaaat acaagctgaa cgtggatcag aaagtgatcc aggcgggcat gtttgaccaa
3841 aagtcttcaa gccacgagcg gagggcattc ctgcaggcca tcttggagca tgaggaggaa
3901 aatgaggaag aagatgaagt accggacgat gagactctga accaaatgat tgctcgacga
3961 gaagaagaat ttgacctttt tatgcggatg gacatggacc ggcggaggga agatgcccgg
4021 aacccgaaac ggaagccccg tttaatggag gaggatgagc tgccctcctg gatcattaag
4081 gatgacgctg aagtagaaag gctcacctgt gaagaagagg aggagaaaat atttgggagg
4141 gggtcccgcc agcgccgtga cgtggactac agtgacgccc tcacggagaa gcagtggcta
4201 agggccatcg aagacggcaa tttggaggaa atggaagagg aagtacggct taagaagcga
4261 aaaagacgaa gaaatgtgga taaagatcct gcaaaagaag atgtggaaaa agctaagaag
4321 agaagaggcc gccctcccgc tgagaaactg tcaccaaatc cccccaaact gacaaagcag
4381 atgaacgcta tcatcgatac tgtgataaac tacaaagata gttcagggcg acagctcagt
4441 gaagtcttca ttcagttacc ttcaaggaaa gaattaccag aatactatga attaattagg
4501 aagccagtgg atttcaaaaa aataaaggaa aggattcgta atcataagta ccggagccta
4561 ggcgacctgg agaaggatgt catgcttctc tgtcacaacg ctcagacgtt caacctggag
4621 ggatcccaga tctatgaaga ctccatcgtc ttacagtcag tgtttaagag tgcccggcag
4681 aaaattgcca aagaggaaga gagtgaggat gaaagcaatg aagaggagga agaggaagat
4741 gaagaagagt cagagtccga ggcaaaatca gtcaaggtga aaattaagct caataaaaaa
4801 gatgacaaag gccgggacaa agggaaaggc aagaaaaggc caaatcgagg aaaagccaaa
4861 cctgtagtga gcgattttga cagcgatgag gagcaggatg aacgtgaaca gtcagaagga
4921 agtgggacgg atgatgagtg atcagtatgg accttttttcc ttggtagaac tgaattcctt
4981 cctcccctgt ctcatttcta cccagtgagt tcatttgtca tataggcact gggttgtttc
5041 tatatcatca tcgtctataa actagcttta ggatagtgcc agacaaacat atgatatcat
5101 ggtgtaaaaa acacacacat acacaaatat ttgtaacata ttgtgaccaa atgggcctca
5161 aagattcaga ttgaaacaaa caaaaagctt ttgatggaaa atatgtgggt ggatagtata
5221 tttctatggg tgggtctaat ttggtaacgg tttgattgtg cctggtttta tcacctgttc
5281 agatgagaag atttttgtct tttgtagcac tgataaccag gagaagccat taaaagccac
5341 tggttatttt atttttcatc aggcaatttt cgaggttttt atttgttcgg tattgttttt
5401 ttacactgtg gtacatataa gcaactttaa taggtgataa atgtacagta gttagatttc
5461 acctgcatat acatttttcc attttatgct ctatgatctg aacaaaagct ttttgaattg
5521 tataagattt atgtctactg taaacattgc ttaatttttt tgctcttgat ttaaaaaaaa
5581 gttttgttga aagcgctatt gaatattgca atctatatag tgtattggat ggcttctttt
5641 gtcaccctga tctcctatgt taccaatgtg tatcgtctcc ttctccctaa agtgtactta
5701 atctttgctt tctttgcaaa atgtctttgg ttgcaagtca taagcctgag gcaaataaaa
5761 ttccagtaat ttcgaagaat gtggtgttgg tgctttccta ataaagaaat aatttagctt
5821 gacaaaaaaa aaaaaaaa
```

SEQ ID NO: 169 Human SMARCA2 Amino Acid Sequence Isoform C (NP_001276326.1)

```
   1 mstptdpgam phpgpspgpg pspgpilgps pgpgpspgsv hsmmgpspgp psyshpmptm
  61 gstdfpqegm hqmhkpidgi hdkgivedih cgsmkgtgmr pphpgmgppq spmdqhsqgy
 121 msphpsplga pehvsspmsg ggptppqmpp sqpgalipgd pqamsqpnrg pspfspvglh
 181 qlragilayk mlargqplpe tlglavqgkr tlpglqqqqq qqqqqqqqqq qqqqqqqqpq
 241 qqppqpqtqq qqqpalvnyn rpsgpgpels gpstpqklpv papggrpspa ppaaaqppaa
 301 avpgpsvpqp apgqpspvlq lqqkqsrisp iqkpqgldpv eilqereyrl qariahrige
 361 lenlpgslpp dlrtkatvel kalrllnfqr qlrgevvacm rrdttletal nskaykrskr
 421 qtlrearmte klekqqkieq erkrrqkhqe ylnsilqhak dfkeyhrsva gkiqklskav
 481 atwhantere qkketeriek ermrrlmaed eegyrklidq kkdrrlayll qqtdeyvanl
 541 tnlvwehkqa qaakekkkrr rrkkkaeena eggesalgpd gepidessqm sdlpvkvtht
 601 etgkvlfgpe apkasqldaw lemnpgyeva prsdseesds dyeeedeeee ssrqeteeki
 661 lldpnseevs ekdakqiiet akqdvddeys mgysargsgs yytvahaise rvekqsalli
 721 ngtlkhyqlq glewmvslyn nnlngilade mglgktiqti alitylmehk rlngpyliiv
 781 plstlsnwty efdkwapsvv kisykgtpam rrslvpqlrs gkfnvlltty eyiikdkhil
 841 akirwkymiv deghrmknhh ckltqvdlne eetiliirrl hkvlrpfllr rlkkevesql
 901 pekveyvikc dmsalqkily rhmqakgill tdgsekdkkg kggaktlmnt imqlrkicnh
 961 pymfqhiees faehlgysng vingaelyra sgkfelldri lpklratnhr vllfcgmtsl
1021 mtimedyfaf rnflylrldg ttksedraal lkkfnepgsq yfifllstra gglglnlqaa
1081 dtvvifdsdw nphqdlqaqd rahrigqgne vrvlrlctvn sveekilaaa kyklnvdqkv
1141 igagmfdqks ssherraflq aileheeene eedevpddet lnqmiarree efdlfmrmdm
1201 drrredarnp krkprlmeed elpswiikdd aeverltcee eeekifgrgs rqrrdvdysd
1261 altekqwlra iedgnleeme eevrlkkrkr rrnvdkdpak edvekakkrr grppaeklsp
1321 nppkltkqmn aiidtvinyk dssgrqlsev fiqlpsrkel peyyelirkp vdfkkikeri
1381 rnhkyrslgd lekdvmllch naqtfnlegs qiyedsivlq svfksarqki akeeesedes
1441 neeeeeedee eseseaksvk vkiklnkkdd kgrdkgkgkk rpnrgkakpv vsdfdsdeeq
1501 dereqsegsg tdde
```

SEQ ID NO: 170 Human SMARCA2 cDNA Sequence Variant 4 (NM_001289397.1, CDS: 223-4767)

```
   1 gcgtcttccg gcgcccgcgg aggaggcgag ggtgggacgc tgggcggagc ccgagtttag
  61 gaagaggagg ggacggctgt catcaatgaa gtcatattca taatctagtc ctctctccct
 121 ctgtttctgt actctgggtg actcagagag ggaagagatt cagccagcac actcctcgcg
 181 agcaagcatt actctactga ctggcagaga caggagaggt agatgtccac gcccacagac
 241 cctggtgcga tgccccaccc agggccttcg ccggggcctg ggccttcccc tgggccaatt
 301 cttgggccta gtccaggacc aggaccatcc ccaggttccg tccacagcat gatggggcca
 361 agtcctggac ctccaagtgt ctcccatcct atgccgacga tggggtccac agacttccca
 421 caggaaggca tgcatcaaat gcataagccc atcgatggta tacatgacaa ggggattgta
 481 gaagacatcc attgtggatc catgaagggc actggtatgc gaccacctca cccaggcatg
 541 ggccctcccc agagtccaat ggatcaacac agccaaggtt atatgtcacc acacccatct
 601 ccattaggag ccccagagca cgtctccagc cctatgtctg gaggaggccc aactccacct
 661 cagatgccac caagccagcc gggggccctc atcccaggtg atccgcaggc catgagccag
```

TABLE 1-continued

| | | | | | | |
|---|---|---|---|---|---|---|
| 721 | cccaacagag | gtccctcacc | tttcagtcct | gtccagctgc | atcagcttcg | agctcagatt |
| 781 | ttagcttata | aaatgctggc | ccgaggccag | cccctccccg | aaacgctgca | gcttgcagtc |
| 841 | caggggaaaa | ggacgttgcc | tggcttgcag | caacaacagc | agcagcaaca | gcagcagcag |
| 901 | cagcagcagc | agcagcagca | gcagcagcaa | cagcagccgc | agcagcagcc | gccgcaacca |
| 961 | cagacgcagc | aacaacagca | gccggccctt | gttaactaca | acagaccatc | tggcccgggg |
| 1021 | ccggagctga | gcggcccgag | caccccgcag | aagctgccgg | tgcccgcgcc | cggcggccgg |
| 1081 | ccctcgcccg | cgccccccgc | agccgcgcag | ccgcccgcgg | ccgcagtgcc | cgggccctca |
| 1141 | gtgccgcagc | cggccccggg | gcagccctcg | cccgtcctcc | agctgcagca | gaagcagagc |
| 1201 | cgcatcagcc | ccatccagaa | accgcaaggc | ctggaccccg | tggaaattct | gcaagagcgg |
| 1261 | gaatacagac | ttcaggcccg | catagctcat | aggatacaag | aactggaaaa | tctgcctggc |
| 1321 | tctttgccac | cagatttaag | aaccaaagca | accgtggaac | taaaagcact | tcggttactc |
| 1381 | aatttccagc | gtcagctgag | acaggaggtg | gtggcctgca | tgcgcaggga | cacgaccctg |
| 1441 | gagacggctc | tcaactccaa | agcatacaaa | cggagcaagc | gccagactct | gagagaagct |
| 1501 | cgcatgaccg | agaagctgga | gaagcagcag | aagattgagc | aggagaggaa | acgccgtcag |
| 1561 | aaacaccagg | aatacctgaa | cagtattttg | caacatgcaa | aagattttaa | ggaatatcat |
| 1621 | cggtctgtgg | ccggaaagat | ccagaagctc | tccaaagcag | tggcaacttg | gcatgccaac |
| 1681 | actgaaagag | agcagaagaa | ggagacagag | cggattgaaa | aggagagaat | gcggcgactg |
| 1741 | atggctgaag | atgaggaggg | ttatagaaaa | ctgattgatc | aaaagaaaga | caggcgttta |
| 1801 | gcttaccttt | tgcagcagac | cgatgagtat | gtagccaatc | tgaccaatct | ggtttgggag |
| 1861 | cacaagcaag | cccaggcagc | caaagagaag | aagaagagga | ggaggaggaa | gaagaaggct |
| 1921 | gaggagaatg | cagagggtgg | ggagtctgcc | ctgggaccgg | atggagagcc | catagatgag |
| 1981 | agcagccaga | tgagtgacct | ccctgtcaaa | gtgactcaca | cagaaaccgg | caaggttctg |
| 2041 | ttcggaccag | aagcacccaa | agcaagtcag | ctggacgcct | ggctggaaat | gaatcctggt |
| 2101 | tatgaagttg | cccctagatc | tgacagtgaa | gagagtgatt | ctgattatga | ggaagaggat |
| 2161 | gaggaagaag | agtccagtag | gcaggaaacc | gaagagaaaa | tactcctgga | tccaaatagc |
| 2221 | gaagaagttt | ctgagaagga | tgctaagcag | atcattgaga | cagctaagca | agacgtggat |
| 2281 | gatgaataca | gcatgcagta | cagtgccagg | ggctcccagt | cctactacac | cgtggctcat |
| 2341 | gccatctcgg | agagggtgga | gaaacagtct | gccctcctaa | ttaatgggac | cctaaagcat |
| 2401 | taccagctcc | agggcctgga | atggatggtt | tccctgtata | ataacaactt | gaacggaatc |
| 2461 | ttagccgatg | aaatggggct | tggaaagacc | atacagacca | ttgcactcat | cacttatctg |
| 2521 | atggagcaca | aaagactcaa | tggcccctat | ctcatcattg | ttcccctttc | gactctatct |
| 2581 | aactggacat | atgaatttga | caaatgggct | ccttctgtgg | tgaagatttc | ttacaagggt |
| 2641 | actcctgcca | tgcgtcgctc | ccttgtcccc | cagctacgga | gtggcaaatt | caatgtcctc |
| 2701 | ttgactactt | atgagtatat | tataaaagac | aagcacattc | ttgcaaagat | tcggtggaaa |
| 2761 | tacatgatag | tggacgaagg | ccaccgaatg | aagaatcacc | actgcaagct | gactcaggtg |
| 2821 | gacttaaatg | aagaagaaac | tatattgatc | atcaggcgtc | tacataaggt | gttaagacca |
| 2881 | tttttactaa | ggagactgaa | gaaagaagtt | gaatcccagc | ttcccgaaaa | agtggaatat |
| 2941 | gtgatcaagt | gtgacatgtc | agctctgcag | aagattctgt | atcgccatat | gcaagccaag |
| 3001 | gggatccttc | tcacagatgg | ttctgagaaa | gataagaagg | ggaaaggagg | tgctaagaca |
| 3061 | cttatgaaca | ctattatgca | gttgagaaaa | atctgcaacc | acccatatat | gtttcagcac |
| 3121 | attgaggaat | cctttgctga | acacctaggc | tattcaaatg | ggtcatcaa | tggggctgaa |
| 3181 | ctgtatcggg | cctcagggaa | gtttgagctg | cttgatcgta | ttctgccaaa | attgagagcg |
| 3241 | actaatcacc | gagtgctgct | tttctgccag | atgacatctc | tcatgaccat | catggaggat |
| 3301 | tattttgctt | ttcggaactt | cctttaccta | cgccttgatg | gcaccaccaa | gtctgaagat |
| 3361 | cgtgctgctt | tgctgaagaa | attcaatgaa | cctggatccc | agtatttcat | tttcttgctg |
| 3421 | agcacaagag | ctggtggcct | gggcttaaat | cttcaggcag | ctgatacagt | ggtcatcttt |
| 3481 | gacagcgact | ggaatcctca | tcaggatctg | caggcccaag | accgagctca | ccgcatcggg |
| 3541 | cagcagaacg | aggtccgggt | actgaggctc | tgtaccgtga | acagcgtgga | ggaaaagatc |
| 3601 | ctcgcggccg | caaaatacaa | gctgaacgtg | gatcagaaag | tgatccaggc | gggcatgttt |
| 3661 | gaccaaaagt | cttcaagcca | cgagcggagg | gcattcctgc | aggccatctt | ggagcatgag |
| 3721 | gaggaaaatg | aggaagaaga | tgaagtaccg | gacgatgaga | ctctgaacca | aatgattgct |
| 3781 | cgacgagaag | aagaatttga | ccttttttatg | cggatggaca | tggaccggcg | gagggaagat |
| 3841 | gcccggaacc | cgaaacggaa | gccccgttta | atggaggagg | atgagctgcc | ctcctggatc |
| 3901 | attaaggatg | acgctgaagt | agaaaggctc | acctgtgaag | aagaggagga | gaaaatattt |
| 3961 | gggagggggt | cccgccagcg | ccgtgacgtg | gactacagtg | acgccctcac | ggagaagcag |
| 4021 | tggctaaggg | ccatcgaaga | cggcaatttg | gaggaaatgg | aagaggaagt | acggcttaag |
| 4081 | aagcgaaaaa | gacgaagaaa | tgtggataaa | gatcctgcaa | aagaagatgt | ggaaaaagct |
| 4141 | aagaagagaa | gaggccgccc | tcccgctgag | aaactgtcac | caaatccccc | caaactgaca |
| 4201 | aagcagatga | acgctatcat | cgatactgtg | ataaactaca | aagatagttc | agggcgacag |
| 4261 | ctcagtgaag | tcttcattca | gttaccttca | aggaaagaat | taccagaata | ctatgaatta |
| 4321 | attaggaagc | cagtggattt | caaaaaaata | aaggaaagga | ttcgtaatca | taagtaccgg |
| 4381 | agcctaggcg | acctggagaa | ggatgtcatg | cttctctgtc | acaacgctca | gacgttcaac |
| 4441 | ctggagggat | cccagatcta | tgaagactcc | atcgtcttac | agtcagtgtt | taagagtgcc |
| 4501 | cggcagaaaa | ttgccaaaga | ggaagagagt | gaggatgaaa | gcaatgaaga | ggaggaagag |
| 4561 | gaagatgaag | aagagtcaga | gtccgaggca | aaatcagtca | aggtgaaaat | taagctcaat |
| 4621 | aaaaaagatg | acaaaggccg | ggacaaaggg | aaaggcaaga | aaaggccaaa | tcgaggaaaa |
| 4681 | gccaaacctg | tagtgagcga | ttttgacagc | gatgaggagc | aggatgaacg | tgaacagtca |
| 4741 | gaaggaagtg | ggacggatga | tgagtgatca | gtatggacct | tttttccttgg | tagaactgaa |
| 4801 | ttccttcctc | ccctgtctca | tttctaccca | gtgagttcat | ttgtcatata | ggcactgggt |
| 4861 | tgtttctata | tcatcatcgt | ctataaacta | gctttaggat | agtgccagac | aaacatatga |
| 4921 | tatcatggtg | taaaaaacac | acacatacac | aaatatttgt | aacatattgt | gaccaaatgg |
| 4981 | gcctcaaaga | ttcagattga | aacaaacaaa | aagcttttga | tggaaaatat | gtgggtggat |
| 5041 | agtatatttc | tatgggtggg | tctaatttgg | taacggtttg | attgtgcctg | gttttatcac |
| 5101 | ctgttcagat | gagaagattt | ttgtcttttg | tagcactgat | aaccaggaga | agccattaaa |
| 5161 | agccactggt | tattttattt | ttcatcaggc | aattttcgag | gtttttattt | gttcggtatt |
| 5221 | gtttttttac | actgtggtac | atataagcaa | ctttaatagg | tgataaatgt | acagtagtta |
| 5281 | gatttcacct | gcatatacat | ttttccattt | tatgctctat | gatctgaaca | aaagcttttt |
| 5341 | gaattgtata | agatttatgt | ctactgtaaa | cattgcttaa | ttttttttgct | cttgatttaa |
| 5401 | aaaaaagttt | tgttgaaagc | gctattgaat | attgcaatct | atatagtgta | ttggatggct |
| 5461 | tcttttgtca | ccctgatctc | ctatgttacc | aatgtgtatc | gtctccttct | ccctaaagtg |

TABLE 1-continued 5521 tacttaatct ttgctttctt tgcacaatgt ctttggttgc aagtcataag cctgaggcaa
5581 ataaaattcc agtaatttcg aagaatgtgg tgttggtgct ttcctaataa agaaataatt
5641 tagcttgaca aaaaaaaaaa aaaa SEQ ID NO: 171 Human SMARCA2 Amino Acid Sequence Isoform D (NP_001276327.1)
1 mwlaiedgnl eemeeevrlk krkrrrnvdk dpakedveka kkrrgrppae klspnppklt
61 kqmnaiidtv inykdssgrq lsevfiqlps rkelpeyyel irkpvdfkki kerirnhkyr
121 slgdlekdvm llchnaqtfn legsqiyeds ivlqsvfksa rqkiakeees edesneeeee
181 edeeesesea ksvkvkikln kkddkgrdkg kgkkrpnrgk akpvvsdfds deecidereqs
241 egsgtdde SEQ ID NO: 172 Human SMARCA2 cDNA Sequence Variant 5 (NM_001289398.1, CDS: 203-949)
1 cttggagagg cggaggtgga aacgatgcgc aggagttggc ttggggcttt ttgtttgcgt
61 gtccctgttt acctattcat aatcatggat cccctctgct ttgtgatact gtgaaccacg
121 cataacagca attctttaca ccaccgggtt gagaagaagg cgcctgaggc tgactttctg
181 gacctgccgt cacgcagtaa agatgtggtt ggccatcgaa gacggcaatt tggaggaaat
241 ggaagaggaa gtacggctta agaagcgaaa aagacgaaga aatgtggata aagatcctgc
301 aaaagaagat gtggaaaaag ctaagaagag aagaggccgc cctcccgctg agaaactgtc
361 accaaatccc cccaaactga caaagcagat gaacgctatc atcgatactg tgataaacta
421 caaagatagt tcagggcgac agctcagtga agtcttcatt cagttacctt caaggaaaga
481 attaccagaa tactatgaat taattaggaa gccagtggat ttcaaaaaaa taaaggaaag
541 gattcgtaat cataagtacc ggagcctagg cgacctggag aaggatgtca tgcttctctg
601 tcacaacgct cagacgttca acctggaggg atcccagatc tatgaagact ccatcgtctt
661 acagtcagtg tttaagagtg cccggcagaa aattgccaaa gaggaagaga gtgaggatga
721 aagcaatgaa gaggaggaag aggaagatga agaagagtca gagtccgagg caaaatcagt
781 caaggtgaaa attaagctca ataaaaaaga tgacaaaggc cgggacaaag ggaaaggcaa
841 gaaaaggcca aatcgaggaa aagccaaacc tgtagtgagc gattttgaca gcgatgagga
901 gcaggatgaa cgtgaacagt cagaaggaag tgggacggat gatgagtgat cagtatggac
961 ctttttcctt ggtagaactg aattccttcc tcccctgtct catttctacc cagtgagttc
1021 atttgtcata taggcactgg gttgtttcta tatcatcatc gtctataaac tagctttagg
1081 atagtgccag acaaacatat gatatcatgg tgtaaaaaac acacacatac acaaatattt
1141 gtaacatatt gtgaccaaat gggcctcaaa gattcagatt gaaacaaaca aaaagctttt
1201 gatggaaaat atgtgggtgg atagtatatt tctatgggtg ggtctaattt ggtaacggtt
1261 tgattgtgcc tggttttatc acctgttcag atgagaagat ttttgtcttt tgtagcactg
1321 ataaccagga gaagccatta aaagccactg gttattttat ttttcatcag gcaattttcg
1381 aggtttttat ttgttcggta ttgttttttt acactgtggt acatataagc aactttaata
1441 ggtgataaat gtacagtagt tagatttcac ctgcatatac atttttccat tttatgctct
1501 atgatctgaa caaaagcttt ttgaattgta taagatttat gtctactgta aacattgctt
1561 aatttttttg ctcttgattt aaaaaaaagt tttgttgaaa gcgctattga atattgcaat
1621 ctatatagtg tattggatgg cttcttttgt caccctgatc tcctatgtta ccaatgtgta
1681 tcgtctcctt ctccctaaag tgtacttaat ctttgctttc tttgcacaat gtctttggtt
1741 gcaagtcata agcctgaggc aaataaaatt ccagtaattt cgaagaatgt ggtgttggtg
1801 ctttcctaat aaagaaataa tttagcttga caaaaaaaaa aaaaaa SEQ ID NO: 173 Human SMARCA2 Amino Acid Sequence Isoform E (NP_001276328.1)
1 mkrlaarcfa gllilspltv isdsrpadsg kaiedgnlee meeevrlkkr krrrnvdkdp
61 akedvekakk rrgrppaekl spnppkltkq mnaiidtvin ykdssgrqls evfiqlpsrk
121 elpeyyelir kpvdfkkike rirnhkyrsl gdlekdvmll chnaqtfnle gsqiyedsiv
181 lqsvfksarq kiakeeesed esneeeeeed eeeseseaks vkvkiklnkk ddkgrdkgkg
241 kkrpnrgkak pvvsdfdsde egderegseg sgtdde SEQ ID NO: 174 Human SMARCA2 cDNA Sequence Variant 6 (NM_001289399.1, CDS: 106-936)
1 attcacttca ttaaatctag aggcagttga gcatgggagc cgtctgtatg ttgaattagg
61 gctcgcactc ttgcgcaaca cgtcaccagt cggaaactgg ggctgatgaa gagactagca
121 gctcgctgct ttgctggctt gttaatttta tccccactaa ctgtgatttc tgatagccgg
181 cctgctgata gtggtaaggc catcgaagac ggcaatttgg aggaaatgga agaggaagta
241 cggcttaaga agcgaaaaag acgaagaaat gtggataaag atcctgcaaa agaagatgtg
301 gaaaaagcta agaagagaag aggccgccct cccgctgaga aactgtcacc aaatcccccc
361 aaactgacaa agcagatgaa cgctatcatc gatactgtga taaactacaa agatagttca
421 gggcgacagc tcagtgaagt cttcattcag ttaccttcaa ggaaagaatt accagaatac
481 tatgaattaa ttaggaagcc agtggatttc aaaaaaataa aggaaaggat tcgtaatcat
541 aagtaccgga gcctaggcga cctggagaag gatgtcatgc ttctctgtca caacgctcag
601 acgttcaacc tggagggatc ccagatctat gaagactcca tcgtcttaca gtcagtgttt
661 aagagtgccc ggcagaaaat tgccaaagag gaagagagtg aggatgaaag caatgaagag
721 gaggaagagg aagatgaaga agagtcagag tccgaggcaa aatcagtcaa ggtgaaaatt
781 aagctcaata aaaaagatga caaaggccgg gacaaaggga aaggcaagaa aaggccaaat
841 cgaggaaaag ccaaacctgt agtgagcgat tttgacagcg atgaggagca ggatgaacgt
901 gaacagtcag aaggaagtgg gacggatgat gagtgatcag tatggacctt tttccttggt
961 agaactgaat tccttcctcc cctgtctcat ttctacccag tgagttcatt tgtcatatag
1021 gcactgggtt gtttctatat catcatcgtc tataaactag ctttaggata gtgccagaca
1081 aacatatgat atcatggtgt aaaaaacaca cacatacaca aatatttgta acatattgtg
1141 accaaatggg cctcaaagat tcagattgaa acaaacaaaa agcttttgat ggaaaatatg
1201 tgggtggata gtatatttct atgggtgggt ctaatttggt aacggtttga ttgtgcctgg
1261 ttttatcacc tgttcagatg agaagatttt tgtcttttgt agcactgata accaggagaa
1321 gccattaaaa gccactggtt attttatttt tcatcaggca attttcgagg tttttatttg
1381 ttcggtattg tttttttaca ctgtggtaca tataagcaac tttaataggt gataaatgta
1441 cagtagttag atttcacctg catatacatt tttccatttt atgctctatg atctgaacaa
1501 aagctttttg aattgtataa gatttatgtc tactgtaaac attgcttaat ttttttgctc TABLE 1-continued

```
1561 ttgatttaaa aaaaagtttt gttgaaagcg ctattgaata ttgcaatcta tatagtgtat
1621 tggatggctt cttttgtcac cctgatctcc tatgttacca atgtgtatcg tctccttctc
1681 cctaaagtgt acttaatctt tgctttcttt gcacaatgtc tttggttgca agtcataagc
1741 ctgaggcaaa taaaattcca gtaatttcga agaatgtggt gttggtgctt tcctaataaa
1801 gaaataattt agcttgacaa aaaaaaaaaa aaa
```

SEQ ID NO: 175 Human SMARCA2 Amino Acid Sequence Isoform F (NP_001276329.1)

```
  1 mlmkrlaarc fagllilspl tvisdsrpad sgkaiedgnl eemeeevrlk krkrrrnvdk
 61 dpakedveka kkrrgrppae klspnppklt kqmnaiidtv inykdssgrq lsevfiqlps
121 rkelpeyyel irkpvdfkki kerirnhkyr slgdlekdvm llchnagtfn legsqiyeds
181 ivlqsvfksa rqkiakeees edesneeeee edeeesesea ksvkvkikln kkddkgrdkg
241 kgkkrpnrgk akpvvsdfds deeqdereqs egsgtdde
```

SEQ ID NO: 176 Human SMARCA2 cDNA Sequence Variant 7 (NM_001289400.1, CDS: 521-1357)

```
   1 acttcattaa atctagaggc agttgagcat gggagccgtc tgtatgttga attagggctc
  61 gcactcttgc gcaacacgtc accagtcgga aactgggggt ttgcttctgt gatttatttc
 121 attattgtgc tggtaaaagg tttggaaggg aattcttttt gggggtagta ctttagcatt
 181 gtgtagcaag ttttggggtt ttttttgtgt gtgacccccc agccccccagc gctgagtttg
 241 agtcagttga gccagtttag taaataattt tttaaaataa aagaacagtt taaaatctcc
 301 atgaataatt ttacttacat gcaggagtaa tcttactcta ctctttatgt gcgaaaagca
 361 ttgggaagtg tttagtgaat tgatttccat tagaaaaaga cccttagaaa tcacagaaca
 421 taaagcactg catatggatg tgtttggggt ctttggggag gagggaagat gttttgtagc
 481 tctctgcatt cctgcataaa accttagttt gaggggaata atgctgatga agagactagc
 541 agctcgctgc tttgctggct tgttaatttt atccccacta actgtgattt ctgatagccg
 601 gcctgctgat agtggtaagg ccatcgaaga cggcaatttg gaggaaatgg aagaggaagt
 661 acggcttaag aagcgaaaaa gacgaagaaa tgtggataaa gatcctgcaa aagaagatgt
 721 ggaaaaagct aagaagagaa gaggccgccc tcccgctgag aaactgtcac caaatccccc
 781 caaactgaca aagcagatga acgctatcat cgatactgtg ataaactaca aagatagttc
 841 agggcgacag ctcagtgaag tcttcattca gttaccttca aggaaagaat taccagaata
 901 ctatgaatta attaggaagc cagtggattt caaaaaaata aaggaaagga ttcgtaatca
 961 taagtaccgg agcctaggcg acctggagaa ggatgtcatg cttctctgtc acaacgctca
1021 gacgttcaac ctggagggat cccagatcta tgaagactcc atcgtcttac agtcagtgtt
1081 taagagtgcc cggcagaaaa ttgccaaaga ggaagagagt gaggatgaaa gcaatgaaga
1141 ggaggaagag gaagatgaag aagagtcaga gtccgaggca aaatcagtca aggtgaaaat
1201 taagctcaat aaaaaagatg acaaaggccg ggacaaaggg aaaggcaaga aaaggccaaa
1261 tcgaggaaaa gccaaacctg tagtgagcga ttttgacagc gatgaggagc aggatgaacg
1321 tgaacagtca gaaggaagtg ggacggatga tgagtgatca gtatggacct ttttccttgg
1381 tagaactgaa ttccttcctc ccctgtctca tttctaccca gtgagttcat ttgtcatata
1441 ggcactgggt tgtttctata tcatcatcgt ctataaacta gctttaggat agtgccagac
1501 aaacatatga tatcatggtg taaaaaacac acacatacac aaatatttgt aacatattgt
1561 gaccaaatgg gcctcaaaga ttcagattga aacaaacaaa aagcttttga tggaaaatat
1621 gtgggtggat agtatatttc tatgggtggg tctaatttgg taacggtttg attgtgcctg
1681 gtttatcac ctgttcagat gagaagattt ttgtcttttg tagcactgat aaccaggaga
1741 agccattaaa agccactggt tattttattt ttcatcaggc aattttcgag gtttttattt
1801 gttcggtatt gtttttttac actgtggtac atataagcaa ctttaatagg tgataaatgt
1861 acagtagtta gatttcacct gcatatacat ttttccattt tatgctctat gatctgaaca
1921 aaagcttttt gaattgtata agatttatgt ctactgtaaa cattgcttaa ttttttgct
1981 cttgatttaa aaaaaagttt tgttgaaagc gctattgaat attgcaatct atatagtgta
2041 ttggatggct tcttttgtca ccctgatctc ctatgttacc aatgtgtatc gtctccttct
2101 ccctaaagtg tacttaatct ttgctttctt tgcacaatgt ctttggttgc aagtcataag
2161 cctgaggcaa ataaaattcc agtaatttcg aagaatgtgg tgttggtgct ttcctaataa
2221 agaaataatt tagcttgaca aaaaaaaaaa aaaa
```

SEQ ID NO: 177 Mouse SMARCA2 cDNA Sequence variant 1 (NM_011416.2; CDS: 111-4862)

```
   1 ctcgctccct ctgtttctgt actctgggtg actcagagag ggaagattca gccagcacac
  61 tgctcgcgag caagtgtcac tctgctaact ggcagagcca ggagacctag atgtccacac
 121 ccacagaccc agcagcaatg ccccatcctg ggccctcccc ggggcctgga ccctctcctg
 181 gaccaattct ggggcctagt ccaggaccag gaccatcccc aggttctgtg cacagcatga
 241 tgggtcctag tcccggacct cccagcgtct cacatcctct gtcaacgatg ggctctgcag
 301 acttcccaca ggaaggcatg caccaattac ataagcccat ggatgggata catgacaaag
 361 ggattgtaga agatgtccac tgtggatcca tgaagggcac cagcatgcgc cccccacacc
 421 caggaatggg ccctccacag agccccatgg accagcacag ccaaggttat atgtcaccac
 481 atccgtctcc tctgggagcc ccggagcacg tctctagccc tatatctgga ggaggcccaa
 541 ccccaccccca gatgccaccg agccagccag gggcactcat cccaggagat ccgcaggcca
 601 tgaaccagcc taacagaggt ccctcgcctt tcagtcctgt gcagctgcat cagcttcgag
 661 ctcagatttt agcttacaaa atgttggcca ggggccagcc tctccctgaa actctgcagc
 721 tggcagtcca gggaaaaagg accttgcctg gcatgcagca gcagcagcag caacaacaac
 781 aacagcagca gcagcagcag cagcagcagc agcaacagca gcaacaacag cagccccagc
 841 agcctcagca gcaggctcag gcacagcccc agcagcagca gcaacagcag cagcagccag
 901 ctcttgttag ctataatcga ccatctggcc ccgggcagga gctgctactg agtggccaga
 961 gcgctccgca gaagctgtca gcaccagcac caagcggccg accttcaccg gcaccccagg
1021 ccgccgtcca gcccacggcc acagcggtgc ccgggccctc cgtgcagcag cccgccccag
1081 ggcagccgtc tccggtccta cagctgcaac agaagcagag ccgcatcagc cccatccaga
1141 aaccgcaagg cctggacccg gtggagatcc tgcaggaacg agagtacaga cttcaagctc
1201 gcatcgctca taggatacaa gaactggaaa gtctgcctgg ttccttgcca cccagatttac
1261 gcaccaaagc aaccgtggaa ctgaaagcac ttcgcttact caacttccaa cgtcagctga
1321 gacaggaggt ggtggcctgc atgcggaggg acaccaccct ggagacggcc ctcaactcca
1381 aagcatataa gcggagcaag cgccagaccc tgcgtgaggc acgcatgaca gagaaactgg
```

TABLE 1-continued 1441 agaagcagca gaagatagaa caggagagga aacgccggca gaaacaccag gaatacctga
1501 acagtatttt gcaacatgca aaagatttta aggaatatca ccggtctgtg gccgggaaga
1561 tccagaagct ctccaaagca gtggcgactt ggcatgctaa cacagaaagg gagcagaaga
1621 aggagacgga gcggatcgag aaggagagaa tgcggaggct gatggccgaa gatgaagagg
1681 gctacaggaa gcttattgac caaaagaaag acagacgtct cgcctaccta ttgcagcaga
1741 ccgatgagta tgtcgccaat ctgaccaacc tggtgtggga gcacaagcag gcccaagcag
1801 ccaaagagaa gaagaagagg aggaggagga agaagaaggc tgaagagaat gcagagggag
1861 gggaacctgc cctgggacca gatggagagc caatagatga aagcagccag atgagtgacc
1921 tgcctgtcaa agtgacacac acagaaactg gcaaggtcct ctttggacca gaagcaccca
1981 aagcaagtca gctggatgcc tggctggaga tgaatcctgg ttacgaagtt gcacccagat
2041 ctgacagtga agagagtgaa tcggactacg aggaggagga tgaagaagaa gagtccagta
2101 ggcaggaaac cgaggagaag atactgctgg atcccaacag tgaagaagtt tccgaaaagg
2161 atgccaagca gatcattgag actgcgaagc aggacgtgga cgacgaatac agcatgcagt
2221 acagtgccag aggctctcag tcctactaca cggtggctca cgctatctct gagagggtgg
2281 agaagcagtc tgccctcctc attaacggca ccctaaagca ttaccagctc cagggcctgg
2341 aatggatggt ttccctgtat aataacaatc tgaacggaat cttagctgat gaaatggggc
2401 taggcaagac catccagacc attgcactca tcacgtatct gatggagcac aaaaggctca
2461 atggtcccta cctcatcatc gtcccccctct cgactctgtc taactggaca tatgaatttg
2521 acaaatgggc tccttctgtg gtgaaaattt cttacaaggg tacccctgcc atgcgacgct
2581 ccctcgttcc ccagctacgg agtggcaaat tcaatgtcct cctgactact tacgagtaca
2641 ttataaaaga caagcacatt cttgcaaaga ttcggtggaa gtacatgatc gtggacgaag
2701 gccaccggat gaagaatcac cactgcaagc taacccaggt cctgaacaca cactatgtgg
2761 cccccaggcg gatccttctg actgggaccc cactgcagaa taagcttccg gaactctggg
2821 ccctcctcaa cttcctcctc cctacaatct tcaagagttg cagcacattt gagcagtggt
2881 ttaatgctcc atttgccatg accggtgaaa gggtggacct gaacgaagaa gaaacgattt
2941 tgatcatcag gcgtctacac aaggtgctga gacccttttt actgaggagg ctgaagaaag
3001 aggttgagtc tcagcttccg gaaaaggttg agtatgtgat caagtgtgac atgtcagctc
3061 tgcagaagat tctgtaccgt cacatgcaag ccaaggggat cctcctcacg gacgggtctg
3121 agaaagataa gaaggggaaa ggaggtgcca agacacttat gaacaccatc atgcagctga
3181 gaaaaatatg caaccaccca tatatgtttc agcacattga ggaatccttt gctgaacacc
3241 tgggctattc gaatggggtc atcaatgggg ctgagctgta tcgggcctcg ggaaagtttg
3301 agctgcttga tcgtattctg cccaaattga gagcgactaa ccaccgcgtg ctgcttttct
3361 gccagatgac gtcactcatg accattatgg aggattactt tgcttttcgg aacttcctgt
3421 acctgcgcct tgacggcacc accaagtctg aagatcgtgc tgctttgcta aagaaattca
3481 atgaacctgg gtcccagtat ttcatttttct tgctgagcac aagagcaggg ggcctgggct
3541 taaatcttca ggcggcagac acggtggtca tatttgacag cgactggaat cctcaccagg
3601 atctgcaggc ccaagaccga gctcaccgca ttggccaaca aaacgaggtc cgggtgctga
3661 ggctttgcac cgtcaacagt gtggaggaaa agattctcgc ggctgccaag tacaagctga
3721 acgtggatca gaaggttatc caagcaggca tgtttgacca gaagtcatcc agccacgagc
3781 ggagggcctt cctgcaggcc attctggagc acgaggagga gaatgaggaa gaagatgagg
3841 taccagacga cgagaccctg aaccagatga ttgctcgccg ggaggaagaa tttgatcttt
3901 ttatgcgcat ggacatggac cggcggaggg aggatgcccg gaacccgaag cgcaaacccc
3961 gcttgatgga ggaagatgag ctgccctcct ggattatcaa ggatgacgcc gaagtggaaa
4021 ggctcacctg tgaagaagag gaggagaaga tatttgggag gggctctcgc cagcgccggg
4081 atgtggacta cagtgatgcc ctcaccgaga agcaatggct cagggccatc gaagacggca
4141 atttggaaga aatggaagag gaggtacggc ttaagaagag aaaaagacga agaaatgtgg
4201 ataaagaccc cgtgaaggaa gatgtggaaa aagcgaagaa aagaagaggc cgccctccgg
4261 ctgagaagtt gtcaccaaat cccccaaaac taacgaagca gatgaacgcc atcattgata
4321 ctgtgataaa ctacaaagac agttcagggc gacagctcag tgaagtcttc attcagttac
4381 cttccaggaa agacttacca gaatactatg aattaattag gaagccagtg gatttcaaaa
4441 agataaagga gcgaatccgt aatcataagt atcggagcct gggagacctg gagaaagacg
4501 tcatgcttct ctgtcacaac gcacagacat tcaacttgga aggatcccag atctacgaag
4561 actccattgt cctacagtca gtgtttaaga gtgctcggca gaaaattgcc aaagaagaag
4621 agagtgagga agaaagcaat gaagaagagg aagaagatga tgaagaggag tcggagtcag
4681 aggcgaaatc tgtgaaggtg aaaatcaagc tgaataaaaa ggaagagaaa ggccgggaca
4741 cagggaaggg caagaagcgg ccaaaccgag gcaaagccaa acccgtcgtg agcgatttg
4801 acagtgacga ggaacaggaa gagaacgaac agtcagaagc aagtggaact gataacgagt
4861 gaccatcctg gacgtgagct tcccgcggtg gcagaaccga atgctttctt cccccctctcc
4921 ttcctcccca gtgagttcac ttgccattcg ggcacactgg gttatttctc cgtcctcatt
4981 gtcatctaga actagcttta gggtagtgcc agacaaacat atgatatcat ggtgtaaaaa
5041 aagaaacaca tgcgtgcaga cacactacac acacacacac acacacacac acacacacac
5101 acacatattt gtaacatatt gtgaccaaat gggcctcaaa gattcaaaga ttaaaaacaa
5161 aaagcttttg atggaaaaga tgtgggtgga tagtatattt ctacaggtgg gtcaggtttg
5221 gtagcagttt gatgtgctgg gttctgtcat ctgttctgat gagaagattt ttatcttctg
5281 cagtgctgat ggccgggagg aaccattcaa agccactggt tattttgttt ttcatcaggc
5341 gattttcaag attttcattt gtttcagtat tgttggtttt ctcttttctc ttttttacac
5401 tgtggtacat ataagcaact tgactagtga caaatgtaca gtagttagat atcacctaca
5461 tatacatttt tccattttat gctctatgat ctgaagaaca aaaaaaaaag ctttttgact
5521 tgtataagat ttatgtctac tgtaaacatt gcggaatttt tttttgttct tgttttattg
5581 acaatgctat tgagtattac agtgtctaga ataccctgga tggcttctct tgtccacccg
5641 atctcccgtg ttaccaatgt gtatggtctc cttctcccga aagtgtactt aatctttgct
5701 ttctttgcac aatgtctttg gttgcaagtc ataagcctga ggcaaataaa attccagtaa
5761 tttccaagaa tgtggtgttg gtactttcct aataaaccga taacgtacct tgaaaaaaaa
5821 aaaaaaaaaa a SEQ ID NO: 178 Mouse SMARCA2 Amino Acid Sequence isoform 1 (NP_035546.2)
1 mstptdpaam phpgpspgpg pspgpilgps pgpgpspgsv hsmmgpspgp psyshplstm
61 gsadfpqegm hqlhkpmdgi hdkgivedvh cgsmkgtsmr pphpgmgppq spmdqhsqgy
121 msphpsplga pehvsspisg ggptppqmpp sqpgalipgd pqamnqpnrg pspfspvglh
181 qlraqilayk mlargqplpe tlqlavqgkr tlpgmqqqqq qqqqqqqqqq qqqqqqqqqq TABLE 1-continued

```
 241 qpqqpqqqaq aqpqqqqqqq qqpalvsynr psgpgqelll sgqsapqkls apapsgrpsp
 301 apqaavqpta tavpgpsvqq papgqpspvl qlqqkgsris piqkpqgldp veilqereyr
 361 lqariahriq eleslpgslp pdlrtkatve lkalrllnfq rqlrqevvac mrrdttleta
 421 lnskaykrsk rqtlrearmt eklekqqkie qerkrrqkhq eylnsilqha kdfkeyhrsv
 481 agkiqklska vatwhanter eqkketerie kermrrlmae deegyrklid qkkdrrlayl
 541 lqqtdeyvan ltnlvwehkq aqaakekkkr rrrkkkaeen aeggepalgp dgepidessq
 601 msdlpvkvth tetgkvlfgp eapkasqlda wlemnpgyev aprsdseese sdyeeedeee
 661 essrqeteek illdpnseev sekdakqiie takqdvddey smqysargsq syytvahais
 721 ervekqsall ingtlkhyql qglewmvsly nnnlngilad emglgktiqt ialitylmeh
 781 kringpylii vplstlsnwt yefdkwapsv vkisykgtpa mrrslvpqlr sgkfnvlltt
 841 yeyiikdkhi lakirwkymi vdeghrmknh hckltqvint hyvaprrill tgtplqnklp
 901 elwallnfll ptifkscstf eqwfnapfam tgervdlnee etiliirrlh kvlrpfllrr
 961 lkkevesqlp ekveyvikcd msalqkilyr hmqakgillt dgsekdkkgk ggaktlmnti
1021 mqlrkicnhp ymfqhieesf aehlgysngv ingaelyras gkfelldril pklratnhry
1081 llfcgmtslm timedyfafr nflylrldgt tksedraall kkfnepgsqy fifllstrag
1141 glglnlqaad tvvifdsdwn phqdlqaqdr ahrigqgnev rvlrlctvns veekilaaak
1201 ykinvdqkvi qagmfdqkss sherraflqa ileheeenee edevpddetl nqmiarreee
1261 fdlfmrmdmd rrredarnpk rkprlmeede lpswiikdda everltceee eekifgrgsr
1321 qrrdvdysda ltekqwlrai edgnleemee evrlkkrkrr rnvdkdpvke dvekakkrrg
1381 rppaeklspn ppkltkqmna iidtvinykd ssgrqlsevf iqlpsrkdlp eyyelirkpv
1441 dfkkikerir nhkyrslgdl ekdvmllchn aqtfnlegsq iyedsivlqs vfksarqkia
1501 keeeseeesn eeeeeddeee seseaksvkv kiklnkkeek grdtgkgkkr pnrgkakpvv
1561 sdfdsdeeqe eneqseasgt dne
```

SEQ ID NO: 179 Mouse SMARCA2 cDNA Sequence variant 2 (NM_026003.2; CDS: 301-1011)

```
   1 ttcacttcat taaatctaga ggcggttcag catgggagcc gtctgtatgt tgaattaggg
  61 ctcgctctct tgcgcaacac gtcaccagtc ggaaactggg ggtttgcttc tgtgatttat
 121 ttcattattg tgctggtaaa agctgatgaa gagactagca gctcgctgct ttgccggctt
 181 gttaatttta tccccactaa ctgtgatttc cgatagccgg cctgctgata gtggtaagtg
 241 cggctggctc tggtttaaag caagcgtttg caggccatcg aagacggcaa tttggaagaa
 301 atggaagagg aggtacggct taagaagaga aaaagacgaa gaaatgtgga taaagacccc
 361 gtgaaggaag atgtggaaaa agcgaagaaa agaagaggcc gccctccggc tgagaagttg
 421 tcaccaaatc ccccaaaact aacgaagcag atgaacgcca tcattgatac tgtgataaac
 481 tacaaagaca gttcagggcg acagctcagt gaagtcttca ttcagttacc ttccaggaaa
 541 gacttaccag aatactatga attaattagg aagccagtgg atttcaaaaa gataaaggag
 601 cgaatccgta atcataagta tcggagcctg ggagacctgg agaaagacgt catgcttctc
 661 tgtcacaacg cacagacatt caacttggaa ggatcccaga tctacgaaga ctccattgtc
 721 ctacagtcag tgtttaagag tgctcggcag aaaattgcca aagaagaaga gagtgaggaa
 781 gaaagcaatg aagaagagga agaagatgat gaagaggagt cggagtcaga ggcgaaatct
 841 gtgaaggtga aaatcaagct gaataaaaag gaagagaaag gccgggacac agggaagggc
 901 aagaagcggc caaaccgagg caaagccaaa cccgtcgtga gcgattttga cagtgacgag
 961 gaacaggaag agaacgaaca gtcagaagca agtggaactg ataacgagtg accatcctgg
1021 acgtgagctt cccgcggtgg cagaaccgaa tgctttcttc cccctctcct tcctccccag
1081 tgagttcact tgccattcgg gcacactggg ttatttctcc gtcctcattg tcatctagaa
1141 ctagctttag ggtagtgcca gacaaacata tgatatcatg gtgtaaaaaa agaaacacat
1201 gcgtgcagac acactacaca cacacacaca cacacacaca cacacacaca cacatatttg
1261 taacatattg tgaccaaatg ggcctcaaag attcaaagat taaaaacaaa aagcttttga
1321 tggaaaagat gtgggtggat agtatatttc tacaggtggg tcaggtttgg tagcagtttg
1381 atgtgctggg ttctgtcatc tgttctgatg agaagatttt tatcttctgc agtgctgatg
1441 gccgggagga accattcaaa gccactggtt attttgtttt tcatcaggcg attttcaaga
1501 ttttcatttg tttcagtatt gttggttttc tcttttctct tttttacact gtggtacata
1561 taagcaactt gactagtgac aaatgtacag tagttagata tcacctacat atacattttt
1621 ccatttttatg ctctatgatc tgaagaacaa aaaaaaaagc tttttgactt gtataagatt
1681 tatgtctact gtaaacattg cggaattttt ttttgttctt gttttattga caatgctatt
1741 gagtattaca gtgtctagaa taccctggat ggcttctctt gtccacccga tctcccgtgt
1801 taccaatgtg tatggtctcc ttctcccgaa agtgtactta atctttgctt tctttgcaca
1861 atgtctttgg ttgcaagtca taagcctgag gcaaataaaa ttccagtaat ttccaagaat
1921 gtggtgttgg tactttccta ataaaccgat aacgtacctt gaaa
```

SEQ ID NO: 180 Mouse SMARCA2 Amino Acid Sequence isoform 2 (NP_080279.1)

```
   1 meeevrlkkr krrrnvdkdp vkedvekakk rrgrppaekl spnppkltkq mnaiidtvin
  61 ykdssgrqls evfiqlpsrk dlpeyyelir kpvdfkkike rirnhkyrsl gdlekdvmll
 121 chnaqtfnle gsqiyedsiv lqsvfksarq kiakeeesee esneeeeedd eeeseseaks
 181 vkvkiklnkk eekgrdtgkg kkrpnrgkak pvvsdfdsde egeenegsea sgtdne
```

SEQ ID NO: 181 Mouse SMARCA2 cDNA Sequence variant 3 (NM_001347439.1; CDS: 180-1010)

```
   1 acacacacac acacacacac acgcaggctg aagtatgctt aactctttta acttggctgg
  61 ggcttttttag caccatatgg gttctttcgt gacgtccgga cccgaaagag tgcagtgtgc
 121 ctttaaggaa agaggtacct caccaaactt ccctgtagtt gtgcctcacc atttagctga
 181 tgaagagact agcagctcgc tgctttgccg gcttgttaat tttatcccca ctaactgtga
 241 tttccgatag ccggcctgct gatagtggta aggccatcga agacggcaat ttggaagaaa
 301 tggaagagga ggtacggctt aagaagagaa aaagacgaag aaatgtggat aaagaccccg
 361 tgaaggaaga tgtggaaaaa gcgaagaaaa gaagaggccg ccctccggct gagaagttgt
 421 caccaaatcc cccaaaacta acgaagcaga tgaacgccat cattgatact gtgataaact
 481 acaaagacag ttcagggcga cagctcagtg aagtcttcat tcagttacct tccaggaaag
 541 acttaccaga atactatgaa ttaattagga agccagtgga tttcaaaaag ataaaggagc
 601 gaatccgtaa tcataagtat cggagcctgg gagacctgga gaaagacgtc atgcttctct
 661 gtcacaacgc acagacattc aacttggaag gatcccagat ctacgaagac tccattgtcc
```

TABLE 1-continued

```
 721 tacagtcagt gtttaagagt gctcggcaga aaattgccaa agaagaagag agtgaggaag
 781 aaagcaatga agaagaggaa gaagatgatg aagaggagtc ggagtcagag gcgaaatctg
 841 tgaaggtgaa aatcaagctg aataaaaagg aagagaaagg ccgggacaca gggaagggca
 901 agaagcggcc aaaccgaggc aaagccaaac ccgtcgtgag cgattttgac agtgacgagg
 961 aacaggaaga gaacgaacag tcagaagcaa gtggaactga taacgagtga ccatcctgga
1021 cgtgagcttc ccgcggtggc agaaccgaat gctttcttcc ccctctcctt cctccccagt
1081 gagttcactt gccattcggg cacactgggt tatttctccg tcctcattgt catctagaac
1141 tagctttagg gtagtgccag acaaacatat gatatcatgg tgtaaaaaaa gaaacacatg
1201 cgtgcagaca cactacacac acacacacac acacacacac acacacacac acatatttgt
1261 aacatattgt gaccaaatgg gcctcaaaga ttcaaagatt aaaaacaaaa agcttttgat
1321 ggaaaagatg tgggtggata gtatatttct acaggtgggt caggtttggt agcagtttga
1381 tgtgctgggt tctgtcatct gttctgatga gaagattttt atcttctgca gtgctgatgg
1441 ccgggaggaa ccattcaaag ccactggtta ttttgttttt catcaggcga ttttcaagat
1501 tttcatttgt ttcagtattg ttggttttct cttttctctt ttttacactg tggtacatat
1561 aagcaacttg actagtgaca aatgtacagt agttagatat cacctacata tacatttttc
1621 cattttatgc tctatgatct gaagaacaaa aaaaaaagct ttttgacttg tataagattt
1681 atgtctactg taaacattgc ggaatttttt tttgttcttg ttttattgac aatgctattg
1741 agtattacag tgtctagaat accctggatg gcttctcttg tccacccgat ctcccgtgtt
1801 accaatgtgt atggtctcct tctcccgaaa gtgtacttaa tctttgcttt ctttgcacaa
1861 tgtctttggt tgcaagtcat aagcctgagg caaataaaat tccagtaatt tccaagaatg
1921 tggtgttggt actttcctaa taaaccgata acgtaccttg aaaaaaaaaa aaaaaaaaa
```

SEQ ID NO: 182 Mouse SMARCA2 Amino Acid Sequence isoform 3 (NP_001334368.1)

```
   1 mkrlaarcfa gllilspltv isdsrpadsg kaiedgnlee meeevrlkkr krrrnvdkdp
  61 vkedvekakk rrgrppaekl spnppkltkq mnaiidtvin ykdssgrqls evfiqlpsrk
 121 dlpeyyelir kpvdfkkike rirnhkyrsl gdlekdvmll chnaqtfnle gsqiyedsiv
 181 lqsvfksarq kiakeeesee esneeeeedd eeeseseaks vkvkiklnkk eekgrdtgkg
 241 kkrpnrgkak pvvsdfdsde eqeeneqsea sgtdne
```

SEQ ID NO: 183 Human SMARCA4 Amino Acid Sequence Isoform A (NP_001122321.1)

```
   1 mstpdpplgg tprpgpspgp gpspgamlgp spgpspgsah smmgpspgpp saghpiptqg
  61 pggypqdnmh qmhkpmesmh ekgmsddpry nqmkgmgmrs gghagmgppp spmdqhsqgy
 121 psplggseha sspvpasgps sgpqmssgpg gapldgadpq algqqnrgpt pfnqnqlhql
 181 ragimaykml argqplpdhl qmavqgkrpm pgmqqqmptl pppsysatgp gpgpgpgpgp
 241 gpgpappnys rphgmggpnm pppgpsgvpp gmpgqppggp pkpwpegpma naaaptstpq
 301 klippqptgr pspappavpp aaspvmppqt qspgqpaqpa pmvplhqkqs ritpiqkprg
 361 ldpveilger eyrlgariah riqelenlpg slagdlrtka tielkalrll nfqrqlrgev
 421 vvcmrrdtal etalnakayk rskrqslrea riteklekqq kiegerkrrq khqeylnsil
 481 qhakdfkeyh rsvtgkiqkl tkavatyhan tereqkkene riekermrrl maedeegyrk
 541 lidqkkdkrl ayllqqtdey vanitelvrq hkaaqvakek kkkkkkkkae naegqtpaig
 601 pdgepldets qmsdlpvkvi hvesgkiltg tdapkagqle awlemnpgye vaprsdsees
 661 gseeeeeeee eeqpqaaqpp tlpveekkki pdpdsddvse vdarhiiena kqdvddeygv
 721 sqalarglqs yyavahavte rvdkqsalmv ngvlkqyqik glewlvslyn nnlngilade
 781 mglgktiqti alitylmehk ringpfliiv plstlsnway efdkwapsvv kvsykgspaa
 841 rrafvpqlrs gkfnvlltty eyiikdkhil akirwkymiv deghrmknhh ckltqvinth
 901 yvaprrlllt gtplqnklpe lwallnfllp tifkscstfe qwfnapfamt gekvdlneee
 961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcgmtslmt imedyfayrg fkylrldgtt kaedrgmllk
1141 tfnepgseyf ifllstragg lglnlqsadt viifdsdwnp hqdlqaqdra hrigqqnevr
1201 vlrlctvnsv eekilaaaky klnvdqkviq agmfdqksss herraflqai leheeqdesr
1261 hcstgsgsas fahtapppag vnpdleeppl keedevpdde tvnqmiarhe eefdlfmrmd
1321 ldrrreearn pkrkprlmee delpswiikd daeverltce eeeekmfgrg srhrkevdys
1381 dsltekqwlk kitgkdihdt assvarglqf qrglqfctra skaieegtle eieeevrqkk
1441 ssrkrkrdsd agsstpttst rsrdkddesk kqkkrgrppa eklspnppnl tkkmkkivda
1501 vikykdsssg rqlsevfiql psrkelpeyy elirkpvdfk kikerirnhk yrslndlekd
1561 vmllcgnaqt fnlegsliye dsivlqsvft svrqkieked dsegeeseee eegeeegses
1621 esrsvkvkik lgrkekaqdr lkggrrrpsr gsrakpvvsd ddseeeqeed rsgsgseed
```

SEQ ID NO: 184 Human SMARCA4 cDNA Sequence Variant 1 (NM_001128849.1, CDS: 75-5114)

```
   1 ggcgggggag gcgcccggaa gtcgacggcg ccggcggctc ctgcaggagg ccactgtctg
  61 cagctcccgt gaagatgtcc actccagacc cacccctggg cggaactcct cggccaggtc
 121 cttccccggg ccctggccct tcccctggag ccatgctggg ccctagcccg ggtccctcgc
 181 cgggctccgc ccacagcatg atggggccca gcccagggcc gccctcagca ggacacccca
 241 tccccaccca ggggcctgga gggtaccctc aggacaacat gcaccagatg cacaagccca
 301 tggagtccat gcatgagaag ggcatgtcgg acgacccgcg ctacaaccag atgaaaggaa
 361 tggggatgcg gtcaggggc catgctggga tggggccccc gcccagcccc atggaccagc
 421 actcccaagg ttacccctcg cccctgggtg gctctgagca tgcctctagt ccagttccag
 481 ccagtggccc gtcttcgggg ccccagatgt cttccggggcc aggaggtgcc ccgctggatg
 541 gtgctgaccc ccaggccttg gggcagcaga accggggccc aaccccattt aaccagaacc
 601 agctgcacca gctcagagct cagatcatgg cctacaagat gctggccagg gggcagcccc
 661 tccccgacca cctgcagatg gcggtgcagg gcaagcggcc gatgcccggg atgcagcagc
 721 agatgccaac gctacctcca ccctcggtgt ccgcaacagg acccggccct ggccctggcc
 781 ctggccccgg cccgggtccc ggcccggcac ctccaaatta cagcaggcct catggtatgg
 841 gagggcccaa catgcctccc ccaggaccct cgggcgtgcc ccccgggatg ccaggccagc
 901 ctcctggagg gcctcccaag ccctggcctg aaggacccat ggcgaatgct gctgccccca
 961 cgagcaccco tcagaagctg attcccccgc agccaacggg ccgcccttcc cccgcgcccc
1021 ctgccgtccc acccgccgcc tcgcccgtga tgccaccgca gacccagtcc ccgggcagc
1081 cggcccagcc cgcgcccatg gtgccactgc accagaagca gagccgcatc acccccatcc
```

TABLE 1-continued

```
1141 agaagccgcg gggcctcgac cctgtggaga tcctgcagga gcgcgagtac aggctgcagg
1201 ctcgcatcgc acaccgaatt caggaacttg aaaaccttcc cgggtccctg gccggggatt
1261 tgcgaaccaa agcgaccatt gagctcaagg ccctcaggct gctgaacttc cagaggcagc
1321 tgcgccagga ggtggtggtg tgcatgcgga gggacacagc gctggagaca gccctcaatg
1381 ctaaggccta caagcgcagc aagcgccagt ccctgcgcga ggcccgcatc actgagaagc
1441 tggagaagca gcagaagatc gagcaggagc gcaagcgccg gcagaagcac caggaatacc
1501 tcaatagcat tctccagcat gccaaggatt tcaaggaata tcacagatcc gtcacaggca
1561 aaatccagaa gctgaccaag gcagtggcca cgtaccatgc caacacggag cgggagcaga
1621 agaaagagaa cgagcggatc gagaaggagc gcatgcggag gctcatggct gaagatgagg
1681 aggggtaccg caagctcatc gaccagaaga aggacaagcg cctggcctac ctcttgcagc
1741 agacagacga gtacgtggct aacctcacgg agctggtgcg gcagcacaag gctgcccagg
1801 tcgccaagga gaaaaagaag aaaaagaaaa agaagaaggc agaaaatgca gaaggacaga
1861 cgcctgccat tgggccggat ggcgagcctc tggacgagac cagccagatg agcgacctcc
1921 cggtgaaggt gatccacgtg gagagtggga agatcctcac aggcacagat gcccccaaag
1981 ccgggcagct ggaggcctgg ctcgagatga acccggggta tgaagtagct ccgaggtctg
2041 atagtgaaga aagtggctca gaagaagagg aagaggagga ggaggaagag cagccgcagg
2101 cagcacagcc tcccaccctg cccgtggagg agaagaagaa gattccagat ccagacagcg
2161 atgacgtctc tgaggtggac gcgcggcaca tcattgagaa tgccaagcaa gatgtcgatg
2221 atgaatatgg cgtgtcccag gcccttgcac gtggcctgca gtcctactat gccgtggccc
2281 atgctgtcac tgagagagtg gacaagcagt cagcgcttat ggtcaatggt gtcctcaaac
2341 agtaccagat caaaggtttg gagtggctgg tgtccctgta caacaacaac ctgaacggca
2401 tcctggccga cgagatgggc ctggggaaga ccatccagac catcgcgctc atcacgtacc
2461 tcatggagca caaacgcatc aatgggccct tcctcatcat cgtgcctctc tcaacgctgt
2521 ccaactgggc gtacgagttt gacaagtggg ccccctccgt ggtgaaggtg tcttacaagg
2581 gatccccagc agcaagacgg gcctttgtcc cccagctccg gagtgggaag ttcaacgtct
2641 tgctgacgac gtacgagtac atcatcaaag acaagcacat cctcgccaag atccgttgga
2701 agtacatgat tgtggacgaa ggtcaccgca tgaagaacca ccactgcaag ctgacgcagg
2761 tgctcaacac gcactatgtg gcaccccgcc gcctgctgct gacgggcaca ccgctgcaga
2821 acaagcttcc cgagctctgg gcgctgctca acttcctgct gcccaccatc ttcaagagct
2881 gcagcacctt cgagcagtgg tttaacgcac cctttgccat gaccggggaa aaggtggacc
2941 tgaatgagga ggaaaccatt ctcatcatcc ggcgtctcca caaagtgctg cggcccttct
3001 tgctccgacg actcaagaag gaagtcgagg cccagttgcc cgaaaaggtg gagtacgtca
3061 tcaagtgcga catgtctgcg ctgcagcgag tgctctaccg ccacatgcag gccaagggcg
3121 tgctgctgac tgatggctcc gagaaggaca agaagggcaa aggcggcacc aagaccctga
3181 tgaacaccat catgcagctg cggaagatct gcaaccaccc ctacatgttc cagcacatcg
3241 aggagtcctt ttccgagcac ttggggttca ctggcggcat tgtccaaggg ctggacctgt
3301 accgagcctc gggtaaattt gagcttcttg atagaattct tcccaaactc cgagcaacca
3361 accacaaagt gctgctgttc tgccaaatga cctccctcat gaccatcatg gaagattact
3421 ttgcgtatcg cggctttaaa tacctcaggc ttgatggaac cacgaaggcg gaggaccggg
3481 gcatgctgct gaaaaccttc aacgagcccg gctctgagta cttcatcttc ctgctcagca
3541 cccgggctgg ggggctcggc ctgaacctcc agtcggcaga cactgtgatc atttttgaca
3601 gcgactggaa tcctcaccag gacctgcaag cgcaggaccg agcccaccgc atcgggcagc
3661 agaacgaggt gcgtgtgctc cgcctctgca ccgtcaacag cgtggaggag aagatcctag
3721 ctgcagccaa gtacaagctc aacgtggacc agaaggtgat ccaggccggc atgttcgacc
3781 agaagtcctc cagccatgag cggcgcgcct tcctgcaggc catcctggag cacgaggagc
3841 aggatgagag cagacactgc agcacgggca gcggcagtgc cagcttcgcc cacactgccc
3901 ctccgccagc gggcgtcaac cccgacttgg aggagccacc tctaaaggag gaagacgagg
3961 tgcccgacga cgagaccgtc aaccagatga tcgcccggca cgaggaggag tttgatctgt
4021 tcatgcgcat ggacctggac cgcaggcgcg aggaggcccg caaccccaag cggaagccgc
4081 gcctcatgga ggaggacgag ctcccctcgt ggatcatcaa ggacgacgcg gaggtggagc
4141 ggctgacctg tgaggaggag gaggagaaga tgttcggccg tggctcccgc caccgcaagg
4201 aggtggacta cagcgactca ctgacggaga agcagtggct caagaaaatt acaggaaaag
4261 atatccatga cacagccagc agtgtggcac gtgggctaca attccagcgt ggccttcagt
4321 tctgcacacg tgcgtcaaag gccatcgagg agggcacgct ggaggagatc gaagaggagg
4381 tccggcagaa gaaatcatca cggaagcgca agcgagacag cgacgccggc tcctccaccc
4441 cgaccaccag cacccgcagc cgcgacaagg acgacgagag caagaagcag aagaagcgcg
4501 ggcggccgcc tgccgagaaa ctctccccta acccacccaa cctcaccaag aagatgaaga
4561 agattgtgga tgccgtgatc aagtacaagg acagcagcag tggacgtcag ctcagcgagg
4621 tcttcatcca gctgccctcg cgaaaggagc tgcccgagta ctacgagctc atccgcaagc
4681 ccgtggactt caagaagata aaggagcgca ttcgcaacca caagtaccgc agcctcaacg
4741 acctagagaa ggacgtcatg ctcctgtgcc agaacgcaca gaccttcaac ctggagggct
4801 ccctgatcta tgaagactcc atcgtcttgc agtcggtctt caccagcgtg cggcagaaaa
4861 tcgagaagga ggatgacagt gaaggcgagg agagtgagga ggaggaagag ggcgaggagg
4921 aaggctccga atccgaatct cggtccgtca aagtgaagat caagcttggc cggaaggaga
4981 aggcacagga ccggctgaag ggcggccggc ggcggccgag ccgagggtcc cgagccaagc
5041 cggtcgtgag tgacgatgac agtgaggagg aacaagagga ggaccgctca ggaagtggca
5101 gcgaagaaga ctgagccccg acattccagt ctcgaccccg agcccctcgt tccagagctg
5161 agatggcata ggccttagca gtaacgggta gcagcagatg tagtttcaga cttggagtaa
5221 aactgtataa acaaaagaat cttccatatt tatacagcag agaagctgta ggactgtttg
5281 tgactggccc tgtcctggca tcagtagcat ctgtaacagc attaactgtc ttaaagagag
5341 agagagagaa ttccgaattg gggaacacac gatacctgtt tttcttttcc gttgctggca
5401 gtactgttgc gccgcagttt ggagtcactg tagttaagtg tggatgcatg tgcgtcaccg
5461 tccactcctc ctactgtatt ttattggaca ggtcagactc gccgggggcc cggcgagggt
5521 atgtcagtgt cactggatgt caaacagtaa taaattaaac caacaacaaa acgcacagcc
5581 aaaaaaaaa
```

SEQ ID NO: 185 Human SMARCA4 Amino Acid Sequence Isoform B
(NP_001122316.1 and NP_003063.2)

```
 1 mstpdpplgg tprpgpspgp gpspgamlgp spgpspgsah smmgpspgpp saghpiptqg
61 pggypqdnmh qmhkpmesmh ekgmsddpry nqmkgmgmrs gghagmgppp spmdqhsqgy
```

TABLE 1-continued 121 psplggseha sspvpasgps sgpqmssgpg gapldgadpq algqqnrgpt pfnqnqlhql
181 raqimaykml argqplpdhl qmavqgkrpm pgmqqqmptl pppsysatgp gpgpgpgpgp
241 gpgpappnys rphgmggpnm pppgpsgvpp gmpgqppggp pkpwpegpma naaaptstpq
301 klippqptgr pspappavpp aaspvmppqt qspggpagpa pmvplhqkqs ritpiqkprg
361 ldpveilqer eyrlgariah rigelenlpg slagdlrtka tielkalrll nfqrqlrgev
421 vvcmrrdtal etalnakayk rskrqslrea riteklekqg kieqerkrrq khqeylnsil
481 qhakdfkeyh rsvtgkiqkl tkavatyhan tereqkkene riekermrrl maedeegyrk
541 lidqkkdkrl ayllqqtdey vanitelvrq hkaaqvakek kkkkkkkkae naegqtpaig
601 pdgepldets qmsdlpvkvi hvesgkiltg tdapkagqle awlemnpgye vaprsdsees
661 gseeeeeeee eeqpqaaqpp tlpveekkki pdpdsddvse vdarhiiena kqdvddeygv
721 sqalarglqs yyavahavte rvdkqsalmv ngvlkqyqik glewlvslyn nnlngilade
781 mglgktiqti alitylmehk ringpfliiv plstlsnway efdkwapsvv kvsykgspaa
841 rrafvpqlrs gkfnvlltty eyiikdkhil akirwkymiv deghrmknhh ckltqvinth
901 yvaprrlllt gtplqnklpe lwallnfllp tifkscstfe qwfnapfamt gekvdlneee
961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcgmtslmt imedyfayrg fkylrldgtt kaedrgmllk
1141 tfnepgseyf ifllstragg lglnlqsadt viifdsdwnp hqdlqaqdra hrigqgnevr
1201 vlrlctvnsv eekilaaaky klnvdqkviq agmfdqksss herraflqai leheeqdesr
1261 hcstgsgsas fahtapppag vnpdleeppl keedevpdde tvnqmiarhe eefdlfmrmd
1321 ldrrreearn pkrkprlmee delpswiikd daeverltce eeeekmfgrg srhrkevdys
1381 dsltekqwlk aieegtleei eeevrqkkss rkrkrdsdag sstpttstrs rdkddeskkq
1441 kkrgrppaek lspnppnitk kmkkivdavi kykdsssgrq lsevfiqlps rkelpeyyel
1501 irkpvdfkki kerirnhkyr slndlekdvm llcqnaqtfn legsliyeds ivlqsvftsv
1561 rqkiekedds egeeseeeee geeegseses rsvkvkiklg rkekaqdrlk ggrrrpsrgs
1621 rakpvvsddd seeeqeedrs gsgseed SEQ ID NO: 186 Human SMARCA4 cDNA Sequence Variant 2 (NM_001128844.1, CDS: 361-5304)

1 ggagaggccg ccgcggtgct gagggggagg ggagccggcg agcgcgcgcg cagcgggggc
61 gcgggtggcg cgcgtgtgtg tgaagggggg gcggtggccg aggcgggcgg gcgcgcgcgc
121 gaggcttccc ctcgtttggc ggcggcggcg gcttctttgt ttcgtgaaga gaagcgagac
181 gcccattctg cccccggccc cgcgcggagg ggcgggggag gcgccgggaa gtcgacggcg
241 ccggcggctc ctgcgtctcg ccctttttgcc caggctagag tgcagtggtg cggtcatggt
301 tcactgcagc ctcaacctcc tggactcagc aggaggccac tgtctgcagc tcccgtgaag
361 atgtccactc cagacccacc cctgggcgga actcctcggc caggtccttc cccgggccct
421 ggcccttccc ctggagccat gctgggccct agcccgggtc cctcgccggg ctccgcccac
481 agcatgatgg ggcccagccc agggccgccc tcagcaggac accccatccc cacccagggg
541 cctggagggt accctcagga caacatgcac cagatgcaca agcccatgga gtccatgcat
601 gagaagggca tgtcggacga cccgcgctac aaccagatga aaggaatggg gatgcggtca
661 gggggccatg ctgggatggg gcccccgccc agccccatgg accagcactc ccaaggttac
721 ccctcgcccc tgggtggctc tgagcatgcc tctagtccag ttccagccag tggcccgtct
781 tcggggcccc agatgtcttc cgggccagga ggtgccccgc tggatggtgc tgacccccag
841 gccttggggc agcagaaccg gggcccaacc ccatttaacc agaaccagct gcaccagctc
901 agagctcaga tcatggccta caagatgctg gccaggggggc agcccctccc cgaccacctg
961 cagatggcgg tgcagggcaa gcggccgatg cccgggatgc agcagcagat gccaacgcta
1021 cctccaccct cggtgtccgc aacaggaccc ggccctggcc ctggccctgg ccccggcccg
1081 ggtcccggcc cggcacctcc aaattacagc aggcctcatg gtatgggagg gcccaacatg
1141 cctcccccag gaccctcggg cgtgcccccc gggatgccag gccagcctcc tggagggcct
1201 cccaagccct ggcctgaagg acccatggcg aatgctgctg cccccacgag cacccctcag
1261 aagctgattc cccgcagcc aacgggccgc ccttccccccg cgccccctgc cgtcccaccc
1321 gccgcctcgc ccgtgatgcc accgcagacc cagtccccccg ggcagccggc ccagcccgcg
1381 cccatggtgc cactgcacca gaagcagagc cgcatcaccc ccatccagaa gccgcggggc
1441 ctcgaccctg tggagatcct gcaggagcgc gagtacaggc tgcaggctcg catcgcacac
1501 cgaattcagg aacttgaaaa ccttcccggg tccctggccg gggatttgcg aaccaaagcg
1561 accattgagc tcaaggccct caggctgctg aacttccaga ggcagctgcg ccaggaggtg
1621 gtggtgtgca tgcggaggga cacagcgctg gagacagccc tcaatgctaa ggcctacaag
1681 cgcagcaagc gccagtccct gcgcgaggcc cgcatcactg agaagctgga gaagcagcag
1741 aagatcgagc aggagcgcaa gcgccggcag aagcaccagg aatacctcaa tagcattctc
1801 cagcatgcca aggatttcaa ggaatatcac agatccgtca caggcaaaat ccagaagctg
1861 accaaggcag tggccacgta ccatgccaac acggagcggg agcagaagaa agagaacgag
1921 cggatcgaga aggagcgcat gcggaggctc atggctgaag atgaggaggg gtaccgcaag
1981 ctcatcgacc agaagaagga caagcgcctg gcctacctct tgcagcagac agacgagtac
2041 gtggctaacc tcacggagct ggtgcggcag cacaaggctg cccaggtcgc caaggagaaa
2101 aagaagaaaa agaaaaagaa gaaggcagaa aatgcagaag gacagacgcc tgccattggg
2161 ccggatggcg agcctctgga cgagaccagc cagatgagcg acctccccggt gaaggtgatc
2221 cacgtggaga gtgggaagat cctcacaggc acagatgccc ccaaagccgg gcagctggag
2281 gcctggctcg agatgaaccc ggggtatgaa gtagctccga ggtctgatag tgaagaaagt
2341 ggctcagaag aagaggaaga ggaggaggag gaagagcagc cgcaggcagc acagcctccc
2401 accctgcccg tggaggagaa gaagaagatt ccagatccag acagcgatga cgtctctgag
2461 gtggacgcgc ggcacatcat tgagaatgcc aagcaagatg tcgatgatga atatggcgtg
2521 tcccaggccc ttgcacgtgg cctgcagtcc tactatgccg tggcccatgc tgtcactgag
2581 agagtggaca agcagtcagc gcttatggtc aatggtgtcc tcaaacagta ccagatcaaa
2641 ggtttggagt ggctggtgtc cctgtacaac aacaacctga acggcatcct ggccgacgag
2701 atgggcctgg ggaagaccat ccagaccatc gcgctcatca cgtacctcat ggagcacaaa
2761 cgcatcaatg ggcccttcct catcatcgtg cctctctcaa cgctgtccaa ctgggcgtac
2821 gagtttgaca agtgggcccc ctccgtggtg aaggtgtctt acaagggatc cccagcagca
2881 agacgggcct ttgtccccca gctccggagt gggaagttca acgtcttgct gacgacgtac
2941 gagtacatca tcaaagacaa gcacatcctc gccaagatcc gttggaagta catgattgtg
3001 gacgaaggtc accgcatgaa gaaccaccac tgcaagctga cgcaggtgct caacacgcac TABLE 1-continued 3061 tatgtggcac cccgccgcct gctgctgacg ggcacaccgc tgcagaacaa gcttcccgag
3121 ctctgggcgc tgctcaactt cctgctgccc accatcttca agagctgcag caccttcgag
3181 cagtggttta acgcaccctt tgccatgacc ggggaaaagg tggacctgaa tgaggaggaa
3241 accattctca tcatccggcg tctccacaaa gtgctgcggc ccttcttgct ccgacgactc
3301 aagaaggaag tcgaggccca gttgcccgaa aaggtggagt acgtcatcaa gtgcgacatg
3361 tctgcgctgc agcgagtgct ctaccgccac atgcaggcca agggcgtgct gctgactgat
3421 ggctccgaga aggacaagaa gggcaaaggc ggcaccaaga ccctgatgaa caccatcatg
3481 cagctgcgga agatctgcaa ccacccctac atgttccagc acatcgagga gtccttttcc
3541 gagcacttgg ggttcactgg cggcattgtc caagggctgg acctgtaccg agcctcgggt
3601 aaatttgagc ttcttgatag aattcttccc aaactccgag caaccaacca caaagtgctg
3661 ctgttctgcc aaatgacctc cctcatgacc atcatggaag attactttgc gtatcgcggc
3721 tttaaatacc tcaggcttga tggaaccacg aaggcggagg accggggcat gctgctgaaa
3781 accttcaacg agcccggctc tgagtacttc atcttcctgc tcagcacccg ggctgggggg
3841 ctcggcctga acctccagtc ggcagacact gtgatcattt ttgacagcga ctggaatcct
3901 caccaggacc tgcaagcgca ggaccgagcc caccgcatcg ggcagcagaa cgaggtgcgt
3961 gtgctccgcc tctgcaccgt caacagcgtg gaggagaaga tcctagctgc agccaagtac
4021 aagctcaacg tggaccagaa ggtgatccag gccggcatgt tcgaccagaa gtcctccagc
4081 catgagcggc gcgccttcct gcaggccatc ctggagcacg aggagcagga tgagagcaga
4141 cactgcagca cgggcagcgg cagtgccagc ttcgcccaca ctgcccctcc gccagcgggc
4201 gtcaaccccg acttggagga gccacctcta aaggaggaag acgaggtgcc cgacgacgag
4261 accgtcaacc agatgatcgc ccggcacgag gaggagtttg atctgttcat gcgcatggac
4321 ctggaccgca ggcgcgagga ggcccgcaac cccaagcgga agccgcgcct catggaggag
4381 gacgagctcc cctcgtggat catcaaggac gacgcggagg tggagcggct gacctgtgag
4441 gaggaggagg agaagatgtt cggccgtggc tcccgccacc gcaaggaggt ggactacagc
4501 gactcactga cggagaagca gtggctcaag gccatcgagg agggcacgct ggaggagatc
4561 gaagaggagg tccggcagaa gaaatcatca cggaagcgca agcgagacag cgacgccggc
4621 tcctccaccc cgaccaccag cacccgcagc cgcgacaagg acgacgagag caagaagcag
4681 aagaagcgcg ggcggccgcc tgccgagaaa ctctccccta acccacccaa cctcaccaag
4741 aagatgaaga agattgtgga tgccgtgatc aagtacaagg acagcagcag tggacgtcag
4801 ctcagcgagg tcttcatcca gctgccctcg cgaaaggagc tgcccgagta ctacgagctc
4861 atccgcaagc ccgtggactt caagaagata aaggagcgca ttcgcaacca caagtaccgc
4921 agcctcaacg acctagagaa ggacgtcatg ctcctgtgcc agaacgcaca gaccttcaac
4981 ctggagggct ccctgatcta tgaagactcc atcgtcttgc agtcggtctt caccagcgtg
5041 cggcagaaaa tcgagaagga ggatgacagt gaaggcgagg agagtgagga ggaggaagag
5101 ggcgaggagg aaggctccga atccgaatct cggtccgtca aagtgaagat caagcttggc
5161 cggaaggaga aggcacagga ccggctgaag ggcggccggc ggcggccgag ccgagggtcc
5221 cgagccaagc cggtcgtgag tgacgatgac agtgaggagg aacaagagga ggaccgctca
5281 ggaagtggca gcgaagaaga ctgagccccg acattccagt ctcgaccccg agcccctcgt
5341 tccagagctg agatggcata ggccttagca gtaacgggta gcagcagatg tagtttcaga
5401 cttggagtaa aactgtataa acaaaagaat cttccatatt tatacagcag agaagctgta
5461 ggactgtttg tgactggccc tgtcctggca tcagtagcat ctgtaacagc attaactgtc
5521 ttaaagagag agagagagaa ttccgaattg gggaacacac gatacctgtt tttcttttcc
5581 gttgctggca gtactgttgc gccgcagttt ggagtcactg tagttaagtg tggatgcatg
5641 tgcgtcaccg tccactcctc ctactgtatt ttattggaca ggtcagactc gccgggggcc
5701 cggcgagggt atgtcagtgt cactggatgt caaacagtaa taaattaaac caacaacaaa
5761 acgcacagcc aaaaaaaaa SEQ ID NO: 187 Human SMARCA4 cDNA Sequence Variant 3 (NM_003072.3, CDS: 285-5228)

1 ggagaggccg ccgcggtgct gaggggggagg ggagccggcg agcgcgcgcg cagcgggggc
61 gcgggtggcg cgcgtgtgtg tgaagggggg gcggtggccg aggcgggcgg gcgcgcgcgc
121 gaggcttccc ctcgtttggc ggcggcggcg gcttctttgt ttcgtgaaga gaagcgagac
181 gcccattctg cccccggccc cgcgcggagg ggcgggggag gcgccgggaa gtcgacggcg
241 ccggcggctc ctgcaggagg ccactgtctg cagctcccgt gaagatgtcc actccagacc
301 cacccctggg cggaactcct cggccaggtc cttccccggg ccctggccct tcccctggag
361 ccatgctggg ccctagcccg ggtccctcgc cgggctccgc ccacagcatg atggggccca
421 gcccagggcc gccctcagca ggacacccca tccccaccca ggggcctgga gggtaccctc
481 aggacaacat gcaccagatg cacaagccca tggagtccat gcatgagaag ggcatgtcgg
541 acgacccgcg ctacaaccag atgaaaggaa tggggatgcg gtcagggggc catgctggga
601 tggggccccc gcccagcccc atggaccagc actcccaagg ttacccctcg cccctgggtg
661 gctctgagca tgcctctagt ccagttccag ccagtggccc gtcttcgggg ccccagatgt
721 cttccgggcc aggaggtgcc ccgctggatg gtgctgaccc ccaggccttg gggcagcaga
781 accggggccc aaccccattt aaccagaacc agctgcacca gctcagagct cagatcatgg
841 cctacaagat gctggccagg gggcagcccc tccccgacca cctgcagatg gcggtgcagg
901 gcaagcggcc gatgcccggg atgcagcagc agatgccaac gctacctcca ccctcggtgt
961 ccgcaacagg acccggccct ggccctggcc ctggccccgg cccgggtccc ggcccggcac
1021 ctccaaatta cagcaggcct catggtatgg gagggcccaa catgcctccc ccaggaccct
1081 cgggcgtgcc ccccgggatg ccaggccagc ctcctggagg gcctcccaag ccctggcctg
1141 aaggacccat ggcgaatgct gctgccccca cgagcacccc tcagaagctg attcccccgc
1201 agccaacggg ccgcccttcc cccgcgcccc ctgccgtccc acccgccgcc tcgcccgtga
1261 tgccaccgca gacccagtcc cccgggcagc cggcccagcc cgcgccccatg gtgccactgc
1321 accagaagca gagccgcatc acccccatcc agaagccgcg gggcctcgac cctgtggaga
1381 tcctgcagga gcgcgagtac aggctgcagg ctcgcatcgc acaccgaatt caggaacttg
1441 aaaaccttcc cgggtccctg gccggggatt tgcgaaccaa agcgaccatt gagctcaagg
1501 ccctcaggct gctgaacttc cagaggcagc tgcgccagga ggtggtggtg tgcatgcgga
1561 gggacacagc gctggagaca gccctcaatg ctaaggccta caagcgcagc aagcgccagt
1621 ccctgcgcga ggcccgcatc actgagaagc tggagaagca gcagaagatc gagcaggagc
1681 gcaagcgccg gcagaagcac caggaatacc tcaatagcat tctccagcat gccaaggatt
1741 tcaaggaata tcacagatcc gtcacaggca aaatccagaa gctgaccaag gcagtggcca
1801 cgtaccatgc caacacggag cgggagcaga agaaagagaa cgagcggatc gagaaggagc TABLE 1-continued

```
1861 gcatgcggag gctcatggct gaagatgagg aggggtaccg caagctcatc gaccagaaga
1921 aggacaagcg cctggcctac ctcttgcagc agacagacga gtacgtggct aacctcacgg
1981 agctggtgcg gcagcacaag gctgcccagg tcgccaagga gaaaaagaag aaaaagaaaa
2041 agaagaaggc agaaaatgca gaaggacaga cgcctgccat tgggccggat ggcgagcctc
2101 tggacgagac cagccagatg agcgacctcc cggtgaaggt gatccacgtg gagagtggga
2161 agatcctcac aggcacagat gcccccaaag ccgggcagct ggaggcctgg ctcgagatga
2221 acccggggta tgaagtagct ccgaggtctg atagtgaaga aagtggctca gaagaagagg
2281 aagaggagga ggaggaagag cagccgcagg cagcacagcc tcccaccctg cccgtggagg
2341 agaagaagaa gattccagat ccagacagcg atgacgtctc tgaggtggac gcgcggcaca
2401 tcattgagaa tgccaagcaa gatgtcgatg atgaatatgg cgtgtcccag gcccttgcac
2461 gtggcctgca gtcctactat gccgtggccc atgctgtcac tgagagagtg gacaagcagt
2521 cagcgcttat ggtcaatggt gtcctcaaac agtaccagat caaaggtttg gagtggctgg
2581 tgtccctgta caacaacaac ctgaacggca tcctggccga cgagatgggc ctggggaaga
2641 ccatccagac catcgcgctc atcacgtacc tcatggagca caaacgcatc aatgggccct
2701 tcctcatcat cgtgcctctc tcaacgctgt ccaactgggc gtacgagttt gacaagtggg
2761 ccccctccgt ggtgaaggtg tcttacaagg gatccccagc agcaagacgg gcctttgtcc
2821 cccagctccg gagtgggaag ttcaacgtct tgctgacgac gtacgagtac atcatcaaag
2881 acaagcacat cctcgccaag atccgttgga agtacatgat tgtggacgaa ggtcaccgca
2941 tgaagaacca ccactgcaag ctgacgcagg tgctcaacac gcactatgtg gcaccccgcc
3001 gcctgctgct gacgggcaca ccgctgcaga acaagcttcc cgagctctgg gcgctgctca
3061 acttcctgct gcccaccatc ttcaagagct gcagcacctt cgagcagtgg tttaacgcac
3121 cctttgccat gaccggggaa aaggtggacc tgaatgagga ggaaaccatt ctcatcatcc
3181 ggcgtctcca caaagtgctg cggcccttct tgctccgacg actcaagaag gaagtcgagg
3241 cccagttgcc cgaaaaggtg gagtacgtca tcaagtgcga catgtctgcg ctgcagcgag
3301 tgctctaccg ccacatgcag gccaagggcg tgctgctgac tgatggctcc gagaaggaca
3361 agaagggcaa aggcggcacc aagaccctga tgaacaccat catgcagctg cggaagatct
3421 gcaaccaccc ctacatgttc cagcacatcg aggagtcctt ttccgagcac ttggggttca
3481 ctggcggcat tgtccaaggg ctggacctgt accgagcctc gggtaaattt gagcttcttg
3541 atagaattct tcccaaactc cgagcaacca accacaaagt gctgctgttc tgccaaatga
3601 cctccctcat gaccatcatg gaagattact ttgcgtatcg cggctttaaa tacctcaggc
3661 ttgatggaac cacgaaggcg gaggaccggg gcatgctgct gaaaaccttc aacgagcccg
3721 gctctgagta cttcatcttc ctgctcagca cccgggctgg ggggctcggc ctgaacctcc
3781 agtcggcaga cactgtgatc atttttgaca gcgactggaa tcctcaccag gacctgcaag
3841 cgcaggaccg agcccaccgc atcgggcagc agaacgaggt gcgtgtgctc cgcctctgca
3901 ccgtcaacag cgtggaggag aagatcctag ctgcagccaa gtacaagctc aacgtggacc
3961 agaaggtgat ccaggccggc atgttcgacc agaagtcctc cagccatgag cggcgcgcct
4021 tcctgcaggc catcctggag cacgaggagc aggatgagag cagacactgc agcacgggca
4081 gcggcagtgc cagcttcgcc cacactgccc ctccgccagc gggcgtcaac cccgacttgg
4141 aggagccacc tctaaaggag gaagacgagg tgcccgacga cgagaccgtc aaccagatga
4201 tcgcccggca cgaggaggag tttgatctgt tcatgcgcat ggacctggac cgcaggcgcg
4261 aggaggcccg caaccccaag cggaagccgc gcctcatgga ggaggacgag ctcccctcgt
4321 ggatcatcaa ggacgacgcg gaggtggagc ggctgacctg tgaggaggag gaggagaaga
4381 tgttcggccg tggctcccgc caccgcaagg aggtggacta cagcgactca ctgacggaga
4441 agcagtggct caaggccatc gaggagggca cgctggagga gatcgaagag gaggtccggc
4501 agaagaaatc atcacggaag cgcaagcgag acagcgacgc cggctcctcc accccgacca
4561 ccagcacccg cagccgcgac aaggacgacg agagcaagaa gcagaagaag cgcgggcggc
4621 cgcctgccga gaaactctcc cctaacccac ccaacctcac caagaagatg aagaagattg
4681 tggatgccgt gatcaagtac aaggacagca gcagtggacg tcagctcagc gaggtcttca
4741 tccagctgcc ctcgcgaaag gagctgcccg agtactacga gctcatccgc aagcccgtgg
4801 acttcaagaa gataaaggag cgcattcgca accacaagta ccgcagcctc aacgacctag
4861 agaaggacgt catgctcctg tgccagaacg cacagacctt caacctggag ggctccctga
4921 tctatgaaga ctccatcgtc ttgcagtcgg tcttcaccag cgtgcggcag aaaatcgaga
4981 aggaggatga cagtgaaggc gaggagagtg aggaggagga agagggcgag gaggaaggct
5041 ccgaatccga atctcggtcc gtcaaagtga agatcaagct tggccggaag gagaaggcac
5101 aggaccggct gaagggcggc cggcggcggc cgagccgagg gtcccgagcc aagccggtcg
5161 tgagtgacga tgacagtgag gaggaacaag aggaggaccg ctcaggaagt ggcagcgaag
5221 aagactgagc cccgacattc cagtctcgac cccgagcccc tcgttccaga gctgagatgg
5281 cataggcctt agcagtaacg ggtagcagca gatgtagttt cagacttgga gtaaaactgt
5341 ataaacaaaa gaatcttcca tatttataca gcagagaagc tgtaggactg tttgtgactg
5401 gccctgtcct ggcatcagta gcatctgtaa cagcattaac tgtcttaaag agagagagag
5461 agaattccga attggggaac acacgatacc tgtttttctt ttccgttgct ggcagtactg
5521 ttgcgccgca gtttggagtc actgtagtta agtgtggatg catgtgcgtc accgtccact
5581 cctcctactg tattttattg gacaggtcag actcgccggg ggcccggcga gggtatgtca
5641 gtgtcactgg atgtcaaaca gtaataaatt aaaccaacaa caaaacgcac agccaaaaaa
5701 aaa
```

SEQ ID NO: 188 Human SMARCA4 Amino Acid Sequence Isoform C (NP_001122317.1)

```
  1 mstpdpplgg tprpgpspgp gpspgamlgp spgpspgsah smmgpspgpp saghpiptqg
 61 pggypqdnmh qmhkpmesmh ekgmsddpry nqmkgmgmrs gghagmgppp spmdqhsqgy
121 psplggseha sspvpasgps sgpqmssgpg gapldgadpq algqqnrgpt pfnqnqlhql
181 raqimaykml argqplpdhl qmavqgkrpm pgmqqqmptl pppsysatgp gpgpgpgpgp
241 gpgpappnys rphgmggpnm pppgpsgvpp gmpgqppggp pkpwpegpma naaaptstpq
301 klippqptgr pspappavpp aaspvmppqt gspggpagpa pmvplhqkqs ritpiqkprg
361 ldpveilqer eyrlqariah rigelenlpg slagdlrtka tielkalrll nfqrqlrgev
421 vvcmrrdtal etalnakayk rskrqslrea riteklekqg kiegerkrrq khqeylnsil
481 qhakdfkeyh rsvtgkiqkl tkavatyhan tereqkkene riekermrrl maedeegyrk
541 lidqkkdkrl ayllqqtdey vanitelvrq hkaaqvakek kkkkkkkae naegqtpaig
601 pdgepldets qmsdlpvkvi hvesgkiltg tdapkagqle awlemnpgye vaprsdsees
661 gseeeeeeee eeqpqaaqpp tlpveekkki pdpdsddvse vdarhiiena kqdvddeygv
```

TABLE 1-continued

```
 721 sqalarglqs yyavahavte rvdkqsalmv ngvlkqyqik glewlvslyn nnlngilade
 781 mglgktiqti alitylmehk ringpfliiv plstlsnway efdkwapsvv kvsykgspaa
 841 rrafvpqlrs gkfnvlltty eyiikdkhil akirwkymiv deghrmknhh ckltqvinth
 901 yvaprrlllt gtplqnklpe lwallnfllp tifkscstfe qwfnapfamt gekvdlneee
 961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcgmtslmt imedyfayrg fkylrldgtt kaedrgmllk
1141 tfnepgseyf ifllstragg lglnlqsadt viifdsdwnp hqdlqaqdra hrigqqnevr
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikddae
1321 verltceeee ekmfgrgsrh rkevdysdsl tekqwlktlk aieegtleei eeevrqkkss
1381 rkrkrdsdag sstpttstrs rdkddeskkq kkrgrppaek lspnppnitk kmkkivdavi
1441 kykdsssgrq lsevfiqlps rkelpeyyel irkpvdfkki kerirnhkyr slndlekdvm
1501 llcgnagtfn legsliyeds ivlqsvftsv rqkiekedds egeeseeeee geeegseses
1561 rsvkvkiklg rkekaqdrlk ggrrrpsrgs rakpvvsddd seeeqeedrs gsgseed
```

SEQ ID NO: 189 Human SMARCA4 cDNA Sequence Variant 4 (NM_001128845.1, CDS: 1-4854)

```
   1 atgtccactc cagacccacc cctgggcgga actcctcggc caggtccttc cccgggccct
  61 ggcccttccc ctggagccat gctgggccct agcccgggtc cctcgccggg ctccgcccac
 121 agcatgatgg ggcccagccc agggccgccc tcagcaggac accccatccc cacccagggg
 181 cctggagggt accctcagga caacatgcac cagatgcaca agcccatgga gtccatgcat
 241 gagaagggca tgtcggacga cccgcgctac aaccagatga aaggaatggg gatgcggtca
 301 gggggccatg ctgggatggg gcccccgccc agccccatgg accagcactc ccaaggttac
 361 ccctcgcccc tgggtggctc tgagcatgcc tctagtccag ttccagccag tggcccgtct
 421 tcggggcccc agatgtcttc cgggccagga ggtgccccgc tggatggtgc tgacccccag
 481 gccttggggc agcagaaccg ggcccaacc ccatttaacc agaaccagct gcaccagctc
 541 agagctcaga tcatggccta caagatgctg gccagggggc agcccctccc cgaccacctg
 601 cagatggcgg tgcagggcaa gcggccgatg cccgggatgc agcagcagat gccaacgcta
 661 cctccaccct cggtgtccgc aacaggaccc ggccctggcc ctggccctgg ccccggcccg
 721 ggtcccggcc cggcacctcc aaattacagc aggcctcatg gtatgggagg gcccaacatg
 781 cctcccccag gaccctcggg cgtgcccccc gggatgccag gccagcctcc tggagggcct
 841 cccaagccct ggcctgaagg acccatggcg aatgctgctg cccccacgag cacccctcag
 901 aagctgattc cccgcagcc aacgggccgc ccttcccccg cgcccccctgc cgtcccaccc
 961 gccgcctcgc ccgtgatgcc accgcagacc cagtcccccg ggcagccggc ccagcccgcg
1021 cccatggtgc cactgcacca gaagcagagc cgcatcaccc ccatccagaa gccgcggggc
1081 ctcgaccctg tggagatcct gcaggagcgc gagtacaggc tgcaggctcg catcgcacac
1141 cgaattcagg aacttgaaaa ccttcccggg tccctggccg gggatttgcg aaccaaagcg
1201 accattgagc tcaaggccct caggctgctg aacttccaga ggcagctgcg ccaggaggtg
1261 gtggtgtgca tgcggaggga cacagcgctg gagacagccc tcaatgctaa ggcctacaag
1321 cgcagcaagc gccagtccct gcgcgaggcc cgcatcactg agaagctgga gaagcagcag
1381 aagatcgagc aggagcgcaa gcgccggcag aagcaccagg aatacctcaa tagcattctc
1441 cagcatgcca aggatttcaa ggaatatcac agatccgtca caggcaaaat ccagaagctg
1501 accaaggcag tggccacgta ccatgccaac acggagcggg agcagaagaa agagaacgag
1561 cggatcgaga aggagcgcat gcggaggctc atggctgaag atgaggaggg gtaccgcaag
1621 ctcatcgacc agaagaagga caagcgcctg gcctacctct tgcagcagac agacgagtac
1681 gtggctaacc tcacggagct ggtgcggcag cacaaggctg cccaggtcgc caaggagaaa
1741 aagaagaaaa agaaaaagaa gaaggcagaa aatgcagaag gacagacgcc tgccattggg
1801 ccggatggcg agcctctgga cgagaccagc cagatgagcg acctcccggt gaaggtgatc
1861 cacgtggaga gtgggaagat cctcacaggc acagatgccc ccaaagccgg gcagctggag
1921 gcctggctcg agatgaaccc ggggtatgaa gtagctccga ggtctgatag tgaagaaagt
1981 ggctcagaag aagaggaaga ggaggaggag gaagagcagc cgcaggcagc acagcctccc
2041 accctgcccg tggaggagaa gaagaagatt ccagatccag acagcgatga cgtctctgag
2101 gtggacgcgc ggcacatcat tgagaatgcc aagcaagatg tcgatgatga atatggcgtg
2161 tcccaggccc ttgcacgtgg cctgcagtcc tactatgccg tggcccatgc tgtcactgag
2221 agagtggaca agcagtcagc gcttatggtc aatggtgtcc tcaaacagta ccagatcaaa
2281 ggtttggagt ggctggtgtc cctgtacaac aacaacctga acggcatcct ggccgacgag
2341 atgggcctgg ggaagaccat ccagaccatc gcgctcatca cgtacctcat ggagcacaaa
2401 cgcatcaatg ggcccttcct catcatcgtg cctctctcaa cgctgtccaa ctgggcgtac
2461 gagtttgaca agtgggcccc ctccgtggtg aaggtgtctt acaagggatc cccagcagca
2521 agacgggcct ttgtccccca gctccggagt gggaagttca acgtcttgct gacgacgtac
2581 gagtacatca tcaaagacaa gcacatcctc gccaagatcc gttggaagta catgattgtg
2641 gacgaaggtc accgcatgaa gaaccaccac tgcaagctga cgcaggtgct caacacgcac
2701 tatgtggcac cccgccgcct gctgctgacg ggcacaccgc tgcagaacaa gcttcccgag
2761 ctctgggcgc tgctcaactt cctgctgccc accatcttca agagctgcag caccttcgag
2821 cagtggttta acgcaccctt tgccatgacc ggggaaaagg tggacctgaa tgaggaggaa
2881 accattctca tcatccggcg tctccacaaa gtgctgcggc ccttcttgct ccgacgactc
2941 aagaaggaag tcgaggccca gttgcccgaa aaggtggagt acgtcatcaa gtgcgacatg
3001 tctgcgctgc agcgagtgct ctaccgccac atgcaggcca agggcgtgct gctgactgat
3061 ggctccgaga aggacaagaa gggcaaaggc ggcaccaaga ccctgatgaa caccatcatg
3121 cagctgcgga agatctgcaa ccacccctac atgttccagc acatcgagga gtccttttcc
3181 gagcacttgg ggttcactgg cggcattgtc caagggctgg acctgtaccg agcctcgggt
3241 aaatttgagc ttcttgatag aattcttccc aaactccgag caaccaacca caaagtgctg
3301 ctgttctgcc aaatgacctc cctcatgacc atcatggaag attactttgc gtatcgcggc
3361 tttaaatacc tcaggcttga tggaaccacg aaggcggagg accggggcat gctgctgaaa
3421 accttcaacg agcccggctc tgagtacttc atcttcctgc tcagcacccg ggctgggggg
3481 ctcggcctga acctccagtc ggcagacact gtgatcattt ttgacagcga ctggaatcct
3541 caccaggacc tgcaagcgca ggaccgagcc caccgcatcg ggcagcagaa cgaggtgcgt
3601 gtgctccgcc tctgcaccgt caacagcgtg gaggagaaga tcctagctgc agccaagtac
3661 aagctcaacg tggaccagaa ggtgatccag gccggcatgt tcgaccagaa gtcctccagc
```

TABLE 1-continued

```
3721 catgagcggc gcgccttcct gcaggccatc ctggagcacg aggagcagga tgaggaggaa
3781 gacgaggtgc ccgacgacga gaccgtcaac cagatgatcg cccggcacga ggaggagttt
3841 gatctgttca tgcgcatgga cctggaccgc aggcgcgagg aggcccgcaa ccccaagcgg
3901 aagccgcgcc tcatggagga ggacgagctc ccctcgtgga tcatcaagga cgacgcggag
3961 gtggagcggc tgacctgtga ggaggaggag gagaagatgt tcggccgtgg ctcccgccac
4021 cgcaaggagg tggactacag cgactcactg acggagaagc agtggctcaa gaccctgaag
4081 gccatcgagg agggcacgct ggaggagatc gaagaggagg tccggcagaa gaaatcatca
4141 cggaagcgca agcgagacag cgacgccggc tcctccaccc cgaccaccag cacccgcagc
4201 cgcgacaagg acgacgagag caagaagcag aagaagcgcg ggcggccgcc tgccgagaaa
4261 ctctccccta acccacccaa cctcaccaag aagatgaaga agattgtgga tgccgtgatc
4321 aagtacaagg acagcagcag tggacgtcag ctcagcgagg tcttcatcca gctgccctcg
4381 cgaaaggagc tgcccgagta ctacgagctc atccgcaagc ccgtggactt caagaagata
4441 aaggagcgca ttcgcaacca caagtaccgc agcctcaacg acctagagaa ggacgtcatg
4501 ctcctgtgcc agaacgcaca gaccttcaac ctggagggct ccctgatcta tgaagactcc
4561 atcgtcttgc agtcggtctt caccagcgtg cggcagaaaa tcgagaagga ggatgacagt
4621 gaaggcgagg agagtgagga ggaggaagag ggcgaggagg aaggctccga atccgaatct
4681 cggtccgtca aagtgaagat caagcttggc cggaaggaga aggcacagga ccggctgaag
4741 ggcggccggc ggcggccgag ccgagggtcc cgagccaagc cggtcgtgag tgacgatgac
4801 agtgaggagg aacaagagga ggaccgctca ggaagtggca gcgaagaaga ctgagccccg
4861 acattccagt ctcgaccccg agcccctcgt tccagagctg agatggcata ggccttagca
4921 gtaacgggta gcagcagatg tagtttcaga cttggagtaa aactgtataa acaaaagaat
4981 cttccatatt tatacagcag agaagctgta ggactgtttg tgactggccc tgtcctggca
5041 tcagtagcat ctgtaacagc attaactgtc ttaaagagag agagagagaa ttccgaattg
5101 gggaacacac gatacctgtt tttcttttcc gttgctggca gtactgttgc gccgcagttt
5161 ggagtcactg tagttaagtg tggatgcatg tgcgtcaccg tccactcctc ctactgtatt
5221 ttattggaca ggtcagactc gccgggggcc cggcgagggt atgtcagtgt cactggatgt
5281 caaacagtaa taaattaaac caacaacaaa acgcacagcc aaaaaaaaa
```

SEQ ID NO: 190 Human SMARCA4 Amino Acid Sequence Isoform D (NP_001122318.1)

```
   1 mstpdpplgg tprpgpspgp gpspgamlgp spgpspgsah smmgpspgpp saghpiptqg
  61 pggypqdnmh qmhkpmesmh ekgmsddpry nqmkgmgmrs gghagmgppp spmdqhsqgy
 121 psplggseha sspvpasgps sgpqmssgpg gapldgadpq algqqnrgpt pfnqnqlhql
 181 raqimaykml argqplpdhl qmavqgkrpm pgmqqqmptl pppsysatgp gpgpgpgpgp
 241 gpgpappnys rphgmggpnm pppgpsgvpp gmpgqppggp pkpwpegpma naaaptstpq
 301 klippqptgr pspappavpp aaspvmppqt gspggpagpa pmvplhqkqs ritpiqkprg
 361 ldpveilger eyrlqariah riqelenlpg slagdlrtka tielkalrll nfqrqlrgev
 421 vvcmrrdtal etalnakayk rskrqslrea riteklekqg kiegerkrrq khqeylnsil
 481 qhakdfkeyh rsvtgkiqkl tkavatyhan tereqkkene riekermrrl maedeegyrk
 541 lidqkkdkrl ayllqqtdey vanitelvrq hkaaqvakek kkkkkkkkae naegqtpaig
 601 pdgepldets qmsdlpvkvi hvesgkiltg tdapkagqle awlemnpgye vaprsdsees
 661 gseeeeeeee eeqpqaaqpp tlpveekkki pdpdsddvse vdarhiiena kqdvddeygv
 721 sqalarglqs yyavahavte rvdkqsalmv ngvlkqyqik glewlvslyn nnlngilade
 781 mglgktiqti alitylmehk ringpfliiv plstlsnway efdkwapsvv kvsykgspaa
 841 rrafvpqlrs gkfnvlltty eyiikdkhil akirwkymiv deghrmknhh ckltqvinth
 901 yvaprrlllt gtplqnklpe lwallnfllp tifkscstfe qwfnapfamt gekvdlneee
 961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcgmtslmt imedyfayrg fkylrldgtt kaedrgmllk
1141 tfnepgseyf ifllstragg lglnlqsadt viifdsdwnp hqdlqaqdra hrigqgnevr
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikddae
1321 verltceeee ekmfgrgsrh rkevdysdsl tekqwlktlk aieegtleei eeevrqkkss
1381 rkrkrdsdag sstpttstrs rdkddeskkq kkrgrppaek lspnppnitk kmkkivdavi
1441 kykdssgrql sevfiqlpsr kelpeyyeli rkpvdfkkik erirnhkyrs lndlekdvml
1501 lcqnagtfnl egsliyedsi vlqsvftsvr qkiekeddse geeseeeeeg eeegsesesr
1561 svkvkiklgr kekaqdrlkg grrrpsrgsr akpvvsddds eeeqeedrsg sgseed
```

SEQ ID NO: 191 Human SMARCA4 cDNA Sequence Variant 5 (NM_001128846.1, CDS: 1-4851)

```
   1 atgtccactc cagacccacc cctgggcgga actcctcggc caggtccttc cccgggccct
  61 ggcccttccc ctggagccat gctgggccct agcccgggtc cctcgccggg ctccgcccac
 121 agcatgatgg ggcccagccc agggccgccc tcagcaggac accccatccc cacccagggg
 181 cctggagggt accctcagga caacatgcac cagatgcaca agcccatgga gtccatgcat
 241 gagaagggca tgtcggacga cccgcgctac aaccagatga aaggaatggg gatgcggtca
 301 gggggccatg ctgggatggg gcccccgccc agccccatgg accagcactc ccaaggttac
 361 ccctcgcccc tgggtggctc tgagcatgcc tctagtccag ttccagccag tggcccgtct
 421 tcggggcccc agatgtcttc cgggccagga ggtgccccgc tggatggtgc tgacccccag
 481 gccttggggc agcagaaccg gggcccaacc ccatttaacc agaaccagct gcaccagctc
 541 agagctcaga tcatggccta caagatgctg gccaggggggc agcccctccc cgaccacctg
 601 cagatggcgg tgcagggcaa gcggccgatg cccgggatgc agcagcagat gccaacgcta
 661 cctccaccct cggtgtccgc aacaggaccc ggccctggcc ctggccctgg ccccggcccg
 721 ggtcccggcc cggcacctcc aaattacagc aggcctcatg gtatgggagg gcccaacatg
 781 cctcccccag gaccctcggg cgtgcccccc gggatgccag gccagcctcc tggagggcct
 841 cccaagccct ggcctgaagg acccatggcg aatgctgctg cccccacgag cacccctcag
 901 aagctgattc ccccgcagcc aacgggccgc ccttccccccg cgccccctgc cgtcccaccc
 961 gccgcctcgc ccgtgatgcc accgcagacc cagtcccccg ggcagccggc ccagcccgcg
1021 cccatggtgc cactgcacca gaagcagagc cgcatcaccc ccatccagaa gccgcggggc
1081 ctcgaccctg tggagatcct gcaggagcgc gagtacaggc tgcaggctcg catcgcacac
1141 cgaattcagg aacttgaaaa ccttcccggg tccctggccg gggatttgcg aaccaaagcg
```

TABLE 1-continued

```
1201 accattgagc tcaaggccct caggctgctg aacttccaga ggcagctgcg ccaggaggtg
1261 gtggtgtgca tgcggaggga cacagcgctg gagacagccc tcaatgctaa ggcctacaag
1321 cgcagcaagc gccagtccct gcgcgaggcc cgcatcactg agaagctgga gaagcagcag
1381 aagatcgagc aggagcgcaa gcgccggcag aagcaccagg aatacctcaa tagcattctc
1441 cagcatgcca aggatttcaa ggaatatcac agatccgtca caggcaaaat ccagaagctg
1501 accaaggcag tggccacgta ccatgccaac acggagcggg agcagaagaa agagaacgag
1561 cggatcgaga aggagcgcat gcggaggctc atggctgaag atgaggaggg gtaccgcaag
1621 ctcatcgacc agaagaagga caagcgcctg gcctacctct tgcagcagac agacgagtac
1681 gtggctaacc tcacggagct ggtgcggcag cacaaggctg cccaggtcgc caaggagaaa
1741 aagaagaaaa agaaaaagaa gaaggcagaa aatgcagaag gacagacgcc tgccattggg
1801 ccggatggcg agcctctgga cgagaccagc cagatgagcg acctcccggt gaaggtgatc
1861 cacgtggaga gtgggaagat cctcacaggc acagatgccc ccaaagccgg gcagctggag
1921 gcctggctcg agatgaaccc ggggtatgaa gtagctccga ggtctgatag tgaagaaagt
1981 ggctcagaag aagaggaaga ggaggaggag gaagagcagc cgcaggcagc acagcctccc
2041 accctgcccg tggaggagaa gaagaagatt ccagatccag acagcgatga cgtctctgag
2101 gtggacgcgc ggcacatcat tgagaatgcc aagcaagatg tcgatgatga atatggcgtg
2161 tcccaggccc ttgcacgtgg cctgcagtcc tactatgccg tggcccatgc tgtcactgag
2221 agagtggaca agcagtcagc gcttatggtc aatggtgtcc tcaaacagta ccagatcaaa
2281 ggtttggagt ggctggtgtc cctgtacaac aacaacctga acggcatcct ggccgacgag
2341 atgggcctgg ggaagaccat ccagaccatc gcgctcatca cgtacctcat ggagcacaaa
2401 cgcatcaatg ggcccttcct catcatcgtg cctctctcaa cgctgtccaa ctgggcgtac
2461 gagtttgaca agtgggcccc ctccgtggtg aaggtgtctt acaagggatc cccagcagca
2521 agacggcct ttgtccccca gctccggagt gggaagttca acgtcttgct gacgacgtac
2581 gagtacatca tcaaagacaa gcacatcctc gccaagatcc gttggaagta catgattgtg
2641 gacgaaggtc accgcatgaa gaaccaccac tgcaagctga cgcaggtgct caacacgcac
2701 tatgtggcac cccgccgcct gctgctgacg ggcacaccgc tgcagaacaa gcttcccgag
2761 ctctgggcgc tgctcaactt cctgctgccc accatcttca agagctgcag caccttcgag
2821 cagtggttta acgcaccctt tgccatgacc ggggaaaagg tggacctgaa tgaggaggaa
2881 accattctca tcatccggcg tctccacaaa gtgctgcggc ccttcttgct ccgacgactc
2941 aagaaggaag tcgaggccca gttgcccgaa aaggtggagt acgtcatcaa gtgcgacatg
3001 tctgcgctgc agcgagtgct ctaccgccac atgcaggcca agggcgtgct gctgactgat
3061 ggctccgaga aggacaagaa gggcaaaggc ggcaccaaga ccctgatgaa caccatcatg
3121 cagctgcgga agatctgcaa ccacccctac atgttccagc acatcgagga gtccttttcc
3181 gagcacttgg ggttcactgg cggcattgtc caagggctgg acctgtaccg agcctcgggt
3241 aaatttgagc ttcttgatag aattcttccc aaactccgag caaccaacca caaagtgctg
3301 ctgttctgcc aaatgacctc cctcatgacc atcatggaag attactttgc gtatcgcggc
3361 tttaaatacc tcaggcttga tggaaccacg aaggcggagg accggggcat gctgctgaaa
3421 accttcaacg agcccggctc tgagtacttc atcttcctgc tcagcacccg ggctgggggg
3481 ctcggcctga acctccagtc ggcagacact gtgatcattt ttgacagcga ctggaatcct
3541 caccaggacc tgcaagcgca ggaccgagcc caccgcatcg ggcagcagaa cgaggtgcgt
3601 gtgctccgcc tctgcaccgt caacagcgtg gaggagaaga tcctagctgc agccaagtac
3661 aagctcaacg tggaccagaa ggtgatccag gccggcatgt tcgaccagaa gtcctccagc
3721 catgagcggc gcgccttcct gcaggccatc ctggagcacg aggagcagga tgaggaggaa
3781 gacgaggtgc ccgacgacga gaccgtcaac cagatgatcg cccggcacga ggaggagttt
3841 gatctgttca tgcgcatgga cctggaccgc aggcgcgagg aggcccgcaa ccccaagcgg
3901 aagccgcgcc tcatggagga ggacgagctc ccctcgtgga tcatcaagga cgacgcggag
3961 gtggagcggc tgacctgtga ggaggaggag gagaagatgt tcggccgtgg ctcccgccac
4021 cgcaaggagg tggactacag cgactcactg acggagaagc agtggctcaa gaccctgaag
4081 gccatcgagg agggcacgct ggaggagatc gaagaggagg tccggcagaa gaaatcatca
4141 cggaagcgca agcgagacag cgacgccggc tcctccaccc cgaccaccag caccccgcagc
4201 cgcgacaagg acgacgagag caagaagcag aagaagcgcg ggcggccgcc tgccgagaaa
4261 ctctccccta acccacccaa cctcaccaag aagatgaaga agattgtgga tgccgtgatc
4321 aagtacaagg acagcagtgg acgtcagctc agcgaggtct tcatccagct gccctcgcga
4381 aaggagctgc ccgagtacta cgagctcatc cgcaagcccg tggacttcaa gaagataaag
4441 gagcgcattc gcaaccacaa gtaccgcagc ctcaacgacc tagagaagga cgtcatgctc
4501 ctgtgccaga acgcacagac cttcaacctg gagggctccc tgatctatga agactccatc
4561 gtcttgcagt cggtcttcac cagcgtgcgg cagaaaatcg agaaggagga tgacagtgaa
4621 ggcgaggaga gtgaggagga ggaagagggc gaggaggaag gctccgaatc cgaatctcgg
4681 tccgtcaaag tgaagatcaa gcttggccgg aaggagaagg cacaggaccg gctgaagggc
4741 ggccggcggc ggccgagccg agggtcccga gccaagccgg tcgtgagtga cgatgacagt
4801 gaggaggaac aagaggagga ccgctcagga agtggcagcg aagaagactg agccccgaca
4861 ttccagtctc gaccccgagc ccctcgttcc agagctgaga tggcatagge cttagcagta
4921 acgggtagca gcagatgtag tttcagactt ggagtaaaac tgtataaaca aaagaatctt
4981 ccatatttat acagcagaga agctgtagga ctgtttgtga ctggccctgt cctggcatca
5041 gtagcatctg taacagcatt aactgtctta aagagagaga gagagaattc cgaattgggg
5101 aacacacgat acctgttttt cttttccgtt gctggcagta ctgttgcgcc gcagtttgga
5161 gtcactgtag ttaagtgtgg atgcatgtgc gtcaccgtcc actcctccta ctgtatttta
5221 ttggacaggt cagactcgcc gggggcccgg cgagggtatg tcagtgtcac tggatgtcaa
5281 acagtaataa attaaaccaa caacaaaacg cacagccaaa aaaaaa
```

SEQ ID NO: 192 Human SMARCA4 Amino Acid Sequence Isoform E (NP_001122319.1)

```
  1 mstpdpplgg tprpgpspgp gpspgamlgp spgpspgsah smmgpspgpp saghpiptqg
 61 pggypqdnmh qmhkpmesmh ekgmsddpry nqmkgmgmrs gghagmgppp spmdqhsqgy
121 psplggseha sspvpasgps sgpqmssgpg gapldgadpq algqqnrgpt pfnqnqlhql
181 raqimaykml argqplpdhl qmavqgkrpm pgmqqqmptl pppsysatgp gpgpgpgpgp
241 gpgpappnys rphgmggpnm pppgpsgvpp gmpgqppggp pkpwpegpma naaaptstpq
301 klippqptgr pspappavpp aaspvmppqt gspggpagpa pmvplhqkqs ritpiqkprg
361 ldpveilqer eyrlqariah rigelenlpg slagdlrtka tielkalrll nfqrqlrgev
421 vvcmrrdtal etalnakayk rskrqslrea riteklekqq kiegerkrrq khqeylnsil
481 qhakdfkeyh rsvtgkiqkl tkavatyhan tereqkkene riekermrrl maedeegyrk
```

TABLE 1-continued

```
 541 lidqkkdkrl ayllqqtdey vanitelvrq hkaaqvakek kkkkkkkkae naegqtpaig
 601 pdgepldets qmsdlpvkvi hvesgkiltg tdapkagqle awlemnpgye vaprsdsees
 661 gseeeeeeee eeqpqaaqpp tlpveekkki pdpdsddvse vdarhiiena kqdvddeygv
 721 sgalarglqs yyavahavte rvdkqsalmv ngvlkqyqik glewlvslyn nnlngilade
 781 mglgktiqti alitylmehk ringpfliiv plstlsnway efdkwapsvv kvsykgspaa
 841 rrafvpqlrs gkfnvlltty eyiikdkhil akirwkymiv deghrmknhh ckltqvinth
 901 yvaprrlllt gtplqnklpe lwallnfllp tifkscstfe qwfnapfamt gekvdlneee
 961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcgmtslmt imedyfayrg fkylrldgtt kaedrgmllk
1141 tfnepgseyf ifllstragg lglnlqsadt viifdsdwnp hqdlqaqdra hrigqgnevr
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikddae
1321 verltceeee ekmfgrgsrh rkevdysdsl tekqwlkaie egtleeieee vrqkkssrkr
1381 krdsdagsst pttstrsrdk ddeskkqkkr grppaeklsp nppnitkkmk kivdavikyk
1441 dsssgrqlse vfiqlpsrke lpeyyelirk pvdfkkiker irnhkyrsln dlekdvmllc
1501 qnaqtfnleg sliyedsivl qsvftsvrqk iekeddsege eseeeeegee egsesesrsv
1561 kvkiklgrke kaqdrlkggr rrpsrgsrak pvvsdddsee eqeedrsgsg seed
```

SEQ ID NO: 193 Human SMARCA4 cDNA Sequence Variant 6 (NM_001128847.1, CDS: 1-4845)

```
   1 atgtccactc cagacccacc cctgggcgga actcctcggc caggtccttc cccgggccct
  61 ggcccttccc ctggagccat gctgggccct agcccgggtc cctcgccggg ctccgcccac
 121 agcatgatgg ggcccagccc agggccgccc tcagcaggac accccatccc cacccagggg
 181 cctggagggt accctcagga caacatgcac cagatgcaca agcccatgga gtccatgcat
 241 gagaagggca tgtcggacga cccgcgctac aaccagatga aaggaatggg gatgcggtca
 301 gggggccatg ctgggatggg gcccccgccc agccccatgg accagcactc ccaaggttac
 361 ccctcgcccc tgggtggctc tgagcatgcc tctagtccag ttccagccag tggcccgtct
 421 tcggggcccc agatgtcttc cgggccagga ggtgccccgc tggatggtgc tgacccccag
 481 gccttggggc agcagaaccg ggcccaacc ccatttaacc agaaccagct gcaccagctc
 541 agagctcaga tcatggccta caagatgctg gccagggggc agcccctccc cgaccacctg
 601 cagatggcgg tgcagggcaa gcggccgatg cccgggatgc agcagcagat gccaacgcta
 661 cctccaccct cggtgtccgc aacaggaccc ggccctggcc ctggccctgg ccccggcccg
 721 ggtcccggcc cggcacctcc aaattacagc aggcctcatg gtatgggagg gcccaacatg
 781 cctcccccag gaccctcggg cgtgcccccc gggatgccag gccagcctcc tggagggcct
 841 cccaagccct ggcctgaagg acccatggcg aatgctgctg cccccacgag cacccctcag
 901 aagctgattc cccgcagcc aacgggccgc ccttcccccg cgccccctgc cgtcccaccc
 961 gccgcctcgc ccgtgatgcc accgcagacc cagtcccccg ggcagccggc ccagcccgcg
1021 cccatggtgc cactgcacca gaagcagagc cgcatcaccc ccatccagaa gccgcggggc
1081 ctcgaccctg tggagatcct gcaggagcgc gagtacaggc tgcaggctcg catcgcacac
1141 cgaattcagg aacttgaaaa ccttcccggg tccctggccg gggatttgcg aaccaaagcg
1201 accattgagc tcaaggccct caggctgctg aacttccaga ggcagctgcg ccaggaggtg
1261 gtggtgtgca tgcggaggga cacagcgctg gagacagccc tcaatgctaa ggcctacaag
1321 cgcagcaagc gccagtccct gcgcgaggcc cgcatcactg agaagctgga gaagcagcag
1381 aagatcgagc aggagcgcaa gcgccggcag aagcaccagg aatacctcaa tagcattctc
1441 cagcatgcca aggatttcaa ggaatatcac agatccgtca caggcaaaat ccagaagctg
1501 accaaggcag tggccacgta ccatgccaac acggagcggg agcagaagaa agagaacgag
1561 cggatcgaga aggagcgcat gcggaggctc atggctgaag atgaggaggg gtaccgcaag
1621 ctcatcgacc agaagaagga caagcgcctg gcctacctct tgcagcagac agacgagtac
1681 gtggctaacc tcacggagct ggtgcggcag cacaaggctg cccaggtcgc caaggagaaa
1741 aagaagaaaa agaaaaagaa gaaggcagaa aatgcagaag gacagacgcc tgccattggg
1801 ccggatggcg agcctctgga cgagaccagc cagatgagcg acctcccggt gaaggtgatc
1861 cacgtggaga gtgggaagat cctcacaggc acagatgccc ccaaagccgg gcagctggag
1921 gcctggctcg agatgaaccc ggggtatgaa gtagctccga ggtctgatag tgaagaaagt
1981 ggctcagaag aagaggaaga ggaggaggag gaagagcagc cgcaggcagc acagcctccc
2041 accctgcccg tggaggagaa gaagaagatt ccagatccag acagcgatga cgtctctgag
2101 gtggacgcgc ggcacatcat tgagaatgcc aagcaagatg tcgatgatga atatggcgtg
2161 tcccaggccc ttgcacgtgg cctgcagtcc tactatgccg tggcccatgc tgtcactgag
2221 agagtggaca agcagtcagc gcttatggtc aatggtgtcc tcaaacagta ccagatcaaa
2281 ggtttggagt ggctggtgtc cctgtacaac aacaacctga acggcatcct ggccgacgag
2341 atgggcctgg ggaagaccat ccagaccatc gcgctcatca cgtacctcat ggagcacaaa
2401 cgcatcaatg ggcccttcct catcatcgtg cctctctcaa cgctgtccaa ctgggcgtac
2461 gagtttgaca agtgggcccc ctccgtggtg aaggtgtctt acaagggatc ccagcagca
2521 agacgggcct ttgtccccca gctccggagt gggaagttca acgtcttgct gacgacgtac
2581 gagtacatca tcaaagacaa gcacatcctc gccaagatcc gttggaagta catgattgtg
2641 gacgaaggtc accgcatgaa gaaccaccac tgcaagctga cgcaggtgct caacacgcac
2701 tatgtggcac cccgccgcct gctgctgacg ggcacaccgc tgcagaacaa gcttcccgag
2761 ctctgggcgc tgctcaactt cctgctgccc accatcttca agagctgcag caccttcgag
2821 cagtggttta acgcaccctt tgccatgacc ggggaaaagg tggacctgaa tgaggaggaa
2881 accattctca tcatccggcg tctccacaaa gtgctgcggc ccttcttgct ccgacgactc
2941 aagaaggaag tcgaggccca gttgcccgaa aaggtggagt acgtcatcaa gtgcgacatg
3001 tctgcgctgc agcgagtgct ctaccgccac atgcaggcca agggcgtgct gctgactgat
3061 ggctccgaga aggacaagaa gggcaaaggc ggcaccaaga ccctgatgaa caccatcatg
3121 cagctgcgga agatctgcaa ccacccctac atgttccagc acatcgagga gtccttttcc
3181 gagcacttgg ggttcactgg cggcattgtc caagggctgg acctgtaccg agcctcgggt
3241 aaatttgagc ttcttgatag aattcttccc aaactccgag caaccaacca caaagtgctg
3301 ctgttctgcc aaatgacctc cctcatgacc atcatggaag attactttgc gtatcgcggc
3361 tttaaatacc tcaggcttga tggaaccacg aaggcggagg accggggcat gctgctgaaa
3421 accttcaacg agcccggctc tgagtacttc atcttcctgc tcagcacccg ggctgggggg
3481 ctcggcctga acctccagtc ggcagacact gtgatcattt ttgacagcga ctggaatcct
```

TABLE 1-continued

```
3541 caccaggacc tgcaagcgca ggaccgagcc caccgcatcg ggcagcagaa cgaggtgcgt
3601 gtgctccgcc tctgcaccgt caacagcgtg gaggagaaga tcctagctgc agccaagtac
3661 aagctcaacg tggaccagaa ggtgatccag gccggcatgt tcgaccagaa gtcctccagc
3721 catgagcggc gcgccttcct gcaggccatc ctggagcacg aggagcagga tgaggaggaa
3781 gacgaggtgc ccgacgacga gaccgtcaac cagatgatcg cccggcacga ggaggagttt
3841 gatctgttca tgcgcatgga cctggaccgc aggcgcgagg aggcccgcaa ccccaagcgg
3901 aagccgcgcc tcatggagga ggacgagctc ccctcgtgga tcatcaagga cgacgcggag
3961 gtggagcggc tgacctgtga ggaggaggag gagaagatgt tcggccgtgg ctcccgccac
4021 cgcaaggagg tggactacag cgactcactg acggagaagc agtggctcaa ggccatcgag
4081 gagggcacgc tggaggagat cgaagaggag gtccggcaga agaaatcatc acggaagcgc
4141 aagcgagaca gcgacgccgg ctcctccacc ccgaccacca gcacccgcag ccgcgacaag
4201 gacgacgaga gcaagaagca gaagaagcgc gggcggccgc ctgccgagaa actctcccct
4261 aacccaccca acctcaccaa gaagatgaag aagattgtgg atgccgtgat caagtacaag
4321 gacagcagca gtggacgtca gctcagcgag gtcttcatcc agctgccctc gcgaaaggag
4381 ctgcccgagt actacgagct catccgcaag cccgtggact tcaagaagat aaaggagcgc
4441 attcgcaacc acaagtaccg cagcctcaac gacctagaga aggacgtcat gctcctgtgc
4501 cagaacgcac agaccttcaa cctggagggc tccctgatct atgaagactc catcgtcttg
4561 cagtcggtct tcaccagcgt gcggcagaaa atcgagaagg aggatgacag tgaaggcgag
4621 gagagtgagg aggaggaaga gggcgaggag gaaggctccg aatccgaatc tcggtccgtc
4681 aaagtgaaga tcaagcttgg ccggaaggag aaggcacagg accggctgaa gggcggccgg
4741 cggcggccga gccgagggtc ccgagccaag ccggtcgtga gtgacgatga cagtgaggag
4801 gaacaagagg aggaccgctc aggaagtggc agcgaagaag actgagcccc gacattccag
4861 tctcgacccc gagcccctcg ttccagagct gagatggcat aggccttagc agtaacgggt
4921 agcagcagat gtagtttcag acttggagta aaactgtata aacaaaagaa tcttccatat
4981 ttatacagca gagaagctgt aggactgttt gtgactggcc ctgtcctggc atcagtagca
5041 tctgtaacag cattaactgt cttaaagaga gagagagaga attccgaatt ggggaacaca
5101 cgatacctgt tttctttttc cgttgctggc agtactgttg cgccgcagtt tggagtcact
5161 gtagttaagt gtggatgcat gtgcgtcacc gtccactcct cctactgtat tttattggac
5221 aggtcagact cgccgggggc ccggcgaggg tatgtcagtg tcactggatg tcaaacagta
5281 ataaattaaa ccaacaacaa aacgcacagc caaaaaaaaa
```

SEQ ID NO: 194 Human SMARCA4 Amino Acid Sequence Isoform F (NP_001122320.1)

```
   1 mstpdpplgg tprpgpspgp gpspgamlgp spgpspgsah smmgpspgpp saghpiptqg
  61 pggypqdnmh qmhkpmesmh ekgmsddpry nqmkgmgmrs gghagmgppp spmdqhsqgy
 121 psplggseha sspvpasgps sgpqmssgpg gapldgadpq algqqnrgpt pfnqnqlhql
 181 raqimaykml argqplpdhl qmavqgkrpm pgmqqqmptl pppsysatgp gpgpgpgpgp
 241 gpgpappnys rphgmggpnm pppgpsgvpp gmpgqppggp pkpwpegpma naaaptstpq
 301 klippqptgr pspappavpp aaspvmppqt gspggpagpa pmvplhqkqs ritpiqkprg
 361 ldpveilqer eyrlqariah riqelenlpg slagdlrtka tielkalrll nfqrqlrgev
 421 vvcmrrdtal etalnakayk rskrqslrea riteklekqg kiegerkrrq khqeylnsil
 481 qhakdfkeyh rsvtgkiqkl tkavatyhan tereqkkene riekermrrl maedeegyrk
 541 lidqkkdkrl ayllqqtdey vanitelvrq hkaaqvakek kkkkkkkkae naegqtpaig
 601 pdgepldets qmsdlpvkvi hvesgkiltg tdapkagqle awlemnpgye vaprsdsees
 661 gseeeeeeee eeqpqaaqpp tlpveekkki pdpdsddvse vdarhiiena kqdvddeygv
 721 sqalarglqs yyavahavte rvdkqsalmv ngvlkqyqik glewlvslyn nnlngilade
 781 mglgktiqti alitylmehk ringpfliiv plstlsnway efdkwapsvv kvsykgspaa
 841 rrafvpqlrs gkfnvlltty eyiikdkhil akirwkymiv deghrmknhh ckltqvinth
 901 yvaprrlllt gtplqnklpe lwallnfllp tifkscstfe qwfnapfamt gekvdlneee
 961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcgmtslmt imedyfayrg fkylrldgtt kaedrgmllk
1141 tfnepgseyf ifllstragg lglnlqsadt viifdsdwnp hqdlqaqdra hrigqgnevr
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikddae
1321 verltceeee ekmfgrgsrh rkevdysdsl tekqwlkaie egtleeieee vrqkkssrkr
1381 krdsdagsst pttstrsrdk ddeskkqkkr grppaeklsp nppnitkkmk kivdavikyk
1441 dssgrqlsev fiqlpsrkel peyyelirkp vdfkkikeri rnhkyrslnd lekdvmllcq
1501 naqtfnlegs liyedsivlq svftsvrqki ekeddsegee seeeeegeee gsesesrsvk
1561 vkiklgrkek aqdrlkggrr rpsrgsrakp vvsdddseee qeedrsgsgs eed
```

SEQ ID NO: 195 Human SMARCA4 cDNA Sequence Variant 7 (NM_001128848.1, CDS: 1-4842)

```
   1 atgtccactc cagacccacc cctgggcgga actcctcggc caggtccttc cccgggccct
  61 ggcccttccc ctggagccat gctgggccct agcccgggtc cctcgccggg ctccgcccac
 121 agcatgatgg ggcccagccc agggccgccc tcagcaggac accccatccc cacccagggg
 181 cctggagggt accctcagga caacatgcac cagatgcaca agcccatgga gtccatgcat
 241 gagaagggca tgtcggacga cccgcgctac aaccagatga aaggaatggg gatgcggtca
 301 gggggccatg ctgggatggg gcccccgccc agccccatgg accagcactc ccaaggttac
 361 ccctcgcccc tgggtggctc tgagcatgcc tctagtccag ttccagccag tggcccgtct
 421 tcggggcccc agatgtcttc cgggccagga ggtgccccgc tggatggtgc tgaccccccag
 481 gccttggggc agcagaaccg gggcccaacc ccatttaacc agaaccagct gcaccagctc
 541 agagctcaga tcatggccta caagatgctg gccagggggc agcccctccc cgaccacctg
 601 cagatggcgg tgcagggcaa gcggccgatg cccgggatgc agcagcagat gccaacgcta
 661 cctccaccct cggtgtccgc aacaggaccc ggccctggcc ctggccctgg ccccggcccg
 721 ggtcccggcc cggcacctcc aaattacagc aggcctcatg gtatgggagg gcccaacatg
 781 cctcccccag gaccctcggg cgtgcccccc gggatgccag gccagcctcc tggagggcct
 841 cccaagccct ggcctgaagg acccatggcg aatgctgctg cccccacgag cacccctcag
 901 aagctgattc ccccgcagcc aacgggccgc ccttcccccg cgccccctgc cgtcccaccc
 961 gccgcctcgc ccgtgatgcc accgcagacc cagtcccccg ggcagccggc ccagcccgcg
1021 cccatggtgc cactgcacca gaagcagagc cgcatcaccc ccatccagaa gccgcggggc
```

TABLE 1-continued

```
1081 ctcgaccctg tggagatcct gcaggagcgc gagtacaggc tgcaggctcg catcgcacac
1141 cgaattcagg aacttgaaaa ccttcccggg tccctggccg gggatttgcg aaccaaagcg
1201 accattgagc tcaaggccct caggctgctg aacttccaga ggcagctgcg ccaggaggtg
1261 gtggtgtgca tgcggaggga cacagcgctg gagacagccc tcaatgctaa ggcctacaag
1321 cgcagcaagc gccagtccct gcgcgaggcc cgcatcactg agaagctgga gaagcagcag
1381 aagatcgagc aggagcgcaa gcgccggcag aagcaccagg aatacctcaa tagcattctc
1441 cagcatgcca aggatttcaa ggaatatcac agatccgtca caggcaaaat ccagaagctg
1501 accaaggcag tggccacgta ccatgccaac acggagcggg agcagaagaa agagaacgag
1561 cggatcgaga aggagcgcat gcggaggctc atggctgaag atgaggaggg gtaccgcaag
1621 ctcatcgacc agaagaagga caagcgcctg gcctacctct tgcagcagac agacgagtac
1681 gtggctaacc tcacggagct ggtgcggcag cacaaggctg cccaggtcgc caaggagaaa
1741 aagaagaaaa agaaaaagaa gaaggcagaa aatgcagaag gacagacgcc tgccattggg
1801 ccggatggcg agcctctgga cgagaccagc cagatgagcg acctcccggt gaaggtgatc
1861 cacgtggaga gtgggaagat cctcacaggc acagatgccc ccaaagccgg gcagctggag
1921 gcctggctcg agatgaaccc ggggtatgaa gtagctccga ggtctgatag tgaagaaagt
1981 ggctcagaag aagaggaaga ggaggaggag gaagagcagc cgcaggcagc acagcctccc
2041 accctgcccg tggaggagaa gaagaagatt ccagatccag acagcgatga cgtctctgag
2101 gtggacgcgc ggcacatcat tgagaatgcc aagcaagatg tcgatgatga atatggcgtg
2161 tcccaggccc ttgcacgtgg cctgcagtcc tactatgccg tggcccatgc tgtcactgag
2221 agagtggaca agcagtcagc gcttatggtc aatggtgtcc tcaaacagta ccagatcaaa
2281 ggtttggagt ggctggtgtc cctgtacaac aacaacctga acggcatcct ggccgacgag
2341 atgggcctgg ggaagaccat ccagaccatc gcgctcatca cgtacctcat ggagcacaaa
2401 cgcatcaatg ggcccttcct catcatcgtg cctctctcaa cgctgtccaa ctgggcgtac
2461 gagtttgaca agtgggcccc ctccgtggtg aaggtgtctt acaagggatc cccagcagca
2521 agacgggcct ttgtccccca gctccggagt gggaagttca acgtcttgct gacgacgtac
2581 gagtacatca tcaaagacaa gcacatcctc gccaagatcc gttggaagta catgattgtg
2641 gacgaaggtc accgcatgaa gaaccaccac tgcaagctga cgcaggtgct caacacgcac
2701 tatgtggcac cccgccgcct gctgctgacg ggcacaccgc tgcagaacaa gcttcccgag
2761 ctctgggcgc tgctcaactt cctgctgccc accatcttca agagctgcag caccttcgag
2821 cagtggttta acgcaccctt tgccatgacc ggggaaaagg tggacctgaa tgaggaggaa
2881 accattctca tcatccggcg tctccacaaa gtgctgcggc ccttcttgct ccgacgactc
2941 aagaaggaag tcgaggccca gttgcccgaa aaggtggagt acgtcatcaa gtgcgacatg
3001 tctgcgctgc agcgagtgct ctaccgccac atgcaggcca agggcgtgct gctgactgat
3061 ggctccgaga aggacaagaa gggcaaaggc ggcaccaaga ccctgatgaa caccatcatg
3121 cagctgcgga agatctgcaa ccacccctac atgttccagc acatcgagga gtccttttcc
3181 gagcacttgg ggttcactgg cggcattgtc caagggctgg acctgtaccg agcctcgggt
3241 aaatttgagc ttcttgatag aattcttccc aaactccgag caaccaacca caaagtgctg
3301 ctgttctgcc aaatgacctc cctcatgacc atcatggaag attactttgc gtatcgcggc
3361 tttaaatacc tcaggcttga tggaaccacg aaggcggagg accggggcat gctgctgaaa
3421 accttcaacg agcccggctc tgagtacttc atcttcctgc tcagcacccg ggctgggggg
3481 ctcggcctga acctccagtc ggcagacact gtgatcattt ttgacagcga ctggaatcct
3541 caccaggacc tgcaagcgca ggaccgagcc caccgcatcg ggcagcagaa cgaggtgcgt
3601 gtgctccgcc tctgcaccgt caacagcgtg gaggagaaga tcctagctgc agccaagtac
3661 aagctcaacg tggaccagaa ggtgatccag gccggcatgt tcgaccagaa gtcctccagc
3721 catgagcggc gcgccttcct gcaggccatc ctggagcacg aggagcagga tgaggaggaa
3781 gacgaggtgc ccgacgacga gaccgtcaac cagatgatcg cccggcacga ggaggagttt
3841 gatctgttca tgcgcatgga cctggaccgc aggcgcgagg aggcccgcaa ccccaagcgg
3901 aagccgcgcc tcatggagga ggacgagctc ccctcgtgga tcatcaagga cgacgcggag
3961 gtggagcggc tgacctgtga ggaggaggag gagaagatgt tcggccgtgg ctcccgccac
4021 cgcaaggagg tggactacag cgactcactg acggagaagc agtggctcaa ggccatcgag
4081 gagggcacgc tggaggagat cgaagaggag gtccggcaga agaaatcatc acggaagcgc
4141 aagcgagaca gcgacgccgg ctcctccacc ccgaccacca gcacccgcag ccgcgacaag
4201 gacgacgaga gcaagaagca gaagaagcgc gggcggccgc ctgccgagaa actctcccct
4261 aacccaccca acctcaccaa gaagatgaag aagattgtgg atgccgtgat caagtacaag
4321 gacagcagtg gacgtcagct cagcgaggtc ttcatccagc tgccctcgcg aaaggagctg
4381 cccgagtact acgagctcat ccgcaagccc gtggacttca agaagataaa ggagcgcatt
4441 cgcaaccaca agtaccgcag cctcaacgac ctagagaagg acgtcatgct cctgtgccag
4501 aacgcacaga ccttcaacct ggagggctcc ctgatctatg aagactccat cgtcttgcag
4561 tcggtcttca ccagcgtgcg gcagaaaatc gagaaggagg atgacagtga aggcgaggag
4621 agtgaggagg aggaagaggg cgaggaggaa ggctccgaat ccgaatctcg gtccgtcaaa
4681 gtgaagatca agcttggccg gaaggagaag gcacaggacc ggctgaaggg cggccggcgg
4741 cggccgagcc gagggtcccg agccaagccg gtcgtgagtg acgatgacag tgaggaggaa
4801 caagaggagg accgctcagg aagtggcagc gaagaagact gagccccgac attccagtct
4861 cgaccccgag cccctcgttc cagagctgag atggcatagg ccttagcagt aacgggtagc
4921 agcagatgta gtttcagact tggagtaaaa ctgtataaac aaaagaatct tccatattta
4981 tacagcagag aagctgtagg actgtttgtg actggccctg tcctggcatc agtagcatct
5041 gtaacagcat taactgtctt aaagagagag agagagaatt ccgaattggg gaacacacga
5101 tacctgtttt tcttttccgt tgctggcagt actgttgcgc cgcagtttgg agtcactgta
5161 gttaagtgtg gatgcatgtg cgtcaccgtc cactcctcct actgtatttt attggacagg
5221 tcagactcgc cgggggcccg gcgagggtat gtcagtgtca ctggatgtca aacagtaata
5281 aattaaacca acaacaaaac gcacagccaa aaaaaaa
```

SEQ ID NO: 196 Mouse SMARCA4 cDNA Sequence variant 1 (NM_001174078.1; CDS: 261-5114)

```
  1 ggcaagtgga gcgggtagac agggaggcgg gggcgcgcgg cgggcgcgtg cggtgggggg
 61 gggtggcctg gcgaagccca gcgggcgcgc gcgcgaggct ttccca ctcg cttggcagcg
121 gcggagacgg cttctttgtt tcctgaggag aagcgagacg cccactctgt ccccgacccc
181 tcgtggaggg ttgggggcgg cgccaggaag gttacggcgc cgttacctcc aggagaccag
241 tgcctgtagc tccagtaaag atgtctactc cagacccacc cttgggtggg actcctcggc
301 ctggtccttc cccaggccct ggtccttcac ctggtgcaat gctgggtcct agccctggcc
```

TABLE 1-continued

| | | | | | | |
|---|---|---|---|---|---|---|
| 361 | cctcaccagg | ttctgcccac | agcatgatgg | ggccaagccc | aggacctcct | tcagcaggac |
| 421 | atcccatgcc | cacccagggg | cctggagggt | acccccagga | caacatgcat | cagatgcaca |
| 481 | agcctatgga | gtccatgcac | gagaagggca | tgcctgatga | cccacgatac | aaccagatga |
| 541 | aagggatggg | catgcggtca | ggggcccaca | caggcatggc | acctccacct | agtcccatgg |
| 601 | accagcattc | tcaaggttac | cctcaccccc | tcggcggctc | tgaacatgcc | tccagtcctg |
| 661 | tcccagccag | tggcccatct | tcaggccccc | agatgtcctc | tgggccagga | ggggccccac |
| 721 | tagatggttc | tgatccccag | gccttgggac | agcaaaacag | aggcccaacc | ccatttaacc |
| 781 | agaaccagct | gcatcaactc | agagctcaga | taatggccta | caagatgttg | gccagggggcc |
| 841 | agccattgcc | cgaccacctg | cagatggccg | tgcaaggcaa | gcggccgatg | cctggaatgc |
| 901 | agcaacagat | gccaacacta | cctccaccct | cagtgtccgc | cacaggaccc | ggacctggac |
| 961 | ccggccctgg | ccctggccct | ggcccaggac | cagcccctcc | aaattacagt | agaccccatg |
| 1021 | gtatgggagg | gcccaacatg | cctcccccag | gaccctcagg | tgtgcccccc | gggatgcctg |
| 1081 | gtcagccgcc | tggagggcct | cccaagccat | ggcctgaagg | acccatggcc | aatgctgctg |
| 1141 | cccccacaag | caccccacag | aagctgattc | ctccgcaacc | aacaggccgt | ccttcacctg |
| 1201 | cacctcctgc | tgtcccgcct | gctgcctcac | ctgtaatgcc | accacaaaca | cagtccccag |
| 1261 | ggcagccagc | ccagcctgct | ccattggtgc | cactgcacca | gaagcagagc | cgaatcaccc |
| 1321 | ccatccagaa | gccccgaggc | cttgaccctg | tggagatcct | acaagagcgg | gagtacaggc |
| 1381 | ttcaggctcg | aatcgcacac | agaattcagg | aacttgaaaa | cctccctggg | tccctggctg |
| 1441 | gggaccttcg | aaccaaagca | accatcgaac | tcaaggccct | taggttgctg | aacttccaga |
| 1501 | ggcagctgcg | ccaggaggtg | gtggtgtgca | tgcgaagaga | cacagccctg | gagacagccc |
| 1561 | tcaatgccaa | ggcctacaag | cgcagcaaac | gtcagtcact | acgggaggcc | cgcatcactg |
| 1621 | agaagttgga | gaagcagcag | aagattgaac | aggagcgcaa | gcgccgccag | aagcaccagg |
| 1681 | agtacctcaa | cagcattctg | cagcatgcca | aggacttcag | ggagtatcac | agatcagtca |
| 1741 | caggcaaact | ccagaaactc | accaaggctg | tggccaccta | ccatgccaac | actgagcggg |
| 1801 | agcagaagaa | agaaaatgag | cgcattgaga | aggagcgaat | gcggaggctt | atggctgaag |
| 1861 | atgaggaggg | ctaccgcaaa | ctcattgacc | agaagaagga | caagcgcctg | gcctaccttc |
| 1921 | tgcagcagac | agatgagtat | gtggccaacc | tcacagagct | ggtgcggcag | cacaaagctg |
| 1981 | cccaggttgc | caaggagaag | aagaagaaaa | agaaaaagaa | gaaggcagaa | aatgctgaag |
| 2041 | gacagacacc | tgctattgga | ccagatggtg | agcctctgga | tgagaccagc | cagatgagtg |
| 2101 | acctccctgt | gaaggtgatc | cacgtggaga | gtggcaagat | cctcactggc | acagatgccc |
| 2161 | caaaagccgg | gcagctggaa | gcctggcttg | aaatgaaccc | agggtatgaa | gtagccccca |
| 2221 | ggtcagacag | tgaagaaagt | ggctctgaag | aggaggagga | ggaggaggaa | gaggagcagc |
| 2281 | ctcagcccgc | acagcccct | acactgcctg | tggaagaaaa | gaagaagatt | ccagacccag |
| 2341 | acagcgatga | tgtctctgag | gtggacgccc | gacacattat | tgagaacgcc | aagcaagatg |
| 2401 | tggacgatga | gtacggtgtg | tcccaggccc | ttgctcgtgg | cctgcagtct | tactatgctg |
| 2461 | tggcccatgc | agtcacagag | agagtagata | agcagtccgc | cctcatggtc | aacggtgtcc |
| 2521 | tcaaacagta | ccagatcaag | ggtttggagt | ggctggtgtc | cctgtacaac | aacaacctga |
| 2581 | atggcatcct | ggctgatgag | atggggctgg | ggaagaccat | ccagaccatc | gcgctcatca |
| 2641 | catacctcat | ggagcacaag | cgcatcaacg | ggcctttcct | catcatcgtg | cctctctcga |
| 2701 | cactgtcaaa | ctgggcgtat | gaatttgaca | agtgggcccc | ctctgtggtg | aaggtttctt |
| 2761 | acaagggctc | tccagctgca | aggcgagctt | ttgtcccaca | gcttcgcagt | gggaagttca |
| 2821 | acgtcttact | gaccacctat | gaatatatca | tcaaagacaa | gcatatccta | gccaagatcc |
| 2881 | gctggaagta | catgattgtg | gatgaaggcc | accgcatgaa | aaaccaccac | tgcaagttga |
| 2941 | cgcaggtcct | taacacacac | tacgtggccc | ctcggcgcct | gcttcttaca | ggcacaccac |
| 3001 | tgcagaacaa | gctaccggag | ctctgggccc | tgcttaactt | cctgctcccc | actatcttca |
| 3061 | agagctgcag | caccttcgaa | cagtggttca | atgcaccctt | tgccatgact | ggagaaaagg |
| 3121 | tggacctgaa | tgaagaggag | actatcctca | ttattcgtcg | cctacacaaa | gttctgcggc |
| 3181 | ccttcctgct | gcggcggctc | aagaaggaag | ttgaagccca | gctccctgag | aaggtagagt |
| 3241 | atgtcatcaa | atgcgacatg | tcagccctgc | agcgtgtgct | gtaccgtcac | atgcaggcca |
| 3301 | aaggtgtgct | gctgactgac | ggctccgaga | aggacaagaa | gggcaaaggt | ggcaccaaga |
| 3361 | cactgatgaa | cactattatg | caactgcgta | agatctgcaa | ccacccctac | atgttccagc |
| 3421 | acatcgagga | gtccttttct | gagcacttgg | ggttcaccgg | cggcatcgtg | caaggattgg |
| 3481 | acctttaccg | tgcctcaggg | aaatttgaac | ttcttgatag | aattctaccc | aaactccgtg |
| 3541 | caacgaacca | taaagtgctc | ctcttttgcc | aaatgacctc | cctcatgacc | atcatggaag |
| 3601 | actactttgc | ataccgtggc | ttcaaatacc | tcaggcttga | tggaaccaca | aaagcagaag |
| 3661 | accggggcat | gctgttgaaa | acctttaatg | aacctggctc | tgagtatttc | attttcctgc |
| 3721 | tcagtacccg | tgctgggggg | ctgggcctga | atctgcagtc | agctgacact | gtgatcatct |
| 3781 | ttgacagtga | ctggaatccc | caccaggacc | tgcaagcaca | ggatcgagcc | catcgcattg |
| 3841 | gacagcagaa | tgaggtgcgt | gttcttcgcc | tgtgcacggt | caacagtgtg | gaagagaaga |
| 3901 | tactggctgc | tgccaaatac | aaactcaatg | tggatcagaa | ggtgatccag | gcaggcatgt |
| 3961 | tcgaccagaa | gtcgtccagc | catgagaggc | gtgccttcct | gcaggccatc | ctggagcacg |
| 4021 | aggagcagga | tgaggaggaa | gatgaggtgc | ctgatgatga | gaccgtcaac | cagatgattg |
| 4081 | cccggcacga | agaagagttt | gacctcttca | tgcgcatgga | cttggaccgc | cggcgtgaag |
| 4141 | aagcccgcaa | ccccaagcgg | aagccacgcc | tgatggaaga | ggatgagctc | ccatcctgga |
| 4201 | tcatcaagga | tgatgccgag | gtggagcggc | tgacatgtga | agaggaagag | gagaagatgt |
| 4261 | tcggccgtgg | ttctcgccac | cgcaaggagg | tagactacag | cgactcactg | acagagaagc |
| 4321 | agtggctcaa | gaccctgaag | gctatcgagg | agggcacgct | ggaggagatc | gaagaggagg |
| 4381 | tccggcagaa | gaaatcttca | cgtaagcgta | agcgagacag | cgaggccggc | tcctccaccc |
| 4441 | cgaccaccag | cacccgcagc | cgtgacaagg | atgaggagag | caagaagcag | aagaaacgtg |
| 4501 | ggcggccacc | tgctgagaag | ctgtccccaa | acccacctaa | cctcaccaag | aagatgaaga |
| 4561 | agatcgtgga | tgctgtgatc | aagtacaaag | acagcagcag | tggacgtcag | ctcagcgagg |
| 4621 | tgttcatcca | gctcccctct | cgcaaggagc | ttcctgagta | ctatgagctc | atccgaaagc |
| 4681 | ctgtggactt | caagaagatc | aaggaacgca | tccgaaacca | caagtaccgc | agcctcaatg |
| 4741 | acctggagaa | ggatgtgatg | ctgctgtgcc | agaacgctca | gacgttcaac | ctcgagggtt |
| 4801 | ccctgatcta | tgaggactcc | atcgtcctgc | agtctgtctt | caccagcgta | cggcagaaga |
| 4861 | ttgagaagga | ggacgacagt | gaaggcgagg | aaagcgagga | ggaggaggag | ggcgaggagg |
| 4921 | aaggctccga | gtctgagtcc | cgctccgtca | aggtgaagat | caagctgggc | cgcaaggaga |
| 4981 | aggcccagga | ccgactcaag | gggggccgcc | ggcggccaag | ccggggatcc | cgggccaagc |
| 5041 | cggttgtgag | tgacgatgac | agtgaggagg | agcaggagga | ggaccgctca | ggaagtggca |
| 5101 | gtgaggaaga | ctgaaccaga | cattcctgag | tcctgacccc | gaggcgctcg | tcccagccaa |

TABLE 1-continued 5161 gatggagtag cccttagcag tgatgggtag caccagatgt agtttcgaac ttggagaact
5221 gtacacatgc aatcttccac atttttaggc agagaagtat aggcctgtct gtcggccctg
5281 gcctggcctc gagtctctac cagcattaac tgtctagaga ggggacctcc tgggagcacc
5341 atccacctcc ccaggcccca gtcactgtag ctcagtggat gcatgcgcgt gccggccgct
5401 ccttgtactg tatcttactg gacagggcca gctctccagg aggctcacag gcccagcggg
5461 tatgtcagtg tcactggagt cagacagtaa taaattaaag caatgacaag ccaccactgg
5521 ctccctggac tccttgctgt cagcagtggc tccggggcca cagagaagaa agaaaagactt
5581 ttaggaactg ggtctaactt atgggcaaag tacttgcctt gccaggtgta tgggttttgc
5641 attcccatca cccacacacc ctaaacaagc caagtcagtg agcttcaagt tagagcctcc
5701 acctcaatgt gtacgtggaa agcaatcaaa gatgatgcct agcatccacc tctggccctc
5761 atgtgcagat gtacacacac tgaattacat acacgggaca cacacatcca cacggaggca
5821 gtccatgact tgcactgggg agatggtacc ataggcgaaa gtgccacagg cacagggcca
5881 ggctaattta gtcctgcagt cctgtgctct taagatgaag gcacaaagag gaaccccagg
5941 cgctccaact agcatgccag gcagtgacaa gaccctgctt caaatgaatc agagcccaca
6001 ttcagtattg ccctcttacc cgatgcgatg cccatgccct cacatatgaa tgtgtatata
6061 tacatacata cgtaaaataa ttcttttttta aattatagac atttttgtgt gaatgttttg
6121 cctgaatgtg tgtgtgtgtg tgtgtgtgtg tgtgtgtgtg tgtgtgtgtg tatcaagtac
6181 attcctagag cctacagagg tcaagggagg gcattggatc tggaactgga gtcacatgag
6241 gctgtgagca actgtgtggg ttcctgggcc tttgcaacag cagttagtac tcttcaccac
6301 tgagccattt ctccaatctc aaaaagaagc attcttttaa atgaagactg aaataaataa
6361 gtaggacttg ccttgg SEQ ID NO: 197 Mouse SMARCA4 Amino Acid Sequence isoform 1 (NP_001167549.1)
1 mstpdpplgg tprpgpspgp gpspgamlgp spgpspgsah smmgpspgpp saghpmptqg
61 pggypqdnmh qmhkpmesmh ekgmpddpry nqmkgmgmrs gahtgmappp spmdqhsqgy
121 psplggseha sspvpasgps sgpqmssgpg gapldgsdpq algqqnrgpt pfnqnqlhql
181 raqimaykml argqplpdhl qmavqgkrpm pgmqqqmptl pppsysatgp gpgpgpgpgp
241 gpgpappnys rphgmggpnm pppgpsgvpp gmpgqppggp pkpwpegpma naaaptstpq
301 klippqptgr pspappavpp aaspvmppqt gspggpagpa plvplhqkqs ritpiqkprg
361 ldpveilqer eyrlqariah rigelenlpg slagdlrtka tielkalrll nfqrqlrgev
421 vvcmrrdtal etalnakayk rskrqslrea riteklekqq kieqerkrrq khqeylnsil
481 qhakdfreyh rsvtgklqkl tkavatyhan tereqkkene riekermrrl maedeegyrk
541 lidqkkdkrl ayllqqtdey vanltelvrq hkaaqvakek kkkkkkkkae naegqtpaig
601 pdgepldets qmsdlpvkvi hvesgkiltg tdapkagqle awlemnpgye vaprsdsees
661 gseeeeeeee eeqpqpaqpp tlpveekkki pdpdsddvse vdarhiiena kqdvddeygv
721 sqalarglqs yyavahavte rvdkqsalmv ngvlkqyqik glewlvslyn nnlngilade
781 mglgktiqti alitylmehk ringpfliiv plstlsnway efdkwapsvv kvsykgspaa
841 rrafvpqlrs gkfnvllty eyiikdkhil akirwkymiv deghrmknhh ckltqvlnth
901 yvaprrlllt gtplqnklpe lwallnfllp tifkscstfe qwfnapfamt gekvdlneee
961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcgmtslmt imedyfayrg fkylrldgtt kaedrgmllk
1141 tfnepgseyf ifllstragg lglnlqsadt viifdsdwnp hqdlqaqdra hrigqgnevr
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikddae
1321 verltceeee ekmfgrgsrh rkevdysdsl tekqwlktlk aieegtleei eeevrqkkss
1381 rkrkrdseag sstpttstrs rdkdeeskkq kkrgrppaek lspnppnitk kmkkivdavi
1441 kykdsssgrq lsevfiqlps rkelpeyyel irkpvdfkki kerirnhkyr slndlekdvm
1501 llcqnaqtfn legsliyeds ivlqsvftsv rqkiekedds egeeseeeee geeegseses
1561 rsvkvkiklg rkekaqdrlk ggrrrpsrgs rakpvvsddd seeeqeedrs gsgseed SEQ ID NO: 198 Mouse SMARCA4 cDNA Sequence variant 2 (NM_011417.3)
1 ggcaagtgga gcgggtagac agggaggcgg gggcgcgcgg cgggcgcgtg cggtgggggg
61 gggtggcctg gcgaagccca gcgggcgcgc gcgcgaggct ttcccactcg cttggcagcg
121 gcggagacgg cttctttgtt tcctgaggag aagcgagacg cccactctgt ccccgacccc
181 tcgtggaggg ttgggggcgg cgccaggaag gttacggcgc cgttacctcc aggagaccag
241 tgcctgtagc tccagtaaag atgtctactc cagacccacc cttgggtggg actcctcggc
301 ctggtccttc cccaggccct ggtccttcac ctggtgcaat gctgggtcct agccctggcc
361 cctcaccagg ttctgcccac agcatgatgg ggccaagccc aggacctcct tcagcaggac
421 atcccatgcc cacccagggg cctggagggt acccccagga caacatgcat cagatgcaca
481 agcctatgga gtccatgcac gagaagggca tgcctgatga cccacgatac aaccagatga
541 aagggatggg catgcggtca ggggcccaca caggcatggc acctccacct agtcccatgg
601 accagcattc tcaaggttac ccctcacccc tcggcggctc tgaacatgcc tccagtcctg
661 tcccagccag tggcccatct tcaggccccc agatgtcctc tgggccagga ggggccccac
721 tagatggttc tgatccccag gccttgggac agcaaaacag aggcccaacc ccatttaacc
781 agaaccagct gcatcaactc agagctcaga taatggccta caagatgttg gccagggggcc
841 agccattgcc cgaccacctg cagatggccg tgcaaggcaa gcggccgatg cctggaatgc
901 agcaacagat gccaacacta cctccaccct cagtgtccgc cacaggaccc ggacctggac
961 ccggccctgg ccctggccct ggcccaggac cagcccctcc aaattacagt agaccccatg
1021 gtatgggagg gcccaacatg cctcccccag gaccctcagg tgtgcccccc gggatgcctg
1081 gtcagccgcc tggagggcct cccaagccat ggcctgaagg acccatggcc aatgctgctg
1141 cccccacaag caccccacag aagctgattc ctccgcaacc aacaggccgt ccttcacctg
1201 cacctcctgc tgtcccgcct gctgcctcac ctgtaatgcc accacaaaca cagtccccag
1261 ggcagccagc ccagcctgct ccattggtgc cactgcacca gaagcagagc cgaatcaccc
1321 ccatccagaa gccccgaggc cttgaccctg tggagatcct acaagagcgg gagtacaggc
1381 ttcaggctcg aatcgcacac agaattcagg aacttgaaaa cctccctggg tccctggctg
1441 gggaccttcg aaccaaagca accatcgaac tcaaggccct taggttgctg aacttccaga
1501 ggcagctgcg ccaggaggtg gtggtgtgca tgcgaagaga cacagccctg gagacagccc
1561 tcaatgccaa ggcctacaag cgcagcaaac gtcagtcact acgggaggcc cgcatcactg
1621 agaagttgga gaagcagcag aagattgaac aggagcgcaa gcgccgccag aagcaccagg TABLE 1-continued

```
1681 agtacctcaa cagcattctg cagcatgcca aggacttcag ggagtatcac agatcagtca
1741 caggcaaact ccagaaactc accaaggctg tggccaccta ccatgccaac actgagcggg
1801 agcagaagaa agaaaatgag cgcattgaga aggagcgaat gcggaggctt atggctgaag
1861 atgaggaggg ctaccgcaaa ctcattgacc agaagaagga caagcgcctg gcctaccttc
1921 tgcagcagac agatgagtat gtggccaacc tcacagagct ggtgcggcag cacaaagctg
1981 cccaggttgc caaggagaag aagaagaaaa agaaaaagaa gaaggcagaa aatgctgaag
2041 gacagacacc tgctattgga ccagatggtg agcctctgga tgagaccagc cagatgagtg
2101 acctccctgt gaaggtgatc cacgtggaga gtggcaagat cctcactggc acagatgccc
2161 caaaagccgg gcagctggaa gcctggcttg aaatgaaccc agggtatgaa gtagcccccca
2221 ggtcagacag tgaagaaagt ggctctgaag aggaggagga ggaggaggaa gaggagcagc
2281 ctcagcccgc acagcccccct acactgcctg tggaagaaaa gaagaagatt ccagacccag
2341 acagcgatga tgtctctgag gtggacgccc gacacattat tgagaacgcc aagcaagatg
2401 tggacgatga gtacggtgtg tcccaggccc ttgctcgtgg cctgcagtct tactatgctg
2461 tggcccatgc agtcacagag agagtagata agcagtccgc cctcatggtc aacggtgtcc
2521 tcaaacagta ccagatcaag ggtttggagt ggctggtgtc cctgtacaac aacaacctga
2581 atgggcatcct ggctgatgag atggggctgg ggaagaccat ccagaccatc gcgctcatca
2641 catacctcat ggagcacaag cgcatcaacg ggcctttcct catcatcgtg cctctctcga
2701 cactgtcaaa ctgggcgtat gaatttgaca agtgggcccc ctctgtggtg aaggtttctt
2761 acaagggctc tccagctgca aggcgagctt ttgtcccaca gcttcgcagt gggaagttca
2821 acgtcttact gaccacctat gaatatatca tcaaagacaa gcatatccta gccaagatcc
2881 gctggaagta catgattgtg gatgaaggcc accgcatgaa aaaccaccac tgcaagttga
2941 cgcaggtcct taacacacac tacgtggccc ctcggcgcct gcttcttaca ggcacaccac
3001 tgcagaacaa gctaccggag ctctgggccc tgcttaactt cctgctcccc actatcttca
3061 agagctgcag caccttcgaa cagtggttca atgcaccctt tgccatgact ggagaaaagg
3121 tggacctgaa tgaagaggag actatcctca ttattcgtcg cctacacaaa gttctgcggc
3181 ccttcctgct gcggcggctc aagaaggaag ttgaagccca gctccctgag aaggtagagt
3241 atgtcatcaa atgcgacatg tcagccctgc agcgtgtgct gtaccgtcac atgcaggcca
3301 aggtgtgctg ctgactgac ggctccgaga aggacaagaa gggcaaaggt ggcaccaaga
3361 cactgatgaa cactattatg caactgcgta agatctgcaa ccacccctac atgttccagc
3421 acatcgagga gtccttttct gagcacttgg ggttcaccgg cggcatcgtg caaggattgg
3481 acctttaccg tgcctcaggg aaatttgaac ttcttgatag aattctaccc aaactccgtg
3541 caacgaacca taaagtgctc ctcttttgcc aaatgacctc cctcatgacc atcatggaag
3601 actactttgc ataccgtggc ttcaaatacc tcaggcttga tggaaccaca aaagcagaag
3661 accggggcat gctgttgaaa acctttaatg aacctggctc tgagtatttc attttcctgc
3721 tcagtacccg tgctgggggg ctgggcctga atctgcagtc agctgacact gtgatcatct
3781 ttgacagtga ctggaatccc caccaggacc tgcaagcaca ggatcgagcc catcgcattg
3841 gacagcagaa tgaggtgcgt gttcttcgcc tgtgcacggt caacagtgtg gaagagaaga
3901 tactggctgc tgccaaatac aaactcaatg tggatcagaa ggtgatccag gcaggcatgt
3961 tcgaccagaa gtcgtccagc catgagaggc gtgccttcct gcaggccatc ctggagcacg
4021 aggagcagga tgaggaggaa gatgaggtgc ctgatgatga gaccgtcaac cagatgattg
4081 cccggcacga agaagagttt gacctcttca tgcgcatgga cttggaccgc cggcgtgaag
4141 aagcccgcaa ccccaagcgg aagccacgcc tgatggaaga ggatgagctc ccatcctgga
4201 tcatcaagga tgatgccgag gtggagcggc tgacatgtga agaggaagag gagaagatgt
4261 tcggccgtgg ttctcgccac cgcaaggagg tagactacag cgactcactg acagagaagc
4321 agtggctcaa ggctatcgag gagggcacgc tggaggagat cgaagaggag gtccggcaga
4381 agaaatcttc acgtaagcgt aagcgagaca gcgaggccgg ctcctccacc ccgaccacca
4441 gcacccgcag ccgtgacaag gatgaggaga gcaagaagca gaagaaacgt gggcggccac
4501 ctgctgagaa gctgtcccca aacccaccta acctcaccaa gaagatgaag aagatcgtgg
4561 atgctgtgat caagtacaaa gacagcagca gtggacgtca gctcagcgag gtgttcatcc
4621 agctcccctc tcgcaaggag cttcctgagt actatgagct catccgaaag cctgtggact
4681 tcaagaagat caaggaacgc atccgaaacc acaagtaccg cagcctcaat gacctggaga
4741 aggatgtgat gctgctgtgc cagaacgctc agacgttcaa cctcgagggt tccctgatct
4801 atgaggactc catcgtcctg cagtctgtct tcaccagcgt acggcagaag attgagaagg
4861 aggacgacag tgaaggcgag gaaagcgagg aggaggagga gggcgaggag gaaggctccg
4921 agtctgagtc ccgctccgtc aaggtgaaga tcaagctggg ccgcaaggag aaggcccagg
4981 accgactcaa ggggggccgc cggcggccaa gccggggatc ccgggccaag ccggttgtga
5041 gtgacgatga cagtgaggag gagcaggagg aggaccgctc aggaagtggc agtgaggaag
5101 actgaaccag acattcctga gtcctgaccc cgaggcgctc gtcccagcca agatggagta
5161 gcccttagca gtgatgggta gcaccagatg tagtttcgaa cttggagaac tgtacacatg
5221 caatcttcca cattttagg cagagaagta taggcctgtc tgtcggccct ggcctggcct
5281 cgagtctcta ccagcattaa ctgtctagag aggggacctc ctgggagcac catccacctc
5341 cccaggcccc agtcactgta gctcagtgga tgcatgcgcg tgccggccgc tccttgtact
5401 gtatcttact ggacagggcc agctctccag gaggctcaca ggcccagcgg gtatgtcagt
5461 gtcactggag tcagacagta ataaattaaa gcaatgacaa gccaccactg gctccctgga
5521 ctccttgctg tcagcagtgg ctccggggcc acagagaaga aagaaagact tttaggaact
5581 gggtctaact tatgggcaaa gtacttgcct tgccaggtgt atgggttttg cattcccatc
5641 acccacacac cctaaacaag ccaagtcagt gagcttcaag ttagagcctc cacctcaatg
5701 tgtacgtgga aagcaatcaa agatgatgcc tagcatccac ctctggccct catgtgcaga
5761 tgtacacaca ctgaattaca tacacgggac acacacatcc acacggaggc agtccatgac
5821 ttgcactggg gagatggtac cataggcgaa agtgccacag gcacaggcc aggctaattt
5881 agtcctgcag tcctgtgctc ttaagatgaa ggcacaaaga ggaaccccag gcgctccaac
5941 tagcatgcca ggcagtgaca agaccctgct tcaaatgaat cagagcccac attcagtatt
6001 gccctcttac ccgatgcgat gcccatgccc tcacatatga atgtgtatat atacatacat
6061 acgtaaaata attcttttt aaattataga catttttgtg tgaatgtttt gcctgaatgt
6121 gtgtgtgtgt gtgtgtgtgt gtgtgtgtgt gtgtgtgtgt gtatcaagta cattcctaga
6181 gcctacagag gtcaagggag ggcattggat ctggaactgg agtcacatga ggctgtgagc
6241 aactgtgtgg gttcctgggc ctttgcaaca gcagttagta ctcttcacca ctgagccatt
6301 tctccaatct caaaaagaag cattctttta aatgaagact gaaataaata agtaggactt
6361 gccttgg
```

TABLE 1-continued

SEQ ID NO: 199 Mouse SMARCA4 Amino Acid Sequence isoform 2 (NP_035547.2)
1 mstpdpplgg tprpgpspgp gpspgamlgp spgpspgsah smmgpspgpp saghpmptqg
61 pggypqdnmh qmhkpmesmh ekgmpddpry nqmkgmgmrs gahtgmappp spmdqhsqgy
121 psplggseha sspvpasgps sgpqmssgpg gapldgsdpq algqqnrgpt pfnqnqlhql
181 raqimaykml argqplpdhl qmavqgkrpm pgmqqqmptl pppsysatgp gpgpgpgpgp
241 gpgpappnys rphgmggpnm pppgpsgvpp gmpgqppggp pkpwpegpma naaaptstpq
301 klippqptgr pspappavpp aaspvmppqt qspgqpaqpa plvplhqkqs ritpiqkprg
361 ldpveilger eyrlgariah riqelenlpg slagdlrtka tielkalrll nfqrqlrgev
421 vvcmrrdtal etalnakayk rskrqslrea riteklekqg kieqerkrrq khqeylnsil
481 qhakdfreyh rsvtgklqkl tkavatyhan tereqkkene riekermrrl maedeegyrk
541 lidqkkdkrl ayllqqtdey vanitelvrq hkaaqvakek kkkkkkkkae naegqtpaig
601 pdgepldets qmsdlpvkvi hvesgkiltg tdapkagqle awlemnpgye vaprsdsees
661 gseeeeeeee eeqpqpaqpp tlpveekkki pdpdsddvse vdarhiiena kqdvddeygv
721 sgalarglqs yyavahavte rvdkqsalmv ngvlkqyqik glewlvslyn nnlngilade
781 mglgktiqti alitylmehk ringpfliiv plstlsnway efdkwapsvv kvsykgspaa
841 rrafvpqlrs gkfnvlltty eyiikdkhil akirwkymiv deghrmknhh ckltqvinth
901 yvaprrlllt gtplqnklpe lwallnfllp tifkscstfe qwfnapfamt gekvdlneee
961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcgmtslmt imedyfayrg fkylrldgtt kaedrgmllk
1141 tfnepgseyf ifllstragg lglnlqsadt viifdsdwnp hqdlqaqdra hrigqgnevr
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikddae
1321 verltceeee ekmfgrgsrh rkevdysdsl tekqwlkaie egtleeieee vrqkkssrkr
1381 krdseagsst pttstrsrdk deeskkqkkr grppaeklsp nppnitkkmk kivdavikyk
1441 dsssgrqlse vfiqlpsrke lpeyyelirk pvdfkkiker irnhkyrsln dlekdvmllc
1501 gnagtfnleg sliyedsivl qsvftsvrqk iekeddsege eseeeeegee egsesesrsv
1561 kvkiklgrke kaqdrlkggr rrpsrgsrak pvvsdddsee eqeedrsgsg seed SEQ ID NO: 200 Mouse SMARCA4 cDNA Sequence variant 3 (NM_001174079.1; CDS: 261-5102)
1 ggcaagtgga gcgggtagac agggaggcgg gggcgcgcgg cgggcgcgtg cggtgggggg
61 gggtggcctg gcgaagccca gcgggcgcgc gcgcgaggct ttcccactcg cttggcagcg
121 gcggagacgg cttctttgtt tcctgaggag aagcgagacg cccactctgt ccccgacccc
181 tcgtggaggg ttgggggcgg cgccaggaag gttacggcgc cgttacctcc aggagaccag
241 tgcctgtagc tccagtaaag atgtctactc cagacccacc cttgggtggg actcctcggc
301 ctggtccttc cccaggccct ggtccttcac ctggtgcaat gctgggtcct agccctggcc
361 cctcaccagg ttctgcccac agcatgatgg ggccaagccc aggacctcct tcagcaggac
421 atcccatgcc cacccagggg cctggagggt acccccagga caacatgcat cagatgcaca
481 agcctatgga gtccatgcac gagaagggca tgcctgatga cccacgatac aaccagatga
541 aagggatggg catgcggtca ggggcccaca caggcatggc acctccacct agtcccatgg
601 accagcattc tcaaggttac ccctcacccc tcggcggctc tgaacatgcc tccagtcctg
661 tcccagccag tggcccatct tcaggccccc agatgtcctc tgggccagga ggggccccac
721 tagatggttc tgatccccag gccttgggac agcaaaacag aggcccaacc ccatttaacc
781 agaaccagct gcatcaactc agagctcaga taatggccta caagatgttg gccaggggcc
841 agccattgcc cgaccacctg cagatggccg tgcaaggcaa gcggccgatg cctggaatgc
901 agcaacagat gccaacacta cctccaccct cagtgtccgc cacaggaccc ggacctggac
961 ccggccctgg ccctggccct ggcccaggac cagcccctcc aaattacagt agaccccatg
1021 gtatgggagg gcccaacatg cctcccccag gaccctcagg tgtgcccccc gggatgcctg
1081 gtcagccgcc tggagggcct cccaagccat ggcctgaagg acccatggcc aatgctgctg
1141 cccccacaag caccccacag aagctgattc ctccgcaacc aacaggccgt ccttcacctg
1201 cacctcctgc tgtcccgcct gctgcctcac ctgtaatgcc accacaaaca cagtccccag
1261 ggcagccagc ccagcctgct ccattggtgc cactgcacca gaagcagagc cgaatcaccc
1321 ccatccagaa gccccgaggc cttgaccctg tggagatcct acaagagcgg gagtacaggc
1381 ttcaggctcg aatcgcacac agaattcagg aacttgaaaa cctccctggg tccctggctg
1441 gggaccttcg aaccaaagca accatcgaac tcaaggccct taggttgctg aacttccaga
1501 ggcagctgcg ccaggaggtg gtggtgtgca tgcgaagaga cacagccctg gagacagccc
1561 tcaatgccaa ggcctacaag cgcagcaaac gtcagtcact acgggaggcc cgcatcactg
1621 agaagttgga gaagcagcag aagattgaac aggagcgcaa gcgccgccag aagcaccagg
1681 agtacctcaa cagcattctg cagcatgcca aggacttcag ggagtatcac agatcagtca
1741 caggcaaact ccagaaactc accaaggctg tggccaccta ccatgccaac actgagcggg
1801 agcagaagag agaaaatgag cgcattgaga aggagcgaat gcggaggctt atggctgaag
1861 atgaggaggg ctaccgcaaa ctcattgacc agaagaagga caagcgcctg gcctaccttc
1921 tgcagcagac agatgagtat gtggccaacc tcacagagct ggtgcggcag cacaaagctg
1981 cccaggttgc caaggagaag aagaagaaaa agaaaaagaa gaaggcagaa aatgctgaag
2041 gacagacacc tgctattgga ccagatggtg agcctctgga tgagaccagc cagatgagtg
2101 acctccctgt gaaggtgatc cacgtggaga gtggcaagat cctcactggc acagatgccc
2161 caaaagccgg gcagctggaa gcctggcttg aaatgaaccc agggtatgaa gtagcccccca
2221 ggtcagacag tgaagaaagt ggctctgaag aggaggagga ggaggaggaa gaggagcagc
2281 ctcagcccgc acagccccct acactgcctg tggaagaaaa gaagaagatt ccagacccag
2341 acagcgatga tgtctctgag gtggacgccc gacacattat tgagaacgcc aagcaagatg
2401 tggacgatga gtacggtgtg tcccaggccc ttgctcgtgg cctgcagtct tactatgctg
2461 tggcccatgc agtcacagag agagtagata agcagtccgc cctcatggtc aacggtgtcc
2521 tcaaacagta ccagatcaag ggtttggagt ggctggtgtc cctgtacaac aacaacctga
2581 atggcatcct ggctgatgag atggggctgg ggaagaccat ccagaccatc gcgctcatca
2641 catacctcat ggagcacaag cgcatcaacg ggcctttcct catcatcgtg cctctctcga
2701 cactgtcaaa ctgggcgtat gaatttgaca agtgggcccc ctctgtggtg aaggtttctt
2761 acaagggctc tccagctgca aggcgagctt ttgtcccaca gcttcgcagt gggaagttca
2821 acgtcttact gaccacctat gaatatatca tcaaagacaa gcatatccta gccaagatcc
2881 gctggaagta catgattgtg gatgaaggcc accgcatgaa aaaccaccac tgcaagttga TABLE 1-continued 2941 cgcaggtcct taacacacac tacgtggccc ctcggcgcct gcttcttaca ggcacaccac
3001 tgcagaacaa gctaccggag ctctgggccc tgcttaactt cctgctcccc actatcttca
3061 agagctgcag caccttcgaa cagtggttca atgcaccctt tgccatgact ggagaaaagg
3121 tggacctgaa tgaagaggag actatcctca ttattcgtcg cctacacaaa gttctgcggc
3181 ccttcctgct gcggcggctc aagaaggaag ttgaagccca gctccctgag aaggtagagt
3241 atgtcatcaa atgcgacatg tcagccctgc agcgtgtgct gtaccgtcac atgcaggcca
3301 aaggtgtgct gctgactgac ggctccgaga aggacaagaa gggcaaaggt ggcaccaaga
3361 cactgatgaa cactattatg caactgcgta agatctgcaa ccacccctac atgttccagc
3421 acatcgagga gtccttttct gagcacttgg ggttcaccgg cggcatcgtg caaggattgg
3481 acctttaccg tgcctcaggg aaatttgaac ttcttgatag aattctaccc aaactccgtg
3541 caacgaacca taaagtgctc ctcttttgcc aaatgacctc cctcatgacc atcatggaag
3601 actactttgc ataccgtggc ttcaaatacc tcaggcttga tggaaccaca aaagcagaag
3661 accggggcat gctgttgaaa acctttaatg aacctggctc tgagtatttc attttcctgc
3721 tcagtacccg tgctgggggg ctgggcctga atctgcagtc agctgacact gtgatcatct
3781 ttgacagtga ctggaatccc caccaggacc tgcaagcaca ggatcgagcc catcgcattg
3841 gacagcagaa tgaggtgcgt gttcttcgcc tgtgcacggt caacagtgtg gaagagaaga
3901 tactggctgc tgccaaatac aaactcaatg tggatcagaa ggtgatccag gcaggcatgt
3961 tcgaccagaa gtcgtccagc catgagaggc gtgccttcct gcaggccatc ctggagcacg
4021 aggagcagga tgaggaggaa gatgaggtgc ctgatgatga gaccgtcaac cagatgattg
4081 cccggcacga agaagagttt gacctcttca tgcgcatgga cttggaccgc cggcgtgaag
4141 aagcccgcaa ccccaagcgg aagccacgcc tgatggaaga ggatgagctc ccatcctgga
4201 tcatcaagga tgatgccgag gtggagcggc tgacatgtga agaggaagag gagaagatgt
4261 tcggccgtgg ttctcgccac cgcaaggagg tagactacag cgactcactg acagagaagc
4321 agtggctcaa ggctatcgag gagggcacgc tggaggagat cgaagaggag gtccggcaga
4381 agaaatcttc acgtaagcgt aagcgagaca gcgaggccgg ctcctccacc ccgaccacca
4441 gcacccgcag ccgtgacaag gatgaggaga gcaagaagca gaagaaacgt gggcggccac
4501 ctgctgagaa gctgtcccca aacccaccta acctcaccaa gaagatgaag aagatcgtgg
4561 atgctgtgat caagtacaaa gacagcagtg gacgtcagct cagcgaggtg ttcatccagc
4621 tcccctctcg caaggagctt cctgagtact atgagctcat ccgaaagcct gtggacttca
4681 agaagatcaa ggaacgcatc cgaaaccaca agtaccgcag cctcaatgac ctggagaagg
4741 atgtgatgct gctgtgccag aacgctcaga cgttcaacct cgagggttcc ctgatctatg
4801 aggactccat cgtcctgcag tctgtcttca ccagcgtacg gcagaagatt gagaaggagg
4861 acgacagtga aggcgaggaa agcgaggagg aggaggaggg cgaggaggaa ggctccgagt
4921 ctgagtcccg ctccgtcaag gtgaagatca agctgggccg caaggagaag gcccaggacc
4981 gactcaaggg gggccgccgg cggccaagcc ggggatcccg ggccaagccg gttgtgagtg
5041 acgatgacag tgaggaggaa caggaggagg accgctcagg aagtggcagt gaggaagact
5101 gaaccagaca ttcctgagtc ctgaccccga ggcgctcgtc ccagccaaga tggagtagcc
5161 cttagcagtg atgggtagca ccagatgtag tttcgaactt ggagaactgt acacatgcaa
5221 tcttccacat ttttaggcag agaagtatag gcctgtctgt cggccctggc ctggcctcga
5281 gtctctacca gcattaactg tctagagagg ggacctcctg ggagcaccat ccacctcccc
5341 aggccccagt cactgtagct cagtggatgc atgcgcgtgc cggccgctcc ttgtactgta
5401 tcttactgga cagggccagc tctccaggag gctcacaggc ccagcgggta tgtcagtgtc
5461 actggagtca gacagtaata aattaaagca atgacaagcc accactggct ccctggactc
5521 cttgctgtca gcagtggctc cggggccaca gagaagaaag aaagactttt aggaactggg
5581 tctaacttat gggcaaagta cttgccttgc caggtgtatg ggttttgcat tcccatcacc
5641 cacacaccct aaacaagcca agtcagtgag cttcaagtta gagcctccac ctcaatgtgt
5701 acgtggaaag caatcaaaga tgatgcctag catccacctc tggccctcat gtgcagatgt
5761 acacacactg aattacatac acgggacaca cacatccaca cggaggcagt ccatgacttg
5821 cactggggag atggtaccat aggcgaaagt gccacaggca cagggccagg ctaatttagt
5881 cctgcagtcc tgtgctctta agatgaaggc acaaagagga accccaggcg ctccaactag
5941 catgccaggc agtgacaaga ccctgcttca aatgaatcag agcccacatt cagtattgcc
6001 ctcttacccg atgcgatgcc catgccctca catatgaatg tgtatatata catacatacg
6061 taaaataatt cttttttaaa ttatagacat ttttgtgtga atgttttgcc tgaatgtgtg
6121 tgtgtgtgtg tgtgtgtgtg tgtgtgtgtg tgtgtgtgta tcaagtacat tcctagagcc
6181 tacagaggtc aagggagggc attggatctg gaactggagt cacatgaggc tgtgagcaac
6241 tgtgtgggtt cctgggcctt tgcaacagca gttagtactc ttcaccactg agccatttct
6301 ccaatctcaa aaagaagcat tcttttaaat gaagactgaa ataaataagt aggacttgcc
6361 ttgg SEQ ID NO: 201 Mouse SMARCA4 Amino Acid Sequence isoform 3 (NP_001167550.1)

1 mstpdpplgg tprpgpspgp gpspgamlgp spgpspgsah smmgpspgpp saghpmptqg
61 pggypqdnmh qmhkpmesmh ekgmpddpry nqmkgmgmrs gahtgmappp spmdqhsqgy
121 psplggseha sspvpasgps sgpqmssgpg gapldgsdpq algqqnrgpt pfnqnqlhql
181 raqimaykml argqplpdhl qmavqgkrpm pgmqqqmptl pppsysatgp gpgpgpgpgp
241 gpgpappnys rphgmggpnm pppgpsgvpp gmpgqppggp pkpwpegpma naaaptstpq
301 klippqptgr pspappavpp aaspvmppqt gspggpagpa plvplhqkqs ritpiqkprg
361 ldpveilqer eyrlgariah rigelenlpg slagdlrtka tielkalrll nfqrqlrgev
421 vvcmrrdtal etalnakayk rskrqslrea ritekleckqg kiegerkrrq khqeylnsil
481 qhakdfreyh rsvtgklqkl tkavatyhan tereqkkene riekermrrl maedeegyrk
541 lidqkkdkrl ayllqqtdey vanitelvrq hkaaqvakek kkkkkkkkae naegqtpaig
601 pdgepldets qmsdlpvkvi hvesgkiltg tdapkagqle awlemnpgye vaprsdsees
661 gseeeeeeee eeqpqpaqpp tlpveekkki pdpdsddvse vdarhiiena kqdvddeygv
721 sqalarglqs yyavahavte rvdkqsalmv ngvlkqyqik glewlvslyn nnlngilade
781 mglgktiqti alitylmehk ringpfliiv plstlsnway efdkwapsvv kvsykgspaa
841 rrafvpqlrs gkfnvlltty eyiikdkhil akirwkymiv deghrmknhh ckltqvinth
901 yvaprrlllt gtplqnklpe lwallnfllp tifkscstfe qwfnapfamt gekvdlneee
961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcgmtslmt imedyfayrg fkylrldgtt kaedrgmllk
1141 tfnepgseyf ifllstragg lglnlqsadt viifdsdwnp hqdlqaqdra hrigqgnevr TABLE 1-continued

```
1201 vlrlctvnsv eekilaaaky klnvdqkviq agmfdqksss herraflqai leheeqdeee
1261 devpddetvn qmiarheeef dlfmrmdldr rreearnpkr kprlmeedel pswiikddae
1321 verltceeee ekmfgrgsrh rkevdysdsl tekqwlkaie egtleeieee vrqkkssrkr
1381 krdseagsst pttstrsrdk deeskkqkkr grppaeklsp nppnitkkmk kivdavikyk
1441 dssgrqlsev fiqlpsrkel peyyelirkp vdfkkikeri rnhkyrslnd lekdvmllcq
1501 naqtfnlegs liyedsivlq svftsvrqki ekeddsegee seeeeegeee gsesesrsvk
1561 vkiklgrkek aqdrlkggrr rpsrgsrakp vvsdddseee qeedrsgsgs eed
```

SEQ ID NO: 202 Mouse SMARCA4 cDNA Sequence variant 4 (NM_001357764.1; CDS: 261-5204)

```
   1 ggcaagtgga gcgggtagac agggaggcgg gggcgcgcgg cgggcgcgtg cggtgggggg
  61 gggtggcctg gcgaagccca gcgggcgcgc gcgcgaggct ttcccactcg cttggcagcg
 121 gcggagacgg cttctttgtt tcctgaggag aagcgagacg cccactctgt ccccgacccc
 181 tcgtggaggg ttgggggcgg cgccaggaag gttacggcgc cgttacctcc aggagaccag
 241 tgcctgtagc tccagtaaag atgtctactc cagacccacc cttgggtggg actcctcggc
 301 ctggtccttc cccaggccct ggtccttcac ctggtgcaat gctgggtcct agccctggcc
 361 cctcaccagg ttctgcccac agcatgatgg ggccaagccc aggacctcct tcagcaggac
 421 atcccatgcc cacccagggg cctggagggt acccccagga caacatgcat cagatgcaca
 481 agcctatgga gtccatgcac gagaagggca tgcctgatga cccacgatac aaccagatga
 541 aagggatggg catgcggtca ggggcccaca caggcatggc acctccacct agtcccatgg
 601 accagcattc tcaaggttac ccctcacccc tcggcggctc tgaacatgcc tccagtcctg
 661 tcccagccag tggcccatct tcaggccccc agatgtcctc tgggccagga ggggccccac
 721 tagatggttc tgatccccag gccttgggac agcaaaacag aggcccaacc ccatttaacc
 781 agaaccagct gcatcaactc agagctcaga taatggccta caagatgttg gccaggggcc
 841 agccattgcc cgaccacctg cagatggccg tgcaaggcaa gcggccgatg cctggaatgc
 901 agcaacagat gccaacacta cctccaccct cagtgtccgc cacaggaccc ggacctggac
 961 ccggccctgg ccctggccct ggcccaggac cagcccctcc aaattacagt agaccccatg
1021 gtatgggagg gcccaacatg cctcccccag gaccctcagg tgtgcccccc gggatgcctg
1081 gtcagccgcc tggagggcct cccaagccat ggcctgaagg acccatggcc aatgctgctg
1141 cccccacaag caccccacag aagctgattc ctccgcaacc aacaggccgt ccttcacctg
1201 cacctcctgc tgtcccgcct gctgcctcac ctgtaatgcc accacaaaca cagtccccag
1261 ggcagccagc ccagcctgct ccattggtgc cactgcacca gaagcagagc cgaatcaccc
1321 ccatccagaa gccccgaggc cttgaccctg tggagatcct acaagagcgg gagtacaggc
1381 ttcaggctcg aatcgcacac agaattcagg aacttgaaaa cctccctggg tccctggctg
1441 gggaccttcg aaccaaagca accatcgaac tcaaggccct taggttgctg aacttccaga
1501 ggcagctgcg ccaggaggtg gtggtgtgca tgcgaagaga cacagccctg gagacagccc
1561 tcaatgccaa ggcctacaag cgcagcaaac gtcagtcact acgggaggcc cgcatcactg
1621 agaagttgga gaagcagcag aagattgaac aggagcgcaa gcgccgccag aagcaccagg
1681 agtacctcaa cagcattctg cagcatgcca aggacttcag ggagtatcac agatcagtca
1741 caggcaaact ccagaaactc accaaggctg tggccaccta ccatgccaac actgagcggg
1801 agcagaagaa agaaaatgag cgcattgaga aggagcgaat gcggaggctt atggctgaag
1861 atgaggaggg ctaccgcaaa ctcattgacc agaagaagga caagcgcctg gcctaccttc
1921 tgcagcagac agatgagtat gtggccaacc tcacagagct ggtgcggcag cacaaagctg
1981 cccaggttgc caaggagaag aagaagaaaa agaaaaagaa gaaggcagaa aatgctgaag
2041 gacagacacc tgctattgga ccagatggtg agcctctgga tgagaccagc cagatgagtg
2101 acctccctgt gaaggtgatc cacgtggaga gtggcaagat cctcactggc acagatgccc
2161 caaaagccgg gcagctggaa gcctggcttg aaatgaaccc agggtatgaa gtagccccca
2221 ggtcagacag tgaagaaagt ggctctgaag aggaggagga ggaggaggaa gaggagcagc
2281 ctcagcccgc acagccccct acactgcctg tggaagaaaa gaagaagatt ccagacccag
2341 acagcgatga tgtctctgag gtggacgccc gacacattat tgagaacgcc aagcaagatg
2401 tggacgatga gtacggtgtg tcccaggccc ttgctcgtgg cctgcagtct tactatgctg
2461 tggcccatgc agtcacagag agagtagata agcagtccgc cctcatggtc aacggtgtcc
2521 tcaaacagta ccagatcaag ggtttggagt ggctggtgtc cctgtacaac aacaacctga
2581 atggcatcct ggctgatgag atggggctgg ggaagaccat ccagaccatc gcgctcatca
2641 catacctcat ggagcacaag cgcatcaacg ggcctttcct catcatcgtg cctctctcga
2701 cactgtcaaa ctgggcgtat gaatttgaca agtgggcccc ctctgtggtg aaggtttctt
2761 acaagggctc tccagctgca aggcgagctt ttgtcccaca gcttcgcagt gggaagttca
2821 acgtcttact gaccacctat gaatatatca tcaaagacaa gcatatccta gccaagatcc
2881 gctggaagta catgattgtg gatgaaggcc accgcatgaa aaaccaccac tgcaagttga
2941 cgcaggtcct taacacacac tacgtggccc ctcggcgcct gcttcttaca ggcacaccac
3001 tgcagaacaa gctaccggag ctctgggccc tgcttaactt cctgctcccc actatcttca
3061 agagctgcag caccttcgaa cagtggttca atgcaccctt tgccatgact ggagaaaagg
3121 tggacctgaa tgaagaggag actatcctca ttattcgtcg cctacacaaa gttctgcggc
3181 ccttcctgct gcggcggctc aagaaggaag ttgaagccca gctccctgag aaggtagagt
3241 atgtcatcaa atgcgacatg tcagccctgc agcgtgtgct gtaccgtcac atgcaggcca
3301 aaggtgtgct gctgactgac ggctccgaga aggacaagaa gggcaaaggt ggcaccaaga
3361 cactgatgaa cactattatg caactgcgta agatctgcaa ccacccctac atgttccagc
3421 acatcgagga gtccttttct gagcacttgg ggttcaccgg cggcatcgtg caaggattgg
3481 acctttaccg tgcctcaggg aaatttgaac ttcttgatag aattctaccc aaactccgtg
3541 caacgaacca taaagtgctc ctcttttgcc aaatgacctc cctcatgacc atcatggaag
3601 actactttgc ataccgtggc ttcaaatacc tcaggcttga tggaaccaca aaagcagaag
3661 accggggcat gctgttgaaa acctttaatg aacctggctc tgagtatttc attttcctgc
3721 tcagtacccg tgctgggggg ctgggcctga atctgcagtc agctgacact gtgatcatct
3781 ttgacagtga ctggaatccc caccaggacc tgcaagcaca ggatcgagcc catcgcattg
3841 gacagcagaa tgaggtgcgt gttcttcgcc tgtgcacggt caacagtgtg gaagagaaga
3901 tactggctgc tgccaaatac aaactcaatg tggatcagaa ggtgatccag gcaggcatgt
3961 tcgaccagaa gtcgtccagc catgagaggc gtgccttcct gcaggccatc ctggagcacg
4021 aggagcagga tgagagcaga cactgcagca cgggcagcgg cagtgccagc ttcgcccaca
4081 ctgcccctcc gccagcgggc gtcaaccccg acttggagga gccacctcta aaggaggaag
4141 atgaggtgcc tgatgatgag accgtcaacc agatgattgc ccggcacgaa gaagagtttg
```

TABLE 1-continued 4201 acctcttcat gcgcatggac ttggaccgcc ggcgtgaaga agcccgcaac cccaagcgga
4261 agccacgcct gatggaagag gatgagctcc catcctggat catcaaggat gatgccgagg
4321 tggagcggct gacatgtgaa gaggaagagg agaagatgtt cggccgtggt tctcgccacc
4381 gcaaggaggt agactacagc gactcactga cagagaagca gtggctcaag gctatcgagg
4441 agggcacgct ggaggagatc gaagaggagg tccggcagaa gaaatcttca cgtaagcgta
4501 agcgagacag cgaggccggc tcctccaccc cgaccaccag cacccgcagc cgtgacaagg
4561 atgaggagag caagaagcag aagaaacgtg ggcggccacc tgctgagaag ctgtccccaa
4621 acccacctaa cctcaccaag aagatgaaga agatcgtgga tgctgtgatc aagtacaaag
4681 acagcagcag tggacgtcag ctcagcgagg tgttcatcca gctccccctct cgcaaggagc
4741 ttcctgagta ctatgagctc atccgaaagc ctgtggactt caagaagatc aaggaacgca
4801 tccgaaacca caagtaccgc agcctcaatg acctggagaa ggatgtgatg ctgctgtgcc
4861 agaacgctca gacgttcaac ctcgagggtt ccctgatcta tgaggactcc atcgtcctgc
4921 agtctgtctt caccagcgta cggcagaaga ttgagaagga ggacgacagt gaaggcgagg
4981 aaagcgagga ggaggaggag ggcgaggagg aaggctccga gtctgagtcc cgctccgtca
5041 aggtgaagat caagctgggc cgcaaggaga aggcccagga ccgactcaag gggggccgcc
5101 ggcggccaag ccggggatcc cgggccaagc cggttgtgag tgacgatgac agtgaggagg
5161 agcaggagga ggaccgctca ggaagtggca gtgaggaaga ctgaaccaga cattcctgag
5221 tcctgacccc gaggcgctcg tcccagccaa gatggagtag cccttagcag tgatgggtag
5281 caccagatgt agtttcgaac ttggagaact gtacacatgc aatcttccac atttttaggc
5341 agagaagtat aggcctgtct gtcggccctg gcctggcctc gagtctctac cagcattaac
5401 tgtctagaga ggggacctcc tgggagcacc atccacctcc ccaggcccca gtcactgtag
5461 ctcagtggat gcatgcgcgt gccggccgct ccttgtactg tatcttactg gacagggcca
5521 gctctccagg aggctcacag gcccagcggg tatgtcagtg tcactggagt cagacagtaa
5581 taaattaaag caatgacaag ccaccactgg ctccctggac tccttgctgt cagcagtggc
5641 tccggggcca cagagaagaa agaaagactt ttaggaactg ggtctaactt atgggcaaag
5701 tacttgcctt gccaggtgta tgggttttgc attcccatca cccacacacc ctaaacaagc
5761 caagtcagtg agcttcaagt tagagcctcc acctcaatgt gtacgtggaa agcaatcaaa
5821 gatgatgcct agcatccacc tctggccctc atgtgcagat gtacacacac tgaattacat
5881 acacgggaca cacacatcca cacggaggca gtccatgact tgcactgggg agatggtacc
5941 ataggcgaaa gtgccacagg cacagggcca ggctaattta gtcctgcagt cctgtgctct
6001 taagatgaag gcacaaagag gaaccccagg cgctccaact agcatgccag gcagtgacaa
6061 gaccctgctt caaatgaatc agagcccaca ttcagtattg ccctcttacc cgatgcgatg
6121 cccatgccct cacatatgaa tgtgtatata tacatacata cgtaaaataa ttcttttttta
6181 aattatagac atttttgtgt gaatgttttg cctgaatgtg tgtgtgtgtg tgtgtgtgtg
6241 tgtgtgtgtg tgtgtgtgtg tatcaagtac attcctagag cctacagagg tcaagggagg
6301 gcattggatc tggaactgga gtcacatgag gctgtgagca actgtgtggg ttcctgggcc
6361 tttgcaacag cagttagtac tcttcaccac tgagccattt ctccaatctc aaaaagaagc
6421 attcttttaa atgaagactg aaataaataa gtaggacttg ccttgg SEQ ID NO: 203 Mouse SMARCA4 Amino Acid Sequence isoform 4 (NP_001344693.1)
1 mstpdpplgg tprpgpspgp gpspgamlgp spgpspgsah smmgpspgpp saghpmptqg
61 pggypqdnmh qmhkpmesmh ekgmpddpry nqmkgmgmrs gahtgmappp spmdqhsqgy
121 psplggseha sspvpasgps sgpqmssgpg gapldgsdpq algqqnrgpt pfnqnqlhql
181 raqimaykml argqplpdhl qmavqgkrpm pgmqqqmptl pppsysatgp gpgpgpgpgp
241 gpgpappnys rphgmggpnm pppgpsgvpp gmpgqppggp pkpwpegpma naaaptstpq
301 klippqptgr pspappavpp aaspvmppqt gspggpagpa plvplhqkqs ritpiqkprg
361 ldpveilqer eyrlqariah riqelenlpg slagdlrtka tielkalrll nfqrqlrgev
421 vvcmrrdtal etalnakayk rskrqslrea riteklekqq kiegerkrrq khqeylnsil
481 qhakdfreyh rsvtgklqkl tkavatyhan tereqkkene riekermrrl maedeegyrk
541 lidqkkdkrl ayllqqtdey vanitelvrq hkaaqvakek kkkkkkkkae naegqtpaig
601 pdgepldets qmsdlpvkvi hvesgkiltg tdapkagqle awlemnpgye vaprsdsees
661 gseeeeeeee eeqpqpaqpp tlpveekkki pdpdsddvse vdarhiiena kqdvddeygv
721 sqalarglqs yyavahavte rvdkqsalmv ngvlkqyqik glewlvslyn nnlngilade
781 mglgktiqti alitylmehk ringpfliiv plstlsnway efdkwapsvv kvsykgspaa
841 rrafvpqlrs gkfnvlltty eyiikdkhil akirwkymiv deghrmknhh ckltqvinth
901 yvaprrlllt gtplqnklpe lwallnfllp tifkscstfe qwfnapfamt gekvdlneee
961 tiliirrlhk vlrpfllrrl kkeveaqlpe kveyvikcdm salqrvlyrh mqakgvlltd
1021 gsekdkkgkg gtktlmntim qlrkicnhpy mfqhieesfs ehlgftggiv qgldlyrasg
1081 kfelldrilp klratnhkvl lfcgmtslmt imedyfayrg fkylrldgtt kaedrgmllk
1141 tfnepgseyf ifllstragg lglnlqsadt viifdsdwnp hqdlqaqdra hrigqqnevr
1201 vlrlctvnsv eekilaaaky klnvdqkviq agmfdqksss herraflqai leheeqdesr
1261 hcstgsgsas fahtapppag vnpdleeppl keedevpdde tvnqmiarhe eefdlfmrmd
1321 ldrrreearn pkrkprlmee delpswiikd daeverltce eeeekmfgrg srhrkevdys
1381 dsltekqwlk aieegtleei eeevrqkkss rkrkrdseag sstpttstrs rdkdeeskkq
1441 kkrgrppaek lspnppnitk kmkkivdavi kykdsssgrq lsevfiqlps rkelpeyyel
1501 irkpvdfkki kerirnhkyr slndlekdvm llcgnaqtfn legsliyeds ivlqsvftsv
1561 rqkiekedds egeeseeeee geeegseses rsvkvkiklg rkekaqdrlk ggrrrpsrgs
1621 rakpvvsddd seeeqeedrs gsgseed SEQ ID NO: 204 Mouse SMARCA4 cDNA Sequence variant 1 (NM_001174078.1; 261-5114)
1 ggcaagtgga gcgggtagac agggaggcgg gggcgcgcgg cgggcgcgtg cggtgggggg
61 gggtggcctg gcgaagccca gcgggcgcgc gcgcgaggct ttcccactcg cttggcagcg
121 gcggagacgg cttctttgtt tcctgaggag aagcgagacg cccactctgt ccccgacccc
181 tcgtggaggg ttgggggcgg cgccaggaag gttacggcgc cgttacctcc aggagaccag
241 tgcctgtagc tccagtaaag atgtctactc cagacccacc cttgggtggg actcctcggc
301 ctggtccttc cccaggccct ggtccttcac ctggtgcaat gctgggtcct agccctggcc
361 cctcaccagg ttctgcccac agcatgatgg ggccaagccc aggacctcct tcagcaggac
421 atcccatgcc cacccagggg cctggagggt acccccagga caacatgcat cagatgcaca
481 agcctatgga gtccatgcac gagaagggca tgcctgatga cccacgatac aaccagatga TABLE 1-continued 541 aagggatggg catgcggtca ggggcccaca caggcatggc acctccacct agtcccatgg
601 accagcattc tcaaggttac ccctcacccc tcggcggctc tgaacatgcc tccagtcctg
661 tcccagccag tggcccatct tcaggccccc agatgtcctc tgggccagga ggggccccac
721 tagatggttc tgatccccag gccttgggac agcaaaacag aggcccaacc ccatttaacc
781 agaaccagct gcatcaactc agagctcaga taatggccta caagatgttg gccaggggcc
841 agccattgcc cgaccacctg cagatggccg tgcaaggcaa gcggccgatg cctggaatgc
901 agcaacagat gccaacacta cctccaccct cagtgtccgc cacaggaccc ggacctggac
961 ccggccctgg ccctggccct ggcccaggac cagcccctcc aaattacagt agaccccatg
1021 gtatgggagg gcccaacatg cctcccccag gaccctcagg tgtgcccccc gggatgcctg
1081 gtcagccgcc tggagggcct cccaagccat ggcctgaagg acccatggcc aatgctgctg
1141 cccccacaag caccccacag aagctgattc ctccgcaacc aacaggccgt ccttcacctg
1201 cacctcctgc tgtcccgcct gctgcctcac ctgtaatgcc accacaaaca cagtccccag
1261 ggcagccagc ccagcctgct ccattggtgc cactgcacca gaagcagagc cgaatcaccc
1321 ccatccagaa gccccgaggc cttgaccctg tggagatcct acaagagcgg gagtacaggc
1381 ttcaggctcg aatcgcacac agaattcagg aacttgaaaa cctccctggg tccctggctg
1441 gggaccttcg aaccaaagca accatcgaac tcaaggccct taggttgctg aacttccaga
1501 ggcagctgcg ccaggaggtg gtggtgtgca tgcgaagaga cacagccctg gagacagccc
1561 tcaatgccaa ggcctacaag cgcagcaaac gtcagtcact acgggaggcc cgcatcactg
1621 agaagttgga gaagcagcag aagattgaac aggagcgcaa gcgccgccag aagcaccagg
1681 agtacctcaa cagcattctg cagcatgcca aggacttcag ggagtatcac agatcagtca
1741 caggcaaact ccagaaactc accaaggctg tggccaccta ccatgccaac actgagcggg
1801 agcagaagaa agaaaatgag cgcattgaga aggagcgaat gcggaggctt atggctgaag
1861 atgaggaggg ctaccgcaaa ctcattgacc agaagaagga caagcgcctg gcctaccttc
1921 tgcagcagac agatgagtat gtggccaacc tcacagagct ggtgcggcag cacaaagctg
1981 cccaggttgc caaggagaag aagaagaaaa agaaaaagaa gaaggcagaa aatgctgaag
2041 gacagacacc tgctattgga ccagatggtg agcctctgga tgagaccagc cagatgagtg
2101 acctccctgt gaaggtgatc cacgtggaga gtggcaagat cctcactggc acagatgccc
2161 caaaagccgg gcagctggaa gcctggcttg aaatgaaccc agggtatgaa gtagccccca
2221 ggtcagacag tgaagaaagt ggctctgaag aggaggagga ggaggaggaa gaggagcagc
2281 ctcagcccgc acagcccccct acactgcctg tggaagaaaa gaagaagatt ccagacccag
2341 acagcgatga tgtctctgag gtggacgccc gacacattat tgagaacgcc aagcaagatg
2401 tggacgatga gtacggtgtg tcccaggccc ttgctcgtgg cctgcagtct tactatgctg
2461 tggcccatgc agtcacagag agagtagata agcagtccgc cctcatggtc aacggtgtcc
2521 tcaaacagta ccagatcaag ggtttggagt ggctggtgtc cctgtacaac aacaacctga
2581 atggcatcct ggctgatgag atggggctgg ggaagaccat ccagaccatc gcgctcatca
2641 catacctcat ggagcacaag cgcatcaacg ggcctttcct catcatcgtg cctctctcga
2701 cactgtcaaa ctgggcgtat gaatttgaca agtgggcccc ctctgtggtg aaggtttctt
2761 acaagggctc tccagctgca aggcgagctt ttgtcccaca gcttcgcagt gggaagttca
2821 acgtcttact gaccacctat gaatatatca tcaaagacaa gcatatccta gccaagatcc
2881 gctggaagta catgattgtg gatgaaggcc accgcatgaa aaaccaccac tgcaagttga
2941 cgcaggtcct taacacacac tacgtggccc ctcggcgcct gcttcttaca ggcacaccac
3001 tgcagaacaa gctaccggag ctctgggccc tgcttaactt cctgctcccc actatcttca
3061 agagctgcag caccttcgaa cagtggttca atgcaccctt tgccatgact ggagaaaagg
3121 tggacctgaa tgaagaggag actatcctca ttattcgtcg cctacacaaa gttctgcggc
3181 ccttcctgct gcggcggctc aagaaggaag ttgaagccca gctccctgag aaggtagagt
3241 atgtcatcaa atgcgacatg tcagccctgc agcgtgtgct gtaccgtcac atgcaggcca
3301 aaggtgtgct gctgactgac ggctccgaga aggacaagaa gggcaaaggt ggcaccaaga
3361 cactgatgaa cactattatg caactgcgta agatctgcaa ccacccctac atgttccagc
3421 acatcgagga gtccttttct gagcacttgg ggttcaccgg cggcatcgtg caaggattgg
3481 acctttaccg tgcctcaggg aaatttgaac ttcttgatag aattctaccc aaactccgtg
3541 caacgaacca taaagtgctc ctcttttgcc aaatgacctc cctcatgacc atcatggaag
3601 actactttgc ataccgtggc ttcaaatacc tcaggcttga tggaaccaca aaagcagaag
3661 accggggcat gctgttgaaa acctttaatg aacctggctc tgagtatttc attttcctgc
3721 tcagtacccg tgctgggggg ctgggcctga atctgcagtc agctgacact gtgatcatct
3781 ttgacagtga ctggaatccc caccaggacc tgcaagcaca ggatcgagcc catcgcattg
3841 gacagcagaa tgaggtgcgt gttcttcgcc tgtgcacggt caacagtgtg gaagagaaga
3901 tactggctgc tgccaaatac aaactcaatg tggatcagaa ggtgatccag gcaggcatgt
3961 tcgaccagaa gtcgtccagc catgagaggc gtgccttcct gcaggccatc ctggagcacg
4021 aggagcagga tgaggaggaa gatgaggtgc ctgatgatga gaccgtcaac cagatgattg
4081 cccggcacga agaagagttt gacctcttca tgcgcatgga cttggaccgc cggcgtgaag
4141 aagcccgcaa ccccaagcgg aagccacgcc tgatggaaga ggatgagctc ccatcctgga
4201 tcatcaagga tgatgccgag gtggagcggc tgacatgtga agaggaagag gagaagatgt
4261 tcggccgtgg ttctcgccac cgcaaggagg tagactacag cgactcactg acagagaagc
4321 agtggctcaa gaccctgaag gctatcgagg agggcacgct ggaggagatc gaagaggagg
4381 tccggcagaa gaaatcttca cgtaagcgta agcgagacag cgaggccggc tcctccaccc
4441 cgaccaccag cacccgcagc cgtgacaagg atgaggagag caagaagcag aagaaacgtg
4501 ggcggccacc tgctgagaag ctgtccccaa acccacctaa cctcaccaag aagatgaaga
4561 agatcgtgga tgctgtgatc aagtacaaag acagcagcag tggacgtcag ctcagcgagg
4621 tgttcatcca gctcccctct cgcaaggagc ttcctgagta ctatgagctc atccgaaagc
4681 ctgtggactt caagaagatc aaggaacgca tccgaaacca caagtaccgc agcctcaatg
4741 acctggagaa ggatgtgatg ctgctgtgcc agaacgctca gacgttcaac ctcgagggtt
4801 ccctgatcta tgaggactcc atcgtcctgc agtctgtctt caccagcgta cggcagaaga
4861 ttgagaagga ggacgacagt gaaggcgagg aaagcgagga ggaggaggag ggcgaggagg
4921 aaggctccga gtctgagtcc cgctccgtca aggtgaagat caagctgggc cgcaaggaga
4981 aggcccagga ccgactcaag gggggccgcc ggcggccaag ccggggatcc cgggccaagc
5041 cggttgtgag tgacgatgac agtgaggagg agcaggagga ggaccgctca ggaagtggca
5101 gtgaggaaga ctgaaccaga cattcctgag tcctgacccc gaggcgctcg tcccagccaa
5161 gatggagtag cccttagcag tgatgggtag caccagatgt agtttcgaac ttggagaact
5221 gtacacatgc aatcttccac atttttaggc agagaagtat aggcctgtct gtcggccctg
5281 gcctggcctc gagtctctac cagcattaac tgtctagaga ggggacctcc tgggagcacc TABLE 1-continued

```
5341 atccacctcc ccaggcccca gtcactgtag ctcagtggat gcatgcgcgt gccggccgct
5401 ccttgtactg tatcttactg gacagggcca gctctccagg aggctcacag gcccagcggg
5461 tatgtcagtg tcactggagt cagacagtaa taaattaaag caatgacaag ccaccactgg
5521 ctccctggac tccttgctgt cagcagtggc tccggggcca cagagaagaa agaaagactt
5581 ttaggaactg ggtctaactt atgggcaaag tacttgcctt gccaggtgta tgggttttgc
5641 attcccatca cccacacacc ctaaacaagc caagtcagtg agcttcaagt tagagcctcc
5701 acctcaatgt gtacgtggaa agcaatcaaa gatgatgcct agcatccacc tctggccctc
5761 atgtgcagat gtacacacac tgaattacat acacgggaca cacacatcca cacggaggca
5821 gtccatgact tgcactgggg agatggtacc ataggcgaaa gtgccacagg cacagggcca
5881 ggctaattta gtcctgcagt cctgtgctct taagatgaag gcacaaagag gaaccccagg
5941 cgctccaact agcatgccag gcagtgacaa gaccctgctt caaatgaatc agagcccaca
6001 ttcagtattg ccctcttacc cgatgcgatg cccatgccct cacatatgaa tgtgtatata
6061 tacatacata cgtaaaataa ttcttttttta aattatagac atttttgtgt gaatgttttg
6121 cctgaatgtg tgtgtgtgtg tgtgtgtgtg tgtgtgtgtg tgtgtgtgtg tatcaagtac
6181 attcctagag cctacagagg tcaagggagg gcattggatc tggaactgga gtcacatgag
6241 gctgtgagca actgtgtggg ttcctgggcc tttgcaacag cagttagtac tcttcaccac
6301 tgagccattt ctccaatctc aaaaagaagc attcttttaa atgaagactg aaataaataa
6361 gtaggacttg ccttgg
```

SEQ ID NO: 205 Human SS18 cDNA Sequence variant 1 (NM_001007559.2; CDS: 79-1335)

```
   1 gagaggccgg cgtctctccc ccagtttgcc gttcacccgg agcgctcggg acttgccgat
  61 agtggtgacg gcggcaacat gtctgtggct ttcgcggccc cgaggcagcg aggcaagggg
 121 gagatcactc ccgctgcgat tcagaagatg ttggatgaca ataaccatct tattcagtgt
 181 ataatggact ctcagaataa aggaaagacc tcagagtgtt ctcagtatca gcagatgttg
 241 cacacaaact tggtatacct tgctacaata gcagattcta atcaaaatat gcagtctctt
 301 ttaccagcac cacccacaca gaatatgcct atgggtcctg gagggatgaa tcagagcggc
 361 cctcccccac ctccacgctc tcacaacatg ccttcagatg gaatggtagg tgggggtcct
 421 cctgcaccgc acatgcagaa ccagatgaac ggccagatgc ctgggcctaa ccatatgcct
 481 atgcagggac ctggacccaa tcaactcaat atgacaaaca gttccatgaa tatgccttca
 541 agtagccatg gatccatggg aggttacaac cattctgtgc catcatcaca gagcatgcca
 601 gtacagaatc agatgacaat gagtcaggga caaccaatgg gaaactatgg tcccagacca
 661 aatatgagta tgcagccaaa ccaaggtcca atgatgcatc agcagcctcc ttctcagcaa
 721 tacaatatgc cacagggagg cggacagcat taccaaggac agcagccacc tatgggaatg
 781 atgggtcaag ttaaccaagg caatcatatg atgggtcaga gacagattcc tccctataga
 841 cctcctcaac agggcccacc acagcagtac tcaggccagg aagactatta cggggaccaa
 901 tacagtcatg gtggacaagg tcctccagaa ggcatgaacc agcaatatta ccctgatggt
 961 cataatgatt acggttatca gcaaccgtcg tatcctgaac aaggctacga taggccttat
1021 gaggattcct cacaacatta ctacgaagga ggaaattcac agtatggcca acagcaagat
1081 gcataccagg gaccacctcc acaacaggga tatccacccc agcagcagca gtacccaggg
1141 cagcaaggtt acccaggaca gcagcagggc tacggtcctt cacagggtgg tccaggtcct
1201 cagtatccta actacccaca gggacaaggt cagcagtatg gaggatatag accaacacag
1261 cctggaccac cacagccacc ccagcagagg ccttatggat atgaccaggg acagtatgga
1321 aattaccagc agtgaaaaag tacttacatt ccagtagcca gtatctatta gcagccatat
1381 tgtcacctca gcactgtgga cacctccctg tgaagagatc cttccattcc atctagtttt
1441 tggaaaaacc ttgtggataa gtggctgttt catcagtaag cagcctttgt ggtttagtta
1501 taaaaggctt tagtagctca aaaatactct tgatttcaca tttctactct agatggcaac
1561 attggacaga aaatgcaatg acataaccaa tttgtaatga ttttggaact gtgtttcaaa
1621 tggactgtta cagactgaaa ggtgtgaaca gctttgtatg tttatgaagg gtaagggaat
1681 ttaatacttt tccacagatt tttttgtaag gggaagaggg aaatgtacac tttttacagc
1741 agcaatattt tgtatattat gtttatttca tgtggtgaat atgcaaggcg gtacactacg
1801 cactggacag catcagaaat cctctgttaa tgtggactgg aacatggtag atgcttgatt
1861 gtttggtct caaaatggtg tgctataaag ataaaggtga ggggaagaca aagcacacca
1921 tatgtccact gttctgttct catagaggaa attcaaatcc cttttatcta ttagataatc
1981 aagggcactg tgatacagtt ttgagtaaaa agacattttt taaaagcctt ccagttttgt
2041 ggattaaacc tttttataaa gatcatttat aatactgttt taaaatgtga ggcaataaga
2101 attactttgt gttggatctg aggaggcttt ggtaaaacag tttcatctaa atgaaagtgg
2161 taatcctctt ctaaaatagc aataactgaa aatgaaagtg ttaattttac cttgtttgag
2221 ttatcaggga acttagtaag taatatcaaa gcattttata aatgatatca aagaagagtc
2281 aacattgatc cagtcatttt attttgtaat attgagggat aattggttat taaactgaat
2341 agttcaggag actttacaaa cctttgtttc aactttctta tctggaaata atatcattta
2401 taaagggaca cttttatgtt tttccctttt ttatgttggt tgatataaca caaagagata
2461 tttaggaaaa tgcttattga tgaggtttat tctatctgtt tttaaagcac cgaggttgca
2521 ttctagataa ccttgtttat tagcatggca tattttaatc attatttgag actgtcctgt
2581 gcctgattat tttagctaaa ttcagggaga ttgcgtgggg caggaaagca tgcattgaaa
2641 aatttctaac cacggttatt taagcataat ctgaaaacat ctagcccaaa ggtaagttgc
2701 tattttcatc acagttgcct atgcccaggg aataagatgt attctttata attgaattgg
2761 tttttcccac gtctaactgg aaacaaaaca gaaggggcgt cataaatttg aataagcaga
2821 acatactgtt ctcaacatac tgtaatcaaa aggaggaatt tcagtgggtc tctgtgtgtg
2881 tatgagagag agagtgtgtg tttgtgtgtt tcaaggtcag aacaggtttt tttgtttttg
2941 tttttttgttc tttgtttttt tttttgagat ggagtcttgc tcttgtcgcc caggctggag
3001 tgcagtggcg caatctcagc tcactgcaac ctccgcctcc caggttcaag cagttctcct
3061 gcctcagcct cctgagtagc tgggatgaca ggcacccgcc accacaccca gctaattttt
3121 gtacttttag tagagacgag gtttcgccat gttggccagg ctggtctcga actcctgacc
3181 tcaggtgatc cacccgcctc ggccttccaa agtgctggga ttacaggcgt gagccaccgt
3241 gcctggccag aataggtttt ttctttcaac ttgatcagta gaaaatggac atcaagtttg
3301 aacagataaa tcatggacag ccttattgtg attgaaatgc ttgtaggttc tgtgccaatt
3361 ttccaccact gtgtactttg ttgctattta aaactgtatc aactctaacg gaagaataaa
3421 ttatttgtga ttttaaaaaa
```

TABLE 1-continued

SEQ ID NO: 206 Human SS18 Amino Acid Sequence isoform 1 (NP_001007560.1)
1 msvafaaprq rgkgeitpaa igkmlddnnh liqcimdsqn kgktsecsqy qqmlhtnlvy
61 latiadsnqn mqsllpappt qnmpmgpggm nqsgpppppr shnmpsdgmv gggppaphmq
121 nqmngqmpgp nhmpmqgpgp nqlnmtnssm nmpsssshgsm ggynhsvpss gsmpvqnqmt
181 msqgqpmgny gprpnmsmqp nqgpmmhqqp psqqynmpqg ggqhyqgqqp pmgmmgqvnq
241 qnhmmgqrqi ppyrppqqgp pqqysgqedy ygdqyshggq gppegmnqqy ypdghndygy
301 qqpsypeggy drpyedssqh yyeggnsqyg qqqdayggpp pqqgyppqqg qypgqqgypg
361 qqqgygpsqg gpgpqypnyp qgqgqqyggy rptqpgppqp pqqrpygydq gqygnyqq SEQ ID NO: 207 Human SS18 cEMA Sequence variant 2 (NM_0056373)
1 gagaggccgg cgtctctccc ccagtttgcc gttcacccgg agcgctcggg acttgccgat
61 agtggtgacg gcggcaacat gtctgtggct ttcgcggccc cgaggcagcg aggcaagggg
121 gagatcactc ccgctgcgat tcagaagatg ttggatgaca ataaccatct tattcagtgt
181 ataatggact ctcagaataa aggaaagacc tcagagtgtt ctcagtatca gcagatgttg
241 cacacaaact tggtatacct tgctacaata gcagattcta atcaaaatat gcagtctctt
301 ttaccagcac cacccacaca gaatatgcct atgggtcctg gagggatgaa tcagagcggc
361 cctcccccac ctccacgctc tcacaacatg ccttcagatg gaatggtagg tgggggtcct
421 cctgcaccgc acatgcagaa ccagatgaac ggccagatgc ctgggcctaa ccatatgcct
481 atgcagggac ctggacccaa tcaactcaat atgacaaaca gttccatgaa tatgccttca
541 agtagccatg gatccatggg aggttacaac cattctgtgc catcatcaca gagcatgcca
601 gtacagaatc agatgacaat gagtcaggga caaccaatgg gaaactatgg tcccagacca
661 aatatgagta tgcagccaaa ccaaggtcca atgatgcatc agcagcctcc ttctcagcaa
721 tacaatatgc cacagggagg cggacagcat taccaaggac agcagccacc tatgggaatg
781 atgggtcaag ttaaccaagg caatcatatg atgggtcaga gacagattcc tccctataga
841 cctcctcaac agggcccacc acagcagtac tcaggccagg aagactatta cggggaccaa
901 tacagtcatg gtggacaagg tcctccagaa ggcatgaacc agcaatatta ccctgatgga
961 aattcacagt atggccaaca gcaagatgca taccagggac cacctccaca acagggatat
1021 ccaccccagc agcagcagta cccagggcag caaggttacc caggacagca gcagggctac
1081 ggtccttcac agggtggtcc aggtcctcag tatcctaact acccacaggg acaaggtcag
1141 cagtatggag gatatagacc aacacagcct ggaccaccac agccacccca gcagaggcct
1201 tatggatatg accagggaca gtatggaaat taccagcagt gaaaaagtac ttacattcca
1261 gtagccagta tctattagca gccatattgt cacctcagca ctgtggacac ctccctgtga
1321 agagatcctt ccattccatc tagtttttgg aaaaaccttg tggataagtg gctgtttcat
1381 cagtaagcag cctttgtggt ttagttataa aaggctttag tagctcaaaa atactcttga
1441 tttcacattt ctactctaga tggcaacatt ggacagaaaa tgcaatgaca taaccaattt
1501 gtaatgattt tggaactgtg tttcaaatgg actgttacag actgaaaggt gtgaacagct
1561 ttgtatgttt atgaagggta agggaattta atacttttcc acagattttt ttgtaagggg
1621 aagagggaaa tgtacacttt ttacagcagc aatattttgt atattatgtt tatttcatgt
1681 ggtgaatatg caaggcggta cactacgcac tggacagcat cagaaatcct ctgttaatgt
1741 ggactggaac atggtagatg cttgattgtt ttggtctcaa aatggtgtgc tataaagata
1801 aaggtgaggg gaagacaaag cacaccatat gtccactgtt ctgttctcat agaggaaatt
1861 caaatccctt ttatctatta gataatcaag ggcactgtga tacagttttg agtaaaaaga
1921 catttttttaa aagccttcca gttttgtgga ttaaaccttt ttataaagat catttataat
1981 actgttttaa aatgtgaggc aataagaatt actttgtgtt ggatctgagg aggctttggt
2041 aaaacagttt catctaaatg aaagtggtaa tcctcttcta aaatagcaat aactgaaaat
2101 gaaagtgtta attttacctt gtttgagtta tcagggaact tagtaagtaa tatcaaagca
2161 ttttataaat gatatcaaag aagagtcaac attgatccag tcattttatt ttgtaatatt
2221 gagggataat tggttattaa actgaatagt tcaggagact ttacaaacct ttgtttcaac
2281 tttcttatct ggaaataata tcatttataa agggacactt ttatgttttt cccttttttta
2341 tgttggttga tataacacaa agagatattt aggaaaatgc ttattgatga ggtttattct
2401 atctgttttt aaagcaccga ggttgcattc tagataacct tgtttattag catggcatat
2461 tttaatcatt atttgagact gtcctgtgcc tgattatttt agctaaattc agggagattg
2521 cgtggggcag gaaagcatgc attgaaaaat ttctaaccac ggttatttaa gcataatctg
2581 aaaacatcta gcccaaaggt aagttgctat tttcatcaca gttgcctatg cccagggaat
2641 aagatgtatt ctttataatt gaattggttt ttcccacgtc taactggaaa caaaacagaa
2701 ggggcgtcat aaatttgaat aagcagaaca tactgttctc aacatactgt aatcaaaagg
2761 aggaatttca gtgggtctct gtgtgtgtat gagagagaga gtgtgtgttt gtgtgtttca
2821 aggtcagaac aggttttttt gtttttgttt tttgttcttt gtttttttttt ttgagatgga
2881 gtcttgctct tgtcgcccag gctggagtgc agtggcgcaa tctcagctca ctgcaacctc
2941 cgcctcccag gttcaagcag ttctcctgcc tcagcctcct gagtagctgg gatgacaggc
3001 acccgccacc acacccagct aatttttgta cttttagtag agacgaggtt tcgccatgtt
3061 ggccaggctg gtctcgaact cctgacctca ggtgatccac ccgcctcggc cttccaaagt
3121 gctgggatta caggcgtgag ccaccgtgcc tggccagaat aggtttttttc tttcaacttg
3181 atcagtagaa aatggacatc aagtttgaac agataaatca tggacagcct tattgtgatt
3241 gaaatgcttg taggttctgt gccaattttc caccactgtg tactttgttg ctatttaaaa
3301 ctgtatcaac tctaacggaa gaataaatta tttgtgattt taaaaaa SEQ ID NO: 208 Human SS18 Amino Acid Sequence isoform 2 (NP_005628.2)
1 msvafaaprq rgkgeitpaa igkmlddnnh liqcimdsqn kgktsecsqy qqmlhtnlvy
61 latiadsnqn mqsllpappt qnmpmgpggm nqsgpppppr shnmpsdgmv gggppaphmq
121 nqmngqmpgp nhmpmqgpgp nqlnmtnssm nmpsssshgsm ggynhsvpss gsmpvqnqmt
181 msqggpmgny gprpnmsmqp nqgpmmhqqp psqqynmpqg ggqhyqgqqp pmgmmgqvnq
241 gnhmmgqrqi ppyrppqqgp pqqysgqedy ygdqyshggq gppegmnqqy ypdgnsqygq
301 qgdayggppp qqgyppqqgg ypgqqgypgq qqgygpsqgg pgpqypnypq gqgqqyggyr
361 ptqpgppqpp qqrpygydqg qygnyqq SEQ ID NO: 209 Human SS18 cDNA Sequence variant 3 (NM_001308201.1; CDS: 123-1310)
1 ccttccacct ctgccctatc tcggcagatg ctccacggat ttgcacgaac tcccgagtct
61 tgacctccct cccctctccg ggctgccggg acaactcggg gcggccactc ttgccaggag TABLE 1-continued

```
 121 gcatgttgga tgacaataac catcttattc agtgtataat ggactctcag aataaaggaa
 181 agacctcaga gtgttctcag tatcagcaga tgttgcacac aaacttggta taccttgcta
 241 caatagcaga ttctaatcaa aatatgcagt ctcttttacc agcaccaccc acacagaata
 301 tgcctatggg tcctggaggg atgaatcaga gcggccctcc cccacctcca cgctctcaca
 361 acatgccttc agatggaatg gtaggtgggg gtcctcctgc accgcacatg cagaaccaga
 421 tgaacggcca gatgcctggg cctaaccata tgcctatgca gggacctgga cccaatcaac
 481 tcaatatgac aaacagttcc atgaatatgc cttcaagtag ccatggatcc atgggaggtt
 541 acaaccattc tgtgccatca tcacagagca tgccagtaca gaatcagatg acaatgagtc
 601 agggacaacc aatgggaaac tatggtccca gaccaaatat gagtatgcag ccaaaccaag
 661 gtccaatgat gcatcagcag cctccttctc agcaatacaa tatgccacag ggaggcggac
 721 agcattacca aggacagcag ccacctatgg gaatgatggg tcaagttaac caaggcaatc
 781 atatgatggg tcagagacag attcctccct atagacctcc tcaacagggc ccaccacagc
 841 agtactcagg ccaggaagac tattacgggg accaatacag tcatggtgga caaggtcctc
 901 cagaaggcat gaaccagcaa tattaccctg atggtcataa tgattacggt tatcagcaac
 961 cgtcgtatcc tgaacaaggc tacgataggc cttatgagga ttcctcacaa cattactacg
1021 aaggaggaaa ttcacagtat ggccaacagc aagatgcata ccagggacca cctccacaac
1081 agggatatcc accccagcag cagcagtacc cagggcagca aggttaccca ggacagcagc
1141 agggctacgg tccttcacag ggtggtccag gtcctcagta tcctaactac ccacagggac
1201 aaggtcagca gtatggagga tatagaccaa cacagcctgg accaccacag ccaccccagc
1261 agaggcctta tggatatgac cagggacagt atggaaatta ccagcagtga aaaagtactt
1321 acattccagt agccagtatc tattagcagc catattgtca cctcagcact gtggacacct
1381 ccctgtgaag agatccttcc attccatcta gtttttggaa aaaccttgtg gataagtggc
1441 tgtttcatca gtaagcagcc tttgtggttt agttataaaa ggctttagta gctcaaaaat
1501 actcttgatt tcacatttct actctagatg gcaacattgg acagaaaatg caatgacata
1561 accaatttgt aatgattttg gaactgtgtt tcaaatggac tgttacagac tgaaaggtgt
1621 gaacagcttt gtatgtttat gaagggtaag ggaatttaat acttttccac agattttttt
1681 gtaaggggaa gagggaaatg tacacttttt acagcagcaa tattttgtat attatgttta
1741 tttcatgtgg tgaatatgca aggcggtaca ctacgcactg gacagcatca gaaatcctct
1801 gttaatgtgg actggaacat ggtagatgct tgattgtttt ggtctcaaaa tggtgtgcta
1861 taaagataaa ggtgagggga agacaaagca caccatatgt ccactgttct gttctcatag
1921 aggaaattca aatccctttt atctattaga taatcaaggg cactgtgata cagttttgag
1981 taaaaagaca ttttttaaaa gccttccagt tttgtggatt aaaccttttt ataaagatca
2041 tttataatac tgttttaaaa tgtgaggcaa taagaattac tttgtgttgg atctgaggag
2101 gctttggtaa aacagtttca tctaaatgaa agtggtaatc ctcttctaaa atagcaataa
2161 ctgaaaatga aagtgttaat tttaccttgt ttgagttatc agggaactta gtaagtaata
2221 tcaaagcatt ttataaatga tatcaaagaa gagtcaacat tgatccagtc attttatttt
2281 gtaatattga gggataattg gttattaaac tgaatagttc aggagacttt acaaaccttt
2341 gtttcaactt tcttatctgg aaataatatc atttataaag ggacactttt atgtttttcc
2401 ctttttttatg ttggttgata taacacaaag agatatttag gaaaatgctt attgatgagg
2461 tttattctat ctgtttttaa agcaccgagg ttgcattcta gataaccttg tttattagca
2521 tggcatattt taatcattat ttgagactgt cctgtgcctg attattttag ctaaattcag
2581 ggagattgcg tggggcagga aagcatgcat tgaaaaattt ctaaccacgg ttatttaagc
2641 ataatctgaa aacatctagc ccaaaggtaa gttgctattt tcatcacagt tgcctatgcc
2701 cagggaataa gatgtattct ttataattga attggttttt cccacgtcta actggaaaca
2761 aaacagaagg ggcgtcataa atttgaataa gcagaacata ctgttctcaa catactgtaa
2821 tcaaaaggag gaatttcagt gggtctctgt gtgtgtatga gagagagagt gtgtgtttgt
2881 gtgtttcaag gtcagaacag gttttttttgt ttttgttttt tgttctttgt ttttttttt
2941 gagatggagt cttgctcttg tcgcccaggc tggagtgcag tggcgcaatc tcagctcact
3001 gcaacctccg cctcccaggt tcaagcagtt ctcctgcctc agcctcctga gtagctggga
3061 tgacaggcac ccgccaccac acccagctaa tttttgtact tttagtagag acgaggtttc
3121 gccatgttgg ccaggctggt ctcgaactcc tgacctcagg tgatccaccc gcctcggcct
3181 tccaaagtgc tgggattaca ggcgtgagcc accgtgcctg gccagaatag gttttttctt
3241 tcaacttgat cagtagaaaa tggacatcaa gtttgaacag ataaatcatg gacagcctta
3301 ttgtgattga aatgcttgta ggttctgtgc caattttcca ccactgtgta ctttgttgct
3361 atttaaaact gtatcaactc taacggaaga ataaattatt tgtgatttta aaaaa
```

SEQ ID NO: 210 Human SS18 Amino Acid Sequence isoforrn 3 (NP_001295130.1)

```
  1 mlddnnhliq cimdsqnkgk tsecsqyqqm lhtnlvylat iadsnqnmqs llpapptqnm
 61 pmgpggmnqs gppppprshn mpsdgmvggg ppaphmqnqm ngqmpgpnhm pmqgpgpnql
121 nmtnssmnmp ssshgsmggy nhsvpssqsm pvqnqmtmsq gqpmgnygpr pnmsmqpnqg
181 pmmhqqppsq qynmpqgggq hyqgqqppmg mmgqvnqgnh mmgqrgippy rppqqgppqg
241 ysgqedyygd qyshggqgpp egmnqqyypd ghndygyqqp sypeqgydrp yedssqhyye
301 ggnsqygqqg dayggpppqg gyppqqqqyp gqqgypgqqg gygpsqggpg pqypnypqgq
361 gqqyggyrpt qpgppqppqg rpygydqgqy gnyqq
```

SEQ ID NO: 211 Mouse SS18 Amino Acid Sequence isoform 1 (NP_033306.2)

```
  1 msvafaaprq rgkgeitpaa igkmldennh liqcimdyqn kgkasecsqy qqilhtnlvy
 61 latiadsnqn mqsllpappt qtmpmgpggm sqsgpppppr shnmpsdgmv gggppaphmq
121 nqmngqmpgp nhmpmqgpgp sqlsmtnssm nmpssshgsm ggynhsvpss qsmpvqnqmt
181 msqggpmgny gprpnmnmqp nqgpmmhqqp psqqynmppg gaqhyggqqa pmglmgqvnq
241 gshmmgqrqm ppyrppqqgp pqqysgqedy ygdqyshggq gppegmnqqy ypdghndygy
301 qqpsypeggy drpyedssqh yyeggnsqyg qqqdayggpp pqqgyppqqg qypgqqgypg
361 qqqsygpsqg gpgpqypnyp qgqgqqyggy rptqpgppqp pqqrpygydq gqygnyqq
```

SEQ ID NO: 212 Mouse SS18 cDNA Sequence variant 1 (NM_009280.2;
CDS: 180-1436)

```
  1 ccttgctggg agctgcggct cagcgttaag gccaagccgg ccagcgaggg acgcggcccg
 61 ggagcatcct ccccccaccg cgcgccctaa ggtggaactg cccggaggcg ggcgtcgggc
121 ccccagctcc gcgggccctg gagcgctcgg gactcgctga tcgcgggctc ggcggcaaca
181 tgtctgtggc gttcgcagcc ccgaggcagc ggggcaaggg cgaaatcacg cccgccgcca
```

TABLE 1-continued

```
 241 tccagaagat gctggatgaa aacaaccatc ttattcagtg tataatggac tatcagaaca
 301 aagggaaggc ctcggagtgc tcgcagtatc agcagatatt gcatacaaac ctggtatacc
 361 ttgctacaat agcagactct aatcaaaata tgcagtctct cttaccagca ccgcccacac
 421 agactatgcc aatgggtcct ggagggatga gtcagagtgg ccctccaccc cctccccgct
 481 ctcacaacat gccttcagat ggaatggtgg gtgggggccc tcctgcacca cacatgcaga
 541 accagatgaa cggccagatg cctgggccta accatatgcc aatgcaggga cctggaccca
 601 gtcagctcag catgacaaac agctccatga atatgccttc aagtagccat ggctccatgg
 661 gaggttacaa ccattctgtg ccgtcatccc agagcatgcc cgtgcagaac cagatgacaa
 721 tgagtcaggg gcagccaatg ggaaactatg gtcccagacc aaacatgaat atgcaaccaa
 781 atcaagggcc gatgatgcac cagcagcctc cttctcagca gtacaatatg ccacctggag
 841 gggcacagca ttaccaagga cagcaggcgc ccatggggct gatgggccaa gttaaccaag
 901 gcagtcacat gatgggccag cgacagatgc ctccctacag acctccgcaa cagggcccac
 961 cacagcagta ctcaggccag gaagactatt atggggacca atacagtcat ggtggacaag
1021 gtcctccaga aggcatgaac cagcaatatt accctgatgg tcataatgat tacggttatc
1081 agcaaccgtc gtatcctgaa caaggctacg ataggcctta tgaggattcc tcacaacatt
1141 actacgaagg aggaaactcc cagtatggcc aacagcaaga cgcttaccag ggaccacctc
1201 cacagcaagg ataccaccc cagcagcagc agtacccggg acagcaggga tacccagggc
1261 agcagcagag ctatggtcct tcgcagggcg gtccaggtcc tcagtatcct aattatcctc
1321 agggtcaagg tcagcagtat gggggctata gaccaacaca gccaggacca ccccagccac
1381 cccagcagag gccttatggg tacgaccagg gacagtatgg aaattaccag cagtgaaaat
1441 gtccttacat tccaatagcc agtacctatt agcaggcacg ttgtcacagc actgcaccat
1501 ggacaccccc ctgggaagac tccttccatt ccagctaggt ttttgggaaa acctttggct
1561 aagtggctgc ttcgtcagca agtagctgtt atggtttagt ttgtaaaggc ttcgtagcta
1621 ccgatgcacc tgatttcacg tttctactct agatggcaac attggacaga aaatgcattg
1681 acgtgaggag tttgcagcgg tttcagaact gtgctgcaaa tggactgtca cagcctgaaa
1741 ggtgtgagca gctgggtgtg tgttcgcgga gcttcagggg gtttcatact tttccaccga
1801 ttattttgta aggggaaggg ggaaatgtac actttttaca gcagcaatat tttgtctatt
1861 atgtttattt catgtgataa atatgcaaag cggtacacta cacactgggc agaatcagaa
1921 cccctgttaa tgtggagtgt ggtagatgct cggtgctgtg gtgctctgaa gacaggcgag
1981 gggaggcaga agcccaccac aggcccgctg ttagttctta gaggaaactc ctctctctct
2041 tatctaccag attagcaagg gcgctgtgat acagtttttt gagtacaaag acattttta
2101 aaaagccttc cagttttgtg cattaaaacc tttttgtaaa tatggtttat aatactgttt
2161 tcaaacgcaa ggcaataatt atgttgcatc tgtgaacttt ggcaggtttg tgtaaaagga
2221 gggaagcctc tcttaaaaca gcaataacag aaaaggagga agcgggatgt ttttaccttg
2281 tcttgtaatc agggagctct caccacgtca gagaggaggc agcattggtc tcaccttact
2341 gtttttaca ttaccatgat tggttcatgg agcagggagg agtccacgag acttcacacg
2401 cttgtgcttt aactttctta actgggcaca agcaaagggc gccttcgtgt tcctctcttc
2461 atcttagtta atgcgcgagg aaaatgcttt gatggccatt tctcattcgc actgaaagcc
2521 gagaggtgac attttacggt ttcttgtttt taagcacgac atacttaatc attatttgag
2581 actgattatt ttagctaaat ttggggatat gccatggggc aagaaaacat gtactgagag
2641 atttctaaac acatctattt aagcatactt taaaaatatc tagcccaaag gtaagttgct
2701 gtatcctcac agttgtctgc atccagggaa tatgactgaa tataacatat ctttgtaatt
2761 gaattagttt ttgccacttc taactgaaaa cagaacagaa ggagtgccat aaatgcaaag
2821 aagcaaagtg tactgttgtc aacatactgt aatcagagga ggggtttcaa tgtgtctgga
2881 tgagagtgtg tgtgtttaag gtcagagtat agggtgttct tcaacttgga cagtagaaaa
2941 taggcatcaa gtgtgaaccg gtgaggcgtg gacagccttc ttgtgactga gatgcttgta
3001 agttctgtgc caggttctcc accactgtgt actttattgc tatttaaaac tgtatcaact
3061 ctaacgaaag aataaattat ttgtgatttt aaaaaaaaaa aaaaaaaaaa
```

SEQ ID NO: 213 Mouse SS18 Amino Acid Sequence isoform 2 (NP_001154841.1)

```
  1 msvafaaprq rgkgeitpaa igkmldennh liqcimdyqn kgkasecsqy qqilhtnlvy
 61 latiadsnqn mqsllpappt qtmpmgpggm sqsgppppr shnmpsdgmv gggppaphmq
121 nqmngqmpgp nhmpmqgpgp sqlsmtnssm nmpssshgsm ggynhsvpss qsmpvqnqmt
181 msqggpmgny gprpnmnmqp nqgpmmhqqp psqqynmppg gaqhyggqqa pmglmgqvnq
241 gshmmgqrqm ppyrppqqgp pqqysgqedy ygdqyshggq gppegmnqqy ypdgnsqygq
301 qqdayggppp qqgyppqqqg ypgqqgypgq qqsygpsqgg pgpqypnypq gqgqqyggyr
361 ptqpgppqpp qqrpygydqg qygnyqg
```

SEQ ID NO: 214 Mouse SS18 cDNA Sequence variant 2 (NM_001161369.1; CDS: 180-1343)

```
   1 ccttgctggg agctgcggct cagcgttaag gccaagccgg ccagcgaggg acgcggcccg
  61 ggagcatcct ccccccaccg cgcgccctaa ggtggaactg cccggaggcg ggcgtcgggc
 121 ccccagctcc gcgggccctg gagcgctcgg gactcgctga tcgcgggctc ggcggcaaca
 181 tgtctgtggc gttcgcagcc ccgaggcagc ggggcaaggg cgaaatcacg cccgccgcca
 241 tccagaagat gctggatgaa aacaaccatc ttattcagtg tataatggac tatcagaaca
 301 aagggaaggc ctcggagtgc tcgcagtatc agcagatatt gcatacaaac ctggtatacc
 361 ttgctacaat agcagactct aatcaaaata tgcagtctct cttaccagca ccgcccacac
 421 agactatgcc aatgggtcct ggagggatga gtcagagtgg ccctccaccc cctccccgct
 481 ctcacaacat gccttcagat ggaatggtgg gtgggggccc tcctgcacca cacatgcaga
 541 accagatgaa cggccagatg cctgggccta accatatgcc aatgcaggga cctggaccca
 601 gtcagctcag catgacaaac agctccatga atatgccttc aagtagccat ggctccatgg
 661 gaggttacaa ccattctgtg ccgtcatccc agagcatgcc cgtgcagaac cagatgacaa
 721 tgagtcaggg gcagccaatg ggaaactatg gtcccagacc aaacatgaat atgcaaccaa
 781 atcaagggcc gatgatgcac cagcagcctc cttctcagca gtacaatatg ccacctggag
 841 gggcacagca ttaccaagga cagcaggcgc ccatggggct gatgggccaa gttaaccaag
 901 gcagtcacat gatgggccag cgacagatgc ctccctacag acctccgcaa cagggcccac
 961 cacagcagta ctcaggccag gaagactatt atggggacca atacagtcat ggtggacaag
1021 gtcctccaga aggcatgaac cagcaatatt accctgatgg aaactcccag tatggccaac
1081 agcaagacgc ttaccaggga ccacctccac agcaaggata cccaccccag cagcagcagt
1141 acccgggaca gcagggatac ccagggcagc agcagagcta tggtccttcg cagggcggtc
```

TABLE 1-continued

```
1201 caggtcctca gtatcctaat tatcctcagg gtcaaggtca gcagtatggg ggctatagac
1261 caacacagcc aggaccaccc cagccacccc agcagaggcc ttatgggtac gaccagggac
1321 agtatggaaa ttaccagcag tgaaaatgtc cttacattcc aatagccagt acctattagc
1381 aggcacgttg tcacagcact gcaccatgga cacccccctg ggaagactcc ttccattcca
1441 gctaggtttt tgggaaaacc tttggctaag tggctgcttc gtcagcaagt agctgttatg
1501 gtttagtttg taaaggcttc gtagctaccg atgcacctga tttcacgttt ctactctaga
1561 tggcaacatt ggacagaaaa tgcattgacg tgaggagttt gcagcggttt cagaactgtg
1621 ctgcaaatgg actgtcacag cctgaaaggt gtgagcagct gggtgtgtgt tcgcggagct
1681 tcaggggggtt tcatactttt ccaccgatta ttttgtaagg ggaagggggga aatgtacact
1741 ttttacagca gcaatatttt gtctattatg tttatttcat gtgataaata tgcaaagcgg
1801 tacactacac actgggcaga atcagaaccc ctgttaatgt ggagtgtggt agatgctcgg
1861 tgctgtggtg ctctgaagac aggcgagggg aggcagaagc ccaccacagg cccgctgtta
1921 gttcttagag gaaactcctc tctctcttat ctaccagatt agcaagggcg ctgtgataca
1981 gtttttgag tacaaagaca ttttttaaaa agccttccag ttttgtgcat taaaaccttt
2041 ttgtaaatat ggtttataat actgttttca aacgcaaggc aataattatg ttgcatctgt
2101 gaactttggc aggtttgtgt aaaaggaggg aagcctctct taaaacagca ataacagaaa
2161 aggaggaagc gggatgtttt taccttgtct tgtaatcagg gagctctcac cacgtcagag
2221 aggaggcagc attggtctca ccttactgtt ttttacatta ccatgattgg ttcatggagc
2281 agggaggagt ccacgagact tcacacgctt gtgctttaac tttcttaact gggcacaagc
2341 aaagggcgcc ttcgtgttcc tctcttcatc ttagttaatg cgcgaggaaa atgctttgat
2401 ggccatttct cattcgcact gaaagccgag aggtgacatt ttacggtttc ttgtttttaa
2461 gcacgacata cttaatcatt atttgagact gattatttta gctaaatttg gggatatgcc
2521 atggggcaag aaaacatgta ctgagagatt tctaaacaca tctatttaag catactttaa
2581 aaatatctag cccaaaggta agttgctgta tcctcacagt tgtctgcatc cagggaatat
2641 gactgaatat aacatatctt tgtaattgaa ttagtttttg ccacttctaa ctgaaaacag
2701 aacagaagga gtgccataaa tgcaaagaag caaagtgtac tgttgtcaac atactgtaat
2761 cagaggaggg gtttcaatgt gtctggatga gagtgtgtgt gtttaaggtc agagtatagg
2821 gtgttcttca acttggacag tagaaaatag gcatcaagtg tgaaccggtg aggcgtggac
2881 agccttcttg tgactgagat gcttgtaagt tctgtgccag gttctccacc actgtgtact
2941 ttattgctat ttaaaactgt atcaactcta acgaaagaat aaattatttg tgattttaaa
3001 aaaaaaaaaa aaaaaaa
```

SEQ ID NO: 215 Mouse SS18 Amino Acid Sequence isoform 3 (NP_001154842.1)

```
  1 msvafaaprq rgkgeitpaa igkmldennh liqcimdyqn kgkasecsqy gqilhtnlvy
 61 latiadsnqn mqsllpappt qtmpmgpggm sqsgpppppr shnmpsdgmv gggppaphmq
121 nqmngqmpgp mmhqqppsqq ynmppggaqh yqgqqapmgl mgqvnggshm mgqrqmppyr
181 ppqqgppqqy sgqedyygdg yshggqgppe gmnqqyypdg hndygyqqps ypeqgydrpy
241 edssqhyyeg gnsqygqqqd ayggpppqqg yppqqqqypg qqgypgqqqs ygpsqggpgp
301 qypnypqggg qqyggyrptq pgppqppqqr pygydqgqyg nyqq
```

SEQ ID NO: 216 Mouse SS18 cDNA Sequence variant 3 (NM_001161370.1;
CDS: 180-1214)

```
   1 ccttgctggg agctgcggct cagcgttaag gccaagccgg ccagcgaggg acgcggcccg
  61 ggagcatcct ccccccaccg cgcgccctaa ggtggaactg cccggaggcg ggcgtcgggc
 121 ccccagctcc gcgggccctg gagcgctcgg gactcgctga tcgcgggctc ggcggcaaca
 181 tgtctgtggc gttcgcagcc ccgaggcagc ggggcaaggg cgaaatcacg cccgccgcca
 241 tccagaagat gctggatgaa aacaaccatc ttattcagtg tataatggac tatcagaaca
 301 aagggaaggc ctcggagtgc tcgcagtatc agcagatatt gcatacaaac ctggtatacc
 361 ttgctacaat agcagactct aatcaaaata tgcagtctct cttaccagca ccgcccacac
 421 agactatgcc aatgggtcct ggagggatga gtcagagtgg ccctccaccc cctccccgct
 481 ctcacaacat gccttcagat ggaatggtgg gtgggggccc tcctgcacca cacatgcaga
 541 accagatgaa cggccagatg cctgggccga tgatgcacca gcagcctcct tctcagcagt
 601 acaatatgcc acctggaggg gcacagcatt accaaggaca gcaggcgccc atggggctga
 661 tgggccaagt taaccaaggc agtcacatga tgggccagcg acagatgcct ccctacagac
 721 ctccgcaaca gggcccacca cagcagtact caggccagga agactattat ggggaccaat
 781 acagtcatgg tggacaaggt cctccagaag gcatgaacca gcaatattac cctgatggtc
 841 ataatgatta cggttatcag caaccgtcgt atcctgaaca aggctacgat aggccttatg
 901 aggattcctc acaacattac tacgaaggag gaaactccca gtatggccaa cagcaagacg
 961 cttaccaggg accacctcca cagcaaggat acccacccca gcagcagcag tacccgggac
1021 agcagggata cccagggcag cagcagagct atggtccttc gcagggcggt ccaggtcctc
1081 agtatcctaa ttatcctcag ggtcaaggtc agcagtatgg gggctataga ccaacacagc
1141 caggaccacc ccagccaccc cagcagaggc cttatgggta cgaccaggga cagtatggaa
1201 attaccagca gtgaaaatgt ccttacattc caatagccag tacctattag caggcacgtt
1261 gtcacagcac tgcaccatgg acacccccct gggaagactc cttccattcc agctaggttt
1321 ttgggaaaac ctttggctaa gtggctgctt cgtcagcaag tagctgttat ggtttagttt
1381 gtaaaggctt cgtagctacc gatgcacctg atttcacgtt tctactctag atggcaacat
1441 tggacagaaa atgcattgac gtgaggagtt tgcagcggtt tcagaactgt gctgcaaatg
1501 gactgtcaca gcctgaaagg tgtgagcagc tgggtgtgtg ttcgcggagc ttcagggggt
1561 ttcatacttt tccaccgatt attttgtaag gggaaggggg aaatgtacac tttttacagc
1621 agcaatattt tgtctattat gtttatttca tgtgataaat atgcaaagcg gtacactaca
1681 cactgggcag aatcagaacc cctgttaatg tggagtgtgg tagatgctcg gtgctgtggt
1741 gctctgaaga caggcgaggg gaggcagaag cccaccacag gcccgctgtt agttcttaga
1801 ggaaactcct ctctctctta tctaccagat tagcaagggc gctgtgatac agttttttga
1861 gtacaaagac atttttttaaa aagccttcca gttttgtgca ttaaaacctt tttgtaaata
1921 tggtttataa tactgttttc aaacgcaagg caataattat gttgcatctg tgaactttgg
1981 caggtttgtg taaaaggagg gaagcctctc ttaaaacagc aataacagaa aaggaggaag
2041 cgggatgttt ttaccttgtc ttgtaatcag ggagctctca ccacgtcaga gaggaggcag
2101 cattggtctc accttactgt tttttacatt accatgattg gttcatggag cagggaggag
2161 tccacgagac ttcacacgct tgtgctttaa ctttcttaac tgggcacaag caaagggcgc
2221 cttcgtgttc ctctcttcat cttagttaat gcgcgaggaa aatgctttga tggccatttc
```

TABLE 1-continued

```
2281 tcattcgcac tgaaagccga gaggtgacat tttacggttt cttgttttta agcacgacat
2341 acttaatcat tatttgagac tgattatttt agctaaattt ggggatatgc catggggcaa
2401 gaaaacatgt actgagagat ttctaaacac atctatttaa gcatacttta aaaatatcta
2461 gcccaaaggt aagttgctgt atcctcacag ttgtctgcat ccagggaata tgactgaata
2521 taacatatct ttgtaattga attagttttt gccacttcta actgaaaaca gaacagaagg
2581 agtgccataa atgcaaagaa gcaaagtgta ctgttgtcaa catactgtaa tcagaggagg
2641 ggtttcaatg tgtctggatg agagtgtgtg tgtttaaggt cagagtatag ggtgttcttc
2701 aacttggaca gtagaaaata ggcatcaagt gtgaaccggt gaggcgtgga cagccttctt
2761 gtgactgaga tgcttgtaag ttctgtgcca ggttctccac cactgtgtac tttattgcta
2821 tttaaaactg tatcaactct aacgaaagaa taaattattt gtgattttaa aaaaaaaaaa
2881 aaaaaaaa
```

SEQ ID NO: 217 Mouse SS18 Amino Acid Sequence isoform 4 (NP_001154843.1)

```
  1 msvafaaprq rgkgeitpaa igkmldennh liqcimdyqn kgkasecsqy qqilhtnlvy
 61 latiadsnqn mqsllpappt qtmpmgpggm sqsgpppppr shnmpsdgmv gggppaphmq
121 nqmngqmpgp mmhqqppsqq ynmppggaqh yqgqqapmgl mgqvnggshm mgqrqmppyr
181 ppqqgppqqy sgqedyygdg yshggqgppe gmnqqyypdg nsqygqqqda yqgpppqqgy
241 ppqqqqypgq qgypgqqqsy gpsqggpgpq ypnypqgqgq qyggyrptqp gppqppqqrp
301 ygydqgqygn yqq
```

SEQ ID NO: 218 Mouse SS18 cDNA Sequence variant 4 (NM_001161371.1; CDS: 180-1121)

```
   1 ccttgctggg agctgcggct cagcgttaag gccaagccgg ccagcgaggg acgcggcccg
  61 ggagcatcct ccccccaccg cgcgccctaa ggtggaactg cccggaggcg ggcgtcgggc
 121 ccccagctcc gcgggccctg gagcgctcgg gactcgctga tcgcgggctc ggcggcaaca
 181 tgtctgtggc gttcgcagcc ccgaggcagc ggggcaaggg cgaaatcacg cccgccgcca
 241 tccagaagat gctggatgaa aacaaccatc ttattcagtg tataatggac tatcagaaca
 301 aagggaaggc ctcggagtgc tcgcagtatc agcagatatt gcatacaaac ctggtatacc
 361 ttgctacaat agcagactct aatcaaaata tgcagtctct cttaccagca ccgcccacac
 421 agactatgcc aatgggtcct ggagggatga gtcagagtgg ccctccaccc cctccccgct
 481 ctcacaacat gccttcagat ggaatggtgg gtgggggccc tcctgcacca cacatgcaga
 541 accagatgaa cggccagatg cctgggccga tgatgcacca gcagcctcct tctcagcagt
 601 acaatatgcc acctggaggg gcacagcatt accaaggaca gcaggcgccc atggggctga
 661 tgggccaagt taaccaaggc agtcacatga tgggccagcg acagatgcct ccctacagac
 721 ctccgcaaca gggcccacca cagcagtact caggccagga agactattat ggggaccaat
 781 acagtcatgg tggacaaggt cctccagaag gcatgaacca gcaatattac cctgatggaa
 841 actcccagta tggccaacag caagacgctt accagggacc acctccacag caaggatacc
 901 caccccagca gcagcagtac ccgggacagc agggataccc agggcagcag cagagctatg
 961 gtccttcgca gggcggtcca ggtcctcagt atcctaatta tcctcagggt caaggtcagc
1021 agtatggggg ctatagacca acacagccag gaccacccca gccaccccag cagaggcctt
1081 atgggtacga ccagggacag tatggaaatt accagcagtg aaaatgtcct tacattccaa
1141 tagccagtac ctattagcag gcacgttgtc acagcactgc accatggaca ccccccctggg
1201 aagactcctt ccattccagc taggtttttg ggaaaacctt tggctaagtg gctgcttcgt
1261 cagcaagtag ctgttatggt ttagtttgta aaggcttcgt agctaccgat gcacctgatt
1321 tcacgtttct actctagatg gcaacattgg acagaaaatg cattgacgtg aggagtttgc
1381 agcggtttca gaactgtgct gcaaatggac tgtcacagcc tgaaaggtgt gagcagctgg
1441 gtgtgtgttc gcggagcttc agggggtttc atacttttcc accgattatt ttgtaagggg
1501 aagggggaaa tgtacacttt ttacagcagc aatattttgt ctattatgtt tatttcatgt
1561 gataaatatg caaagcggta cactacacac tgggcagaat cagaacccct gttaatgtgg
1621 agtgtggtag atgctcggtg ctgtggtgct ctgaagacag gcgaggggag gcagaagccc
1681 accacaggcc cgctgttagt tcttagagga aactcctctc tctcttatct accagattag
1741 caagggcgct gtgatacagt tttttgagta caaagacatt ttttaaaaag ccttccagtt
1801 ttgtgcatta aaaccttttt gtaaatatgg tttataatac tgttttcaaa cgcaaggcaa
1861 taattatgtt gcatctgtga actttggcag gtttgtgtaa aaggagggaa gcctctctta
1921 aaacagcaat aacagaaaag gaggaagcgg gatgttttta ccttgtcttg taatcaggga
1981 gctctcacca cgtcagagag gaggcagcat tggtctcacc ttactgtttt ttacattacc
2041 atgattggtt catggagcag ggaggagtcc acgagacttc acacgcttgt gctttaactt
2101 tcttaactgg gcacaagcaa agggcgcctt cgtgttcctc tcttcatctt agttaatgcg
2161 cgaggaaaat gctttgatgg ccatttctca ttcgcactga aagccgagag gtgacatttt
2221 acggtttctt gtttttaagc acgacatact taatcattat ttgagactga ttattttagc
2281 taaatttggg gatatgccat ggggcaagaa aacatgtact gagagatttc taaacacatc
2341 tatttaagca tactttaaaa atatctagcc caaaggtaag ttgctgtatc ctcacagttg
2401 tctgcatcca gggaatatga ctgaatataa catatctttg taattgaatt agtttttgcc
2461 acttctaact gaaaacagaa cagaaggagt gccataaatg caaagaagca aagtgtactg
2521 ttgtcaacat actgtaatca gaggaggggt ttcaatgtgt ctggatgaga gtgtgtgtgt
2581 ttaaggtcag agtatagggt gttcttcaac ttggacagta gaaaataggc atcaagtgtg
2641 aaccggtgag gcgtggacag ccttcttgtg actgagatgc ttgtaagttc tgtgccaggt
2701 tctccaccac tgtgtacttt attgctattt aaaactgtat caactctaac gaaagaataa
2761 attatttgtg attttaaaaa aaaaaaaaaa aaaaa
```

SEQ ID NO: 219 Human SS18L1 cDNA Sequence variant 1 (NM_198935.2; CDS: 102-1292)

```
  1 cttccccccc tccgcgactg cggataatga gcgcctcggg ccgcccagcg cagccggagt
 61 atccacctcg atgaccacgg gctgagcccc gcgccgccac catgtccgtg gccttcgcgt
121 ctgcccggcc aagaggcaaa ggggaggtta cgcagcaaac catccagaag atgctggacg
181 agaaccacca cctgatccag tgcatcctgg agtaccagag caagggcaag acggccgagt
241 gcacgcagta ccagcagatc ctgcaccgga acctggtata cctggccacg atcgcagact
301 ccaaccagaa catgcagtcc ctgcttcctg ccccgcccac gcagaacatg aacctgggcc
361 ctggagccct gactcagagc ggctccagcc agggcctgca ctctcagggc agcctgagtg
421 acgccatcag cacgggcctg ccaccctcct ccctcctgca gggccagatt ggcaacgggc
```

TABLE 1-continued

```
 481 cgagccacgt gtccatgcag cagacggcgc ctaacacgct gcccaccacc tccatgagca
 541 tctctgggcc cggctacagc cacgcgggac ccgcctcgca gggcgtcccc atgcaggggc
 601 aaggcaccat cggcaactac gtgtctcgga ccaacatcaa catgcagtcc aacccagtct
 661 ccatgatgca gcagcaggcg gccacgtcgc actacagctc ggcgcagggc ggcagccagc
 721 actaccaggg ccagtcgtcc atcgccatga tggggcaggg cagccagggg agcagcatga
 781 tggggcagcg gcccatggcg ccctaccggc cctcccagca aggctcttcc cagcagtacc
 841 tgggccagga ggagtactat ggcgagcagt acagccacag ccagggcgcc gcggagccca
 901 tgggccagca gtactacccc gacggccatg gcgattacgc ctaccagcag tcatcctaca
 961 cggagcagag ctacgaccgg tccttcgagg agtccacgca gcactactat gagggggga
1021 actcccagta cagccagcag caggccgggt accagcaggg tgccgcgcag cagcagacgt
1081 actcccagca gcagtacccc agccagcaga gctaccccgg gcagcagcag ggctacgggt
1141 ctgcccaggg agccccgtca cagtaccccg gctaccagca aggccaaggc cagcagtacg
1201 gaagctaccg agcaccgcag acagcgccgt ctgcccagca gcagcggccc tacggctatg
1261 aacagggcca gtatggaaat taccagcagt aagggacaca cattctggct ggagcccttg
1321 tggtagcgtg ttcatccagg ggccggatgg gctggcggca gctctggtga attgtgacat
1381 gttggttacc tgttcgccca gtgccacgtc tgcatgtgaa gcgtgctcat ttcatgctgg
1441 gtatgacgcc gagcgcacac cactggcgtg agacagcgct tggtggtgtg atacttttgg
1501 tgctgtgtat agtattgtat gtcggtacac ggagaggtat ccttttttg tcccccgccc
1561 ccttctcaat gtttctagct agctttgggg gtcattttgt catcagagca ttctgtgccc
1621 agggacagga cagatctcga ggacaccaca gtccacctgt tcccgtcaac agacgttagg
1681 tctcattttc ctcctcatgc agtgttgtag tgtgggttgt caacttttct ttaactggct
1741 acgccacagc tggacacaca tgcagcccct ggagggcagc ctcttcctgt gcctcgatgg
1801 ggtgggtggg agggcatctt ctgtgcgttg ggtcagtttc tgttacgtaa cgaaaaggat
1861 aaacatctcc cacgggagag gccacagatg gccacttcca gagcttgccc attgcctgtc
1921 tctcgccaat tccgtttatc caaaaaggta catgttttg tattaaaaag taaacaggga
1981 tcagtgactg tattccaaat aaatatgaat ccctaagggc cgtggacaaa ttgcctaacc
2041 cagggccagc ggtattgctg aaggaaaggg gcagctctct gggaagtggg ccctcagaga
2101 ttactctggc tttgaccctt gtttagctga tggtcatttc tgggattgga atatttaata
2161 agcccaattc taagttgata ggtaatttta aatattcaaa ccaaatcttc ccaacagttg
2221 gcaagttgtt tattttatat tatttcttcc aggacctact tgctcagatc tccaagcaag
2281 catttctttt cttttaggga tgtctgaaag tcacatccag ttacattact gtgttctttc
2341 taatgaaaag taaaggtttt atatagagaa acttgagtaa tttttacatt tctaagacat
2401 taaatcccat ttaaattctg tgtgaacatt aaagacagca cacttgcaaa agtatggtca
2461 aaggaaaaaa atcccacatt tcaattaaca agtagcatgg acatttgatc aacctttagt
2521 tggaataata atattcatat ttgctatgaa tccttttaaa aaaatctttg gataaatgct
2581 gacagatttc caagaactac caagaaaata caagagatat ccaatgcttg atatatgagg
2641 cctagtaata acgatatttc tctttaattg atgttttgtt ttaaaagtta aaagtaattc
2701 ttggcgtggt ggttcacgcc tgtaatccca gcactttggg aggccgaagc gggcggatca
2761 cctgaggtcg ggagttcgag accagcctga ccaacatgga gaaaccccgt ccctactaaa
2821 aatacaaaat tagccaggta tggtggtgca tacctgtaat cccagctact cgggaacctg
2881 aggcaggaga atggcttgaa cccaggagac agaggttgtg gtggggcaag atcgcaccat
2941 tgcacccgag cctaggcaac aagagtgaaa ttccgtctca aaaaaataaa taaataaata
3001 aataaataag ttaaaattaa ttctttatcc agagtcgggt gctttagaat ttataagtca
3061 cttatgtgtt ttgcttgaat taattctgac agcccctatg aggaaatctg gaggcaggta
3121 acagttccca ttttagagat gaagaactga ggcacagatt aaaggacttg cctgtgttga
3181 ataccagtcc tgttctagga cattctcccc tctcctagga gacggatgtc acgcacaaat
3241 ggggagagaa gtgtttattt tgtaggcact aagggtttct aaaaccctta acactggtaa
3301 gggctcaaaa ataaacgtat gtgttcatat tcgatcaccg aaatgagagt tcttaattgc
3361 taattgacaa acgcgttagc aatttcagtt agggagtcat ctcccttgat tgtgttcttt
3421 tcctgtcaat tttcatagac ctaatttgca aactcaatcg gggactaaaa tttcccactg
3481 aaaatgttaa acattttaga taactgtgaa gatagtttat ttttattcct tgccaatctg
3541 ggaatatgcc ttttttgtgt gtttgtgtgt ttttttaagt gctgtattaa taatactttc
3601 tgaaagaaaa ggacacttac cccaaaactt caatctgaaa tgtcttacat taagaatatc
3661 ttgaatgttg tgtatatatt ttaaaaagca ctttgcaaaa tagtttgtac atttatttcc
3721 taatttatac atgatttttg gtgttaatat atttaatgat taataacaga atgtttattt
3781 aatgtgctgt ccattttttat gtaatattat ggggaaagtg atgccagcag ttccttttca
3841 ttattctatc ttctgtcata tgaatgttga gcaaagctta ggccaacatg aattgtttgt
3901 gaagtgtggt tgatggtgct ttgttttttt ctgactactt ctatggaagg ccagtgaaga
3961 agcaaaggaa gacatgaaaa ttgacgctca ttcttcttcc tattgttccc tgacatccag
4021 caaattgtga atttgaaaaa tgatggccag ttttcagaag tgctgacaaa ttcatattgg
4081 tatgcaaaag ctcatcaccc attaaggttt gttgttgaat caacagtact cagcatatta
4141 aaacagtaca tcagaactca tgccaacagt ctttatgatg ggattaaggt ggacaagatc
4201 tcctaagatc tgtgaatggg attaaggtgg acaagatctc ctaagatctg aaaagaaacc
4261 ttaatacgct catatggttg gagtgttaag tgaacctctg attttgtcag ggtttttcta
4321 cgtgtaggcg tgaatagggg gcaccccttc aaaactgtac aaagaagacg actgttttcc
4381 atttccattt aaacattttt agccacttca tttctattta ttgaacaggt caaatttgtc
4441 ttgttatttg tgagtacagt acatttaaaa aacatcctta tcggttattt ttttttcagt
4501 cggagtttga cgtataaatt gtttatgctt ttggtgtaat ctcttaataa actggttctt
4561 caaaaatcat cctataaagt gagttttcat gaagaaaaaa aaaaaaaaaa aa
```

SEQ ID NO: 220 Human SS18L1 Amino Acid Sequence isoform 1 (NP_945173.1)

```
  1 msvafasarp rgkgevtqqt igkmldenhh liqcileyqs kgktaectqy gqilhrnlvy
 61 latiadsnqn mqsllpappt qnmnlgpgal tqsgsssqglh sqgslsdais tglppssllq
121 gqigngpshv smqqtapntl pttsmsisgp gyshagpasq gvpmqgqgti gnyvsrtnin
181 mqsnpvsmmq qqaatshyss agggsqhygg qssiammgqg sqgssmmgqr pmapyrpsqq
241 gssqqylgqe eyygeqyshs ggaaepmgqg yypdghgdya yqqssyteqs ydrsfeestq
301 hyyeggnsqy sqqqagyqqg aaqqqtysqq qypsqqsypg qqqgygsaqg apsgypgyqg
361 gqgqqygsyr apqtapsaqq qrpygyeqgq ygnyqq
```

TABLE 1-continued

SEQ ID NO: 221 Human SS18L1 cDNA Sequence variant 2 (NM_001301778.1; CDS: 600-1397)

```
   1 cttccccccc tccgcgactg cggataatga gcgcctcggg ccgcccagcg cagccggagt
  61 atccacctcg atgaccacgg gctgagcccc gcgccgccac catgtccgtg gccttcgcgt
 121 ctgcccggcc aagaggcaaa ggggaggtta cgcagcaaac catccagaag tttttgaaga
 181 atgccggcca gtcatcgagt gcccttggtt tgggtacaag gtgcgttttc ctaacttgcg
 241 ggtctgaaag tgcgtccatt ccccccttcac gcctggttgc ggtttcggcg gactagaatt
 301 tctacgcaga agtctccctc aggatcagac cgtagccctt ccggaaacct ccatgatgct
 361 ggacgagaac caccacctga tccagtgcat cctggagtac cagagcaagg gcaagacggc
 421 cgagtgcacg cagtaccagc agatcctgca ccggaacctg gtatacctgg ccacgatcgc
 481 agactccaac cagaacatgc agtccctgct tcctgcccct gagtgacgcc atcagcacgg
 541 gcctgccacc ctcctccctc ctgcagggcc agattggcaa cgggccgagc cacgtgtcca
 601 tgcagcagac ggcgcctaac acgctgccca ccacctccat gagcatctct gggcccggct
 661 acagccacgc gggacccgcc tcgcagggcg tccccatgca ggggcaaggc accatcggca
 721 actacgtgtc tcggaccaac atcaacatgc agtccaaccc agtctccatg atgcagcagc
 781 aggcggccac gtcgcactac agctcggcgc agggcggcag ccagcactac cagggccagt
 841 cgtccatcgc catgatgggg cagggcagcc aggggagcag catgatgggg cagcggccca
 901 tggcgcccta ccggccctcc cagcaaggct cttcccagca gtacctgggc caggaggagt
 961 actatggcga gcagtacagc cacagccagg gcgccgcgga gcccatgggc cagcagtact
1021 accccgacgg ccatggcgat tacgcctacc agcagtcatc ctacacggag cagagctacg
1081 accggtcctt cgaggagtcc acgcagcact actatgaggg gggaaactcc cagtacagcc
1141 agcagcaggc cgggtaccag cagggtgccg cgcagcagca gacgtactcc cagcagcagt
1201 accccagcca gcagagctac cccgggcagc agcagggcta cgggtctgcc cagggagccc
1261 cgtcacagta ccccggctac cagcaaggcc aaggccagca gtacggaagc taccgagcac
1321 cgcagacagc gccgtctgcc cagcagcagc ggccctacgg ctatgaacag ggccagtatg
1381 gaaattacca gcagtaaggg acacacattc tggctggagc ccttgtggta gcgtgttcat
1441 ccaggggccg gatgggctgg cggcagctct ggtgaattgt gacatgttgg ttacctgttc
1501 gcccagtgcc acgtctgcat gtgaagcgtg ctcatttcat gctgggtatg acgccgagcg
1561 cacaccactg gcgtgagaca gcgcttggtg gtgtgatact tttggtgctg tgtatagtat
1621 tgtatgtcgg tacacggaga ggtatccttt ttttgtcccc cgccccccttc tcaatgtttc
1681 tagctagctt tgggggtcat tttgtcatca gagcattctg tgcccaggga caggacagat
1741 ctcgaggaca ccacagtcca cctgttcccg tcaacagacg ttaggtctca ttttcctcct
1801 catgcagtgt tgtagtgtgg gttgtcaact tttctttaac tggctacgcc acagctggac
1861 acacatgcag cccctggagg gcagcctctt cctgtgcctc gatggggtgg gtgggagggc
1921 atcttctgtg cgttgggtca gtttctgtta cgtaacgaaa aggataaaca tctcccacgg
1981 gagaggccac agatggccac ttccagagct tgcccattgc ctgtctctcg ccaattccgt
2041 ttatccaaaa aggtacatgt ttttgtatta aaaagtaaac agggatcagt gactgtattc
2101 caaataaata tgaatcccta agggccgtgg acaaattgcc taacccaggg ccagcggtat
2161 tgctgaagga aaggggcagc tctctgggaa gtgggccctc agagattact ctggctttga
2221 cccttgttta gctgatggtc atttctggga ttggaatatt taataagccc aattctaagt
2281 tgataggtaa ttttaaatat tcaaaccaaa tcttcccaac agttggcaag ttgtttattt
2341 tatattattt cttccaggac ctacttgctc agatctccaa gcaagcattt cttttctttt
2401 agggatgtct gaaagtcaca tccagttaca ttactgtgtt ctttctaatg aaaagtaaag
2461 gttttatata gagaaacttg agtaattttt acatttctaa gacattaaat cccatttaaa
2521 ttctgtgtga acattaaaga cagcacactt gcaaaagtat ggtcaaagga aaaaaatccc
2581 acatttcaat taacaagtag catggacatt tgatcaacct ttagttggaa taataatatt
2641 catatttgct atgaatcctt ttaaaaaaat ctttggataa atgctgacag atttccaaga
2701 actaccaaga aaatacaaga gatatccaat gcttgatata tgaggcctag taataacgat
2761 atttctcttt aattgatgtt ttgttttaaa agttaaaagt aattcttggc gtggtggttc
2821 acgcctgtaa tcccagcact ttgggaggcc gaagcggcg gatcacctga ggtcgggagt
2881 tcgagaccag cctgaccaac atggagaaac cccgtcccta ctaaaaatac aaaattagcc
2941 aggtatggtg gtgcatacct gtaatcccag ctactcggga acctgaggca ggagaatggc
3001 ttgaacccag gagacagagg ttgtggtggg gcaagatcgc accattgcac ccgagcctag
3061 gcaacaagag tgaaattccg tctcaaaaaa ataaataaat aaataaataa ataagttaaa
3121 attaattctt tatccagagt cgggtgcttt agaatttata agtcacttat gtgttttgct
3181 tgaattaatt ctgacagccc ctatgaggaa atctggaggc aggtaacagt tcccatttta
3241 gagatgaaga actgaggcac agattaaagg acttgcctgt gttgaatacc agtcctgttc
3301 taggacattc tcccctctcc taggagacgg atgtcacgca caaatgggga gagaagtgtt
3361 tattttgtag gcactaaggg tttctaaaac ccttaacact ggtaagggct caaaaataaa
3421 cgtatgtgtt catattcgat caccgaaatg agagttctta attgctaatt gacaaacgcg
3481 ttagcaattt cagttaggga gtcatctccc ttgattgtgt tcttttcctg tcaattttca
3541 tagacctaat ttgcaaactc aatcggggac taaaatttcc cactgaaaat gttaaacatt
3601 ttagataact gtgaagatag tttattttta ttccttgcca atctgggaat atgccttttt
3661 tgtgtgtttg tgtgtttttt taagtgctgt attaataata ctttctgaaa gaaaaggaca
3721 cttaccccaa aacttcaatc tgaaatgtct tacattaaga atatcttgaa tgttgtgtat
3781 atattttaaa aagcactttg caaaatagtt tgtacattta tttcctaatt tatacatgat
3841 ttttggtgtt aatatattta atgattaata acagaatgtt tatttaatgt gctgtccatt
3901 tttatgtaat attatgggga aagtgatgcc agcagttcct tttcattatt ctatcttctg
3961 tcatatgaat gttgagcaaa gcttaggcca acatgaattg tttgtgaagt gtggttgatg
4021 gtgctttgtt tttttctgac tacttctatg gaaggccagt gaagaagcaa aggaagacat
4081 gaaaattgac gctcattctt cttcctattg ttccctgaca tccagcaaat tgtgaatttg
4141 aaaaatgatg gccagttttc agaagtgctg acaaattcat attggtatgc aaaagctcat
4201 cacccattaa ggtttgttgt tgaatcaaca gtactcagca tattaaaaca gtacatcaga
4261 actcatgcca acagtcttta tgatgggatt aaggtggaca agatctccta agatctgtga
```

TABLE 1-continued

```
4321 atgggattaa ggtggacaag atctcctaag atctgaaaag aaaccttaat acgctcatat
4381 ggttggagtg ttaagtgaac ctctgatttt gtcagggttt ttctacgtgt aggcgtgaat
4441 agggggcacc ccttcaaaac tgtacaaaga agacgactgt tttccatttc catttaaaca
4501 tttttagcca cttcatttct atttattgaa caggtcaaat ttgtcttgtt atttgtgagt
4561 acagtacatt taaaaaacat ccttatcggt tatttttttt tcagtcggag tttgacgtat
4621 aaattgttta tgcttttggt gtaatctctt aataaactgg ttcttcaaaa atcatcctat
4681 aaagtgagtt ttcatgaaga aaaaaaaaaa aaaaaaa
```

SEQ ID NO: 222 Human SS18L1 Amino Acid Sequence isoform 2 (NP_001288707.1)

```
  1 mqqtapntlp ttsmsisgpg yshagpasqg vpmqgqgtig nyvsrtninm qsnpvsmmqg
 61 qaatshyssa qggsqhyggq ssiammgqgs qgssmmgqrp mapyrpsqqg ssqqylgqee
121 yygegyshsq gaaepmgqqy ypdghgdyay qqssytegsy drsfeestqh yyeggnsqys
181 qqqagyqqga aqqqtysqqq ypsqqsypgq qqgygsagga psqypgyqqg qgqqygsyra
241 pqtapsaqqg rpygyeggqy gnyqq
```

SEQ ID NO: 223 Mouse SS18L1 cDNA Sequence (NM_178750.5; CDS: 318-1526)

```
   1 ggcacggcgg ggcggggcag ggcgggcgga accaccgaag ctcagcacag gggcggtgt
  61 accggctacc ggctggacga agagcgcagg ccgggtgcag ggggcctccg cgcggtatcc
 121 tgacctggga ggcagtcgcg taaggcgtgg ggacgcgggg gactcgagcg cgcattggcg
 181 acaggcaggc gggcgagccc acggcaccgc gccccccgtg tccccgcccc cgctctgcgg
 241 agaatgggca cctcgggccg cggggcgcag ccggagaata aaccccaatg atcacgggct
 301 gagtccgcgc caccaccatg tccgtggcct tcgcgtcggc gcggccgaga ggcaaagggg
 361 aggtcactca gcagaccatc cagaagatgc tggatgagaa ccaccacctg atccagtgca
 421 tcctggacta ccagagcaag ggcaagaccg ccgagtgcac gcagtaccag cagatcctgc
 481 accggaacct ggtctaccta gccaccatag cagactccaa tcagaacatg cagtccctgc
 541 ttcccgcgcc tccaacacag aacatgaacc tcgggcccgg agcactgagt cagagtggtt
 601 ccagccaggg cctgcacccc cagggcagcc tcagcgatac cgtcagcaca ggcctgcccc
 661 ccgcctccct catgcagggc cagatcggta acggtccaaa ccacgtgtcc atgcagcaga
 721 cggctcagag cacactgccc acaacctcca tgagcttgtc aggcagtggc catggtactg
 781 gccctgggta cagccactcg gggcctacct cgcagagtgt ccccatgcaa ggccaaggtg
 841 ccatcagcaa ctatgtgtct cggaccaaca tcaacatgca gtctaaccca gtctccatga
 901 tgcaccagca ggcagccacg tcccactaca actcagcaca gggtggaagc cagcattacc
 961 agggccaggc acccattgcc atgatgggcc agggtggcca aggaggcagc atgatggggc
1021 agcggcccat ggcgccctac agaccctccc agcaaggctc ttcccagcag tacctgggcc
1081 aagaggagta ctacagcgaa cagtacagcc acagccaggg ctccgcagag cccatgagtc
1141 aacagtacta cccggatggc cacggtgact acgcctatca gcagtcgtcc tacacagagc
1201 agagctacga ccgctccttt gaggatccca cacagcacta ctacgagggg ggaaactccc
1261 agtacagtca gcagcaggct gggtaccagc agggcacagc acagcagcag acctactccc
1321 agcaacagta tcccaaccag cagagctacc cggggcagca gcagggctac ggtcctgccc
1381 agggagcccc ctcacagtac tcaagctacc agcaaggaca aggtcagcag tatggaagct
1441 acagaacatc gcagacggga ccttctgccc agcagcagcg gccttacggc tatgaacagg
1501 gccagtatgg aaattaccag caataaagaa caagcattgt ctttggaccc ttcatagtag
1561 tatgttctgg acaagccggt ggcagttctg atgagtagcg acatgttggt caccctctct
1621 gcccagtgcc gtgtctgcat gagaggcagg ctggtttcat gctgggcgtg atgctgtgtg
1681 caccactgac tgcgatatgg cgtgacatgt ctggtgctgt gtaaagtatt gtatatcggt
1741 acgatgggga ggttgtcctg tttgtgtccc ctgcccgctc cctgatgttc ttagctagct
1801 tggggggggg ttaccgtgtc atcacatgtt ctgtgcctgg tgatgagaca atgtctaaga
1861 gacatcatgg tccatgctgc tgtgaacaga ctcagtctgc cccctctcat accattgttg
1921 caaagtggac tgtaaatgtt tcttcaactg gcggctcata gcttgacata catacaccgc
1981 taggtgacca tttcttctgt gcctaagtag ggcttgagga caccttctgt gtcttgggtc
2041 atgtcactat aacaaggaag atgtgctttg tgtgcaagga ccatgagctg tcctttccag
2101 aacttaccaa ttgcctgtgt ctctccagtt tccatgatcc caaaggatgt ctttgtatta
2161 gcgagtaaag aaggatcgat gactattcca aatgacagtc ggtgagagtg tgggcatcgt
2221 gaggggagct ttcactaagg agggcgctgt ctgaagagca attcttgctg tctccgagct
2281 gcttgtgtgt agtatggctt tggcccttgg cgtcatctct aggatttgag tgtgcccaaa
2341 cctaagttta tagagaattt aaagtactca tgtttaattt tacaagcagt tggcaagtgt
2401 ttatattact tcttcaggac ctctgagttc agattgccaa gcagatgttc ctttgcgttt
2461 agggaagtct gaaatccaca ctgcattttt aatgaatcca aataacttta ttacgttctt
2521 tcaaatgaaa aggacaagtt ttatacagtg agaattgggt gatttttttt ttttttacat
2581 tcctaggatg tttaatctcg ttttaattct gtgcaaacat gagagacagc ctttttgaaa
2641 aggttctatc aaaggaaaac accgcatata atgcagcagg catatttttc agcatttatt
2701 tagataataa caatgttact atgagaagaa aagaacaacc ttgaagatga gtgctcagaa
2761 caaccaagaa catacaaaac catccccaag gatgcagggc ttggtacatc agacctgtcc
2821 accaggatgc ttttgcttta tttgtgtctt atatgtagcc cagactggcc tcaaactcac
2881 tacatagctg aggctgaact taatgatccc ccagcctcca ctcccgggta ctgagaccac
2941 gggcatgcac caccacatct gttttcagct gatagttttt aaaatataaa acttacctgt
3001 agctcagtag taaggcacct ttgtggagtt tgcttgaatt aatcttgaca gtcttgctgg
3061 aacttacagt gcaagctcca tttacttaca ggagaatcaa gggccggatc aaaggacttg
3121 tctgtgtcgg ctgccgtctt actctaggac attctccctc tccttgggac cattatcaac
3181 aaccatgggc atatgtgtct cataggcaca gggtttagga aacacacagg caagggctga
3241 ctacatgacg gctttaactt tacagaaaca agtttctgat cgctacatgg cagaagtatt
3301 agcaacttga ttttagggac tcatcatctc tttagctcct tccctttctg gcaattttta
3361 taaaactagc ctacaagctc acttgggggc taaatatccc attgaaaatg tcgaaacatt
3421 ttaagtaact gtgaaatggt ttttattcct tgccaatctg ggaatatgcc ttttatgtat
3481 gcatacatgt gcaagtgtgt acgtgtgtgt gtgtgtgtgt gtgtgtatgt atgtgtgtgt
3541 atgtgtgtat atatatgtgt gtatgttaaa gtgctgtatt agtgtgtatg tgtgtgtgta
3601 tatgtaaagt gctgtgttag tgtgtgttaa tactttttga aagaaaagaa cacttaaaat
3661 atgtatcacc ccaaaagttc aatttgaaat gtcttacatt aagaatttct tgaatgttgt
3721 gtatatattt ttaaaagcac tttgtgaaat agtttgtaca tttatttcct aatttatacc
3781 tgattttggt gttaatatat ttaatgatta atattgttta tttaatgttt tattgatttt
```

TABLE 1-continued

```
3841 tatgtaattt tgtgggggaa agtgatgcca gtctttttca ttgcctgtat tatagctttt
3901 cttctgtaac atgaatgttt gaaaagtcct aggctgaaat gaacccttcg tgcaggtgtg
3961 gttgactgtg ttttgttttc aatggttcct cctactgaag gccagaaaag atgcaaaggg
4021 agatttggaa atcgctgctc attcttcctc ctgtttccca gcatccgttc aatacttggt
4081 gaacttgacc actgaggact ggggttttca gatgtgctga ccactacgcg ctgcgcttgt
4141 caggggctat gggtggatgg acatctctgc agacttagca tatagcacag tgggagatgg
4201 gagatgtccg cagaggcact gggcagacac aggcctggcc cagaaaggag gtgttttcct
4261 ttcctgttgt acctgttctc agacgtgggc ttcagtgact gagtgtccgt tcaaacttgt
4321 aaaaagagga agactttcca tttccattaa aacacttttt tagccattaa aaaaaaaaaa
4381 aaaaaaaaaa aaaaa
```

SEQ ID NO: 224 Mouse SS18L1 Amino Acid Sequence (NP_848865.4)

```
  1 msvafasarp rgkgevtqqt igkmldenhh liqcildyqs kgktaectqy qqilhrnlvy
 61 latiadsnqn mqsllpappt qnmnlgpgal sqsgssqglh pqgslsdtvs tglppaslmq
121 gqigngpnhv smqqtagstl pttsmslsgs ghgtgpgysh sgptsqsvpm qgqgaisnyv
181 srtninmqsn pvsmmhqqaa tshynsaqgg sqhyqgqapi ammgqggqgg smmgqrpmap
241 yrpsqqgssq qylgqeeyys eqyshsggsa epmsqqyypd ghgdyayqqs syteqsydrs
301 fedptqhyye ggnsgysqqq agyqqgtagq qtysqqqypn qqsypgqqqg ygpaqgapsq
361 yssyqqgqgq qygsyrtsqt gpsaqqqrpy gyeqgqygny qg
```

SEQ ID NO: 225 Human GLTSCR1 cDNA Sequence (NM_015711.3; CDS: 195-4877)

```
   1 gcgcggccag agcggccggg gacaggctcc gaggcaggcc cgacccgcct ccccggcgcc
  61 gccgtggctc gacggagacc agctaggctg gcccccaaga ggaccctttc caagtcccca
 121 gctgggggcc ctgtgtagac ctggagtgga cacgcccctc cttcccttca tgattcgttt
 181 gtagcgcagt ggcgatggat gatgaggatg ggagatgctt actagacgtg atttgtgacc
 241 cacaggccct caatgacttc ttgcatggat ccgagaagct tgacagtgat gacctcctgg
 301 ataatcccgg ggaggcccaa agtgccttct atgaaggtcc tgggctccat gtgcaagaag
 361 cttccggcaa ccacctgaac ccagagccca accagccggc cccagtgtg gacctagact
 421 tcctggaaga tgacatcctg ggctctcctg cgacaggggg cggcggcggg ggcagtgggg
 481 gcgctgacca gccctgtgac atcctccagc agagcctcca agaggccaac atcacggagc
 541 agacgctgga ggccgaggct gagctggacc tgggtccctt ccagctgccc accctgcagc
 601 ctgcggatgg cggggcaggc ccgacgggcg ctggaggggc agcggccgtg gctgcggggc
 661 cccaagccct cttcccaggc agcaccgacc tgctggggct gcagggcccg cctaccgtgc
 721 tgacccacca ggccctggtg ccgccccagg acgtggtcaa caaggccctg agtgtgcagc
 781 ccttcctgca gcctgtgggc ctgggcaatg tgacactgca gcccatcccg ggcctccaag
 841 gcctgcccaa tggcagccct gggggtgcca cggcggccac actgggcctg gcgcccatcc
 901 aggtggtggg ccagcccgtc atggcgctca acacgcccac ctcccagctc ctggccaagc
 961 aggtgcccgt cagcggctac ctggcctcgg cggctggccc ctcggagccc gtgacgctgg
1021 cgtcggccgg tgtctcgcca caggggggctg gcctggtcat ccagaagaac ctctcggccg
1081 ctgtggccac cacgctcaat gggaactctg tgttcggagg cgcgggggcc gcctcggctc
1141 ccaccgggac gccctcggga cagccgctgg cggtggcccc aggcctcggc tcgtcgccac
1201 tggtcccggc gcccaacgtg atcctgcatc gcacacccac gcccatccag cccaagcccg
1261 cgggggtgct gccgcccaag ctctaccagc tgacgcccaa gccgtttgcg cccgcgggcg
1321 ccacgctcac catccagggc gagccggggg cgctcccgca gcagcccaag gccccgcaga
1381 acctgacgtt catggcgggc gggaaggcgg gccagaacgt ggtgctgtcg ggcttccccg
1441 cgcctgcgct gcaagcgaac gtcttcaagc agccaccggc caccaccacc ggagcggccc
1501 cgccgcagcc ccccggggcc ctgagcaaac ccatgagcgt ccacctcctg aaccaaggca
1561 gcagcatcgt catccccgcc cagcacatgc tgccgggcca gaaccagttc ctactgcctg
1621 gcgccccggc ggtccagctc ccgcagcagc tctcagccct gccggccaac gtgggcgggc
1681 agatcctggc ggccgctgcc ccccacacag gtggacagct catcgcgaac cccatcctca
1741 caaaccagaa cctggcgggc ccactgagcc tgggccccgt gttggccccc cactccgggg
1801 cccacagcgc gcacatcctc tccgccgctc ccatccaggt gggccagcct gcgctcttcc
1861 agatgcccgt gtcgctggcg gcgggcagcc tgcccacgca gagccagcca gcgcccgccg
1921 ggccggccgc caccactgtc ctccaggggg tcaccctgcc ccccagcgcc gtggccatgc
1981 tcaacacccc cgacggcctg gtgcagccgg ccacccctgc cgctgccacc ggggaggccg
2041 cgcctgtcct cacggtgcag cctgcccccc aggcgccccc cgcggtcagc acacccctgc
2101 ccctgggcct ccagcagccg caggcgcagc agcccccgca ggcccccacc ccacaggccg
2161 ccgcccccgc tcaggccacc accccccagc ccagccctgg cctggcgtct agcccggaga
2221 agatcgtcct ggggcagccg ccctctgcca cccccacggc catcctcact caggactccc
2281 tgcagatgtt cctgccccag gagaggagcc agcagcccct ctccgcagag ggcccccacc
2341 tctccgtgcc tgcctcggtc atagtcagcg ccccgcctcc cgcccaagac ccagccccag
2401 ccacccccgt cgccaaagga gctggcctcg gccctcaggc ccccgacagc caggcttccc
2461 cggctccggc cccccagatc ccggcagcgg ctccgctgaa gggcccaggc ccctcttcgt
2521 ccccgtcact acctcaccag gcccctctgg gggacagccc ccacctgccc tccccacacc
2581 ccacccggcc cccttcccgc ccaccctccc ggccacagag tgtgtcccgc cctccctcag
2641 agccacccct gcacccttgc cccccacccc aggcccccccc aactctgcct ggcatctttg
2701 tcatccaaaa ccagctaggc gttcccccgc ctgccagcaa cccggcccct actgccccag
2761 gcccgccgca gccgcctctc cgcccccagt cccagccgcc tgagggaccg ctgcccccag
2821 ccccccacct ccctccatcc tccacctcct ctgctgtggc ctcctcctct gagacgtcct
2881 ccaggttgcc agcccctacg ccatccgact tccagctcca gttcccaccc agccaggggc
2941 cccacaagtc ccccactccc cctccaaccc tccacctggt ccctgagccg gcagcacccc
3001 ccccaccgcc tcctcggacc ttccagatgg tgaccacccc cttcccagcg ctgccccagc
3061 cgaaggctct tctcgagaga tttcaccagg tgccgtccgg aatcatcctc cagaacaagg
3121 ctgggggggc ccctgccgcc ccgcagacct ccaccagcct ggggcccctc accagccccg
3181 ctgcgtctgt gctggtcagt gggcaggccc catctgggac ccccactgcc cccagccacg
3241 cccccgcccc ggcacccatg gccgccacag gcctccctcc tctgcttcca gccgagaaca
3301 aggcttttgc cagcaacctc ccgaccctga atgtggccaa ggccgcttcc tccgggccag
3361 ggaagccctc cgggctgcag tatgagagca aactgagtgg cctgaagaag ccccccacgc
3421 ttcagcccag caaggaagcc tgtttcctgg agcatttgca caaacaccag ggctccgtcc
3481 tgcaccccga ctacaagacg gccttcccct cctttgagga cgccctgcat cgcctcctgc
```

TABLE 1-continued

```
3541 cctaccatgt ctaccagggc gccctcccct cccccagtga ctaccacaaa gtggacgagg
3601 agtttgagac ggtctccacg cagctgctga aacgcaccca ggccatgctc aataaatatc
3661 ggctcctgct cctggaggag tcccggaggg tgagcccctc agcggagatg gtaatgatcg
3721 accgaatgtt cattcaggag gagaagacca ccccttgcctt ggataaacag ctggccaagg
3781 agaagccgga cgagtacgtg tcttcctccc gctcgctcgg cctccccatc gcagcctctt
3841 ccgagggtca tcggcttccc ggccacggcc ccctgtcgtc ttcagctccc ggggcctcca
3901 cccagccccc tccacacctg cccaccaagc ttgtgatccg gcacggcggg gcaggcggct
3961 ccccttcggt cacctgggcc cgggcgtcct cctccctgtc ctcctcttcc tcctcctcct
4021 ctgccgcctc ctccttggac gccgacgagg acggccccat gccctcccgc aaccgcccgc
4081 ccatcaagac ctacgaggcc cggagccgca tcgggctcaa gctcaagatc aagcaggaag
4141 ccgggctcag caaggtcgtg cacaacacgg ccctggaccc cgtgcaccag cccccgccac
4201 cccccgctac cctcaaggtg gccgagcccc cgccacggcc gccaccacca ccgccgccca
4261 cgggccagat gaacggcacg gtggaccacc cgccgcctgc cgccccgag cgcaagcccc
4321 tgggcaccgc cccgcactgc ccgcgcctgc cactgcgcaa gacctaccgc gagaacgtgg
4381 ggggccctgg cgcgccggag gggacgcccg caggcagggc acggggaggc agcccggcgc
4441 cgctgcccgc caaagtggac gaggccacca gcgggctcat ccgcgagctg gcggccgtgg
4501 aggacgagct gtaccagcgt atgctgaagg gcccccgcc agagcccgca gccagcgccg
4561 cccaaggcac cggggacccc gactgggagg cgcccgggct gcccctgcc aagcggcgca
4621 agtccgagtc gcccgacgtg gaccaggcca gcttctccag cgacagcccg caggatgaca
4681 cgctcaccga gcacctgcag agcgccatcg acagcatcct gaacctgcag caggccccg
4741 gccggacgcc cgcgccctcg tacccccacg ctgcctcggc cggcaccccc gcatccccgc
4801 cgcccctgca caggcccgag gcctacccac cctccagtca caacggtggc ctcggcgcca
4861 ggacgttgac cagataacac cgggccgcct ccccttcccc gtcccctcct cccgaagacg
4921 ccgggacagt cgggtgtccg ccctcagcct cctggggact cgagccgggg atcccctgac
4981 ggtttttctt gcctaagtta tttgagtcac aaaggcctcc ttccctgccg cctgcttcag
5041 ctgggttgct ggggggtggg cgtggattta gggagggggc tgtgatgtaa aacgtctccc
5101 ctgccaaagg aggggcaaag tgctgtgtca gttcctgttt cttcccattt cctggcacac
5161 tctgcccctc tgtccggggg acacgcgcat gtgtttgcca gggatggggc caccgggttg
5221 atgccaacgc tccgggtgcc tgtcttgtct gtgtggcttc tcagatggtg gagggtgctg
5281 ggagctggca gggtccttcc agacagtctc agcctctccc cgccgccccc aacaggctgt
5341 caaacaaaac cggagagggg gtgggggagc cagcctccca gcgtgctgtg cccgcaggca
5401 cccgtgtgac atccgcacgt ccagctccgt gacctgtgtg tgtgtgtgtg tgcacaagtg
5461 agtgagagat ttcgaacgcc cacccctcga ctttgaaatc tgagcaaaac aagaaactgg
5521 ggtcttcctc tcccccgaac ctctccccag ctagtcttcc ctctgttctt cctgcctcca
5581 gccgcccgcg ccagattttg aaatctcgga gacaaaacta gtactgtaag ataaattttt
5641 ttgtactgta tttattgtgt ataacgattt ttttaaagga gaattctgta catttagaac
5701 tcttgtaaat taaaaaccga tcctttttttt aaaactgtaa a
```

SEQ ID NO: 226 Human GLTSCR1 Amino Acid Sequence (NP_056526.3)

```
   1 mdddedgrcll dvicdpqaln dflhgsekld sddlldnpge aqsafyegpg lhvgeasgnh
  61 lnpepngpap svdldfledd ilgspatggg gggsggadqp cdilqqslqe aniteqtlea
 121 eaeldlgpfq lptlqpadgg agptgaggaa avaagpqalf pgstdllglq gpptvlthqa
 181 lvppqdvvnk alsvqpflqp vglgnvtlqp ipglqglpng spggataatl glapiqvvgq
 241 pvmalntpts qllakqvpvs gylasaagps epvtlasagv spqgaglviq knlsaavatt
 301 lngnsvfgga gaasaptgtp sgqplavapg lgssplvpap nvilhrtptp iqpkpagvlp
 361 pklyqltpkp fapagatlti qgepgalpqg pkapqnitfm aagkagqnvv lsgfpapalq
 421 anvfkqppat ttgaappqpp galskpmsvh llnqgssivi paqhmlpgqn qfllpgapav
 481 qlpqqlsalp anvggqilaa aaphtgggli anpiltnqnl agplslgpvl aphsgahsah
 541 ilsaapiqvg qpalfqmpvs laagslptqs qpapagpaat tvlqgvtlpp savamlntpd
 601 glvqpatpaa atgeaapvlt vqpapqappa vstplplglq qpqaqqppqa ptpqaaappq
 661 attpqpspgl asspekivlg qppsatptai ltqdslqmfl pgersqqpls aegphlsvpa
 721 svivsapppa qdpapatpva kgaglgpqap dsqaspapap qipaaaplkg pgpssspslp
 781 hqaplgdsph lpsphptrpp srppsrpqsv srppsepplh pcpppqappt lpgifvignq
 841 lgvpppasnp aptapgppqp plrpqsqppe gplppaphlp psstssavas ssetssrlpa
 901 ptpsdfqlqf ppsqgphksp tppptlhlvp epaapppppp rtfqmvttpf palpqpkall
 961 erfhqvpsgi ilqnkaggap aapqtstslg pltspaasvl vsgqapsgtp tapshapapa
1021 pmaatglppl lpaenkafas nlptlnvaka assgpgkpsg lgyesklsgl kkpptlqpsk
1081 eacflehlhk hqgsvlhpdy ktafpsfeda lhrllpyhvy qgalpspsdy hkvdeefetv
1141 stqllkrtqa mlnkyrllll eesrrvspsa emvmidrmfi qeekttlald kqlakekpde
1201 yvsssrslgl piaasseghr lpghgplsss apgastqppp hlptklvirh ggaggspsvt
1261 warassslss ssssssaass ldadedgpmp srnrppikty earsriglkl kikqeaglsk
1321 vvhntaldpv hqpppppatl kvaeppprpp pppptgqmn gtvdhpppaa perkplgtap
1381 hcprlplrkt yrenvggpga pegtpagrar ggspaplpak vdeatsglir elaavedely
1441 qrmlkgpppe paasaaqgtg dpdweapglp pakrrksesp dvdgasfssd spqddtlteh
1501 lqsaidsiln lqqapgrtpa psyphaasag tpaspppplhr peayppsshn gglgartltr
```

SEQ ID NO: 227 Mouse GLTSCR1 cDNA Sequence (NM_001081418.1; CDS: 108-4844)

```
   1 gctggcccca caaaggacat tatcaaagtc cccagcctgg ggccctgtgt agacctggag
  61 tggccaccgc acccttccct tcatgattcg ttcatagcac agtggaaatg gatgatgagg
 121 atgggagatg cttactagac gtgatttgtg atcctcaggc cctcaatgat ttcttgcatg
 181 gatccgagaa gctggacagc gatgacctcc tggatgcccc tgtggaggcc caaagtgcct
 241 tctatgaagg tcctgggctc catgtgcagg aagctgccgc caaccaccta aaccctgagc
 301 ccagccagcc tgcccccagc gtggacctgg acttcctaga agatgatatc ttgggctccc
 361 ctgcagcagg aggaggtgga gggggcggcg gggccccaga ccagccctgt gacatccttc
 421 agcagagtct tcaggaggcc aacatcacag aacagaccct ggaggctgag gctgaactgg
 481 acctgggccc cttccagctg cccaccctac agcccgctga caatggggca ggtgctactg
 541 gagccgcagg agccacggca gtgactgcag gaccccaggc tctcttccca ggcagcgcgg
 601 atctgctggg gctgcaagcc ccgcccactg tactgaccca ccaggccctg gtgccacccc
 661 aggatgtggt caacaaggcc ttgagcgtcc agcccttcct gcagcctgtg ggcctgggca
```

TABLE 1-continued

```
 721 atgtgaccct tcagcccatt tcaggcctcc agggccttcc caatggcagt cctgggaatg
 781 ctgcagcagc caccttgggt ctgacaccta ttcaagtggt gggccagccc gtcatggctc
 841 tcaacccacc cacctcccag ctcttggcaa agcaggtacc tgtcagtggc tacctggcct
 901 cagcagctgg tccttcagag ccagtgacac tggcatctgc cggcgtgtcc ccccagggag
 961 ccggcctggt catccagaaa aatcttccag ccgcagtgac caccacactc aacgggaact
1021 cggtgtttgc cgggacaggg gctgccactg cagcagccag tggggcaccc tcgggacagc
1081 cgctggcggt ggccccgggc cttggcacat caccactggt acaagcaccc agtgtgattt
1141 tacacagaac ccctacgcct atccagccca agcctacagg ggtcctgccc tccaaactct
1201 accagctgac acccaagccc tttcccccta ccggagccac ccttaccatc cagggtgaac
1261 caggcacctt gccccagcag cctaaggccc cccagaacct gacttttatg gccacgggca
1321 aagctggcca gaatgtggtg ctgtctggct tcccggcacc ggctttgcag gcgaatgtgt
1381 tcaagcagcc accagtcacc accacgggga cagccccgcc acagccacca ggggccctca
1441 gcaaacccat gagcgtccac ctcctcaatc aaggcagcag catcgtgatc ccagcccagc
1501 acatgctgcc tggccagaac cagttcttgc tgccaggcac cccagccgta caactccctc
1561 agtcactctc tgcactgcct gccaacgtgg gaggccagat cctcacagct gcagcaccac
1621 acgcaggtgg acagctcatt gccaacccta tcctcaccaa ccagaacctg gcaggcccac
1681 tgagtctggg cccagtgctg gcaccccact ctggggcaca cagcgctgca cacatcctct
1741 ctgcagctcc catccaggtg ggccagcctg ccctcttcca gatgcctgtg tcactggcca
1801 ctggcagcct gcctactcag agccagccgg ctcccactgg ccccacagcc accaccgtcc
1861 tccagggcgt caccctgcct cccagtgctg tggccatgct taacacgcct gatgggctag
1921 tgcaaccctc cactccagct gccaccactg gggaggccac accagttctg gccgttcagc
1981 ctgcaaccca ggtgccccct gctgtcacca caccactgcc tatgggtctc caacagccac
2041 aggcacagca gcctccacag gtccctactc cacaggcggc cacccagcct caggccaccc
2101 ctcctcaggc cagcccaagc ctggcttcca gcccagagaa gatagtcctg gggcaggcgc
2161 cccctgcggc cacaacggcc atcctcactc aggattccct acagatgttc ctgccccagg
2221 agaggagcca gcagcccctc tctacagagg gtccccacct ctcggtgcct gcctccgtca
2281 tagtcagcgc cccgcctcct gcccaagacc cagccctggc cacgcccgtc accaaaggag
2341 ctggcctcgg cgctcagacc ccggacagcc gggcttcccc agctccggct ccccagatcc
2401 ctgcagctgc tccactgaaa gcccctggcc ccgcctcctc cccctcacta cctcaccagg
2461 ccccccctggg agacagtccc cacatgccct ccccacaccc tgccaggccc ccttcccgcc
2521 caccctcaag accccactca cgccctccat cccagcccca gagcctgacc tgcccaccct
2581 ctgagcccac cctgcaccct tgccctccac cccagggtcc cccaactcta cctggcatct
2641 ttgtcatcca gaatcaattg ggcgccccac caccagccag caccccagcc tccacagccc
2701 cgggcccacc ccagcctcct ctgcgacccc catcccagcc tccagagggc ccactgcccc
2761 cagcctccca cctccctcct gcctccaccc cctcggccgt ggcctcctcc tctgagcctt
2821 ctgccaggtt gccggtcccc acacccccctg acttccaact ccagttccca ccgagccagg
2881 gaccccataa gtcccctact ccgccaccag ccctccacat ggtccctgag cccacggcac
2941 cccctcctcc accacctcgg accttccaga tggtaaccgc ccccttccca gcgttgcccc
3001 agccaaaagc acttctggaa cgattccacc aggtgccatc tgggattatt ctccagaata
3061 aggctggggg tactcccacc accccacaga catccaccac cctggggacc ctcaccggtc
3121 ctactgcctc tgtgctagtc agtggacagg caccacctgg gactcctgcc gcctctagcc
3181 atgtcccagc ctccacacct atggccacca caggcctccc tcctctactt cctgccgaaa
3241 acaaagcttt tgccagcaac cttccaaccc tgagtgtggc caaagctacc gtgtctgggc
3301 cagggaagcc cccagcaatt cagtatgaca gcaagttgtg tagcttgaag aaacagcccc
3361 tactgcaacc cagcaaagaa gcctgcttcc tggagcatct gcacaaacac cagggctctg
3421 tcctgcaccc cgattacaag acagccttcc cctcctttga ggacgccctc catcgcctcc
3481 tgccctacca tgtctaccaa ggcgccctcc cctcccccaa cgactaccat aaagtggatg
3541 aagaatttga gactgtctct acgcagctgc tcaaacgcac ccaggccatg ctcaataaat
3601 atcggctttt gcttctggaa gagtccagga gagtcagtcc ttctgcggag atggttatga
3661 tcgaccgaat gttcattcag gaggagaaga ccacccttgc cttggataag cagcttgcca
3721 aggagaagcc tgatgagtac gtgtcttcct cccgctccct tggcttccct gtcccagtgt
3781 cttccgaggg ccaccggctc cccagccatg gccagtcgtc ttcatcctcc acatctggaa
3841 cgtctgccca gccccctcct catctgccca ccaagctagt gatccggcac ggtggggccg
3901 gcggctctcc ctcagtgacc tgggcccggg catcctcctc cttgtcatcc acttcctcat
3961 cctcctcctc atcctctgct gcctcatccc tggacgcaga tgaggacggc cccatgccca
4021 cccgtaaccg gccacccatc aagacctatg aggcccggag ccgcattggt ctcaaactca
4081 agatcaaaca agaggcgggg ctcagcaagg tggtgcacaa cactgcactg gatcctgtgc
4141 atcagccctt gccggctcca accccagcga aaggggcgga gcctccgcca cacccagctc
4201 cgcccccact ccctcctgct acccaggcgc agatgaatgg cactctggac catcccccac
4261 ccgcagtacg caaacccacg gtgcctgcgt cctgcccacg tctaccacta cgcaagacct
4321 accgagaaaa catgggcaat cctggtgccg ccgagggtgc acagggacgg ccgcggggtg
4381 cgggcagccc caccccactg cccaccaagg tagacgaagc caccagtggg ctgatccggg
4441 agctggcagc ggtggaggat gaactatatc agcgggttct gaagggcggc ccaccacccc
4501 cggagactcc agcctccgct accagccagg gccccactga acccagttgg gaagcacccg
4561 tgctaccccc agccaaacga cgcaagtctg agtccccgga cgtggaccag gccagcttct
4621 ctagtgacag cccgcaggat gatacactta ctgagcattt gcagagtgcc atcgacagca
4681 tccttaacct gcagcaggcc cccggccgga cacccgcagg cccatacccc catacggggc
4741 ccacgcctgg cacccccaca tccccagcgc ccctgcacag gcctgacgcc ttcccaccct
4801 ctagtcacaa tggtggcctc ggtgccagga cgttgaacag ataacaccgg gctgcttctg
4861 cagccctcat agagtgcccc caaccccact tccaggagag cagcctgacc gccgacctcc
4921 acctctaagg ggcactaacc cagttcccct gacaattctt gcctaagtta ttttgagtca
4981 caaaggcctc cccaccttcc tgcttccacg ttggctagag atttggaatg gggcgtgggt
5041 tttctagggg aaggtgggct ataaggtaca acgtcccccct ggcacaagcc aggacagggg
5101 atacatgagt gttgcctagg actgggcttc taggttgatg cactggtaac atctgaaaac
```

TABLE 1-continued 5161 aaggtcttgt ctgattggct tcgtggatca ctgtccgggg cactcagagc cgggagagat
5221 cttctgaaag gctcaactct catcctgttg cccacagagc ctgaaagatt aggaagcaag
5281 gactcaagcc agtgtcccaa agtacctaca tcccatccat acgtgcactc accggagtca
5341 tcctgtgtat gtgtgcgtgc SEQ ID NO: 228 Mouse GLTSCR1 Amino Acid Sequence (NP_001074887.1)
1 mddedgrcll dvicdpqaln dflhgsekld sddlldapve aqsafyegpg lhvqeaaanh
61 lnpepsgpap svdldfledd ilgspaaggg gggggapdqp cdilqqslqe aniteqtlea
121 eaeldlgpfq lptlqpadng agatgaagat avtagpqalf pgsadllglq apptvlthqa
181 lvppqdvvnk alsvqpflqp vglgnvtlqp isglqglpng spgnaaaatl gltpiqvvgq
241 pvmalnppts qllakqvpvs gylasaagps epvtlasagv spqgaglviq knlpaavttt
301 lngnsvfagt gaataaasga psgqplavap glgtsplvqa psvilhrtpt piqpkptgvl
361 psklyqltpk pfpptgatlt iqgepgtlpq qpkapqnitf matgkagqnv vlsgfpapal
421 qanvfkqppv tttgtappqp pgalskpmsv hllnqgssiv ipaqhmlpgq nqfllpgtpa
481 vqlpgslsal panvggqilt aaaphaggql ianpiltnqn lagplslgpv laphsgahsa
541 ahilsaapiq vgqpalfqmp vslatgslpt qsqpaptgpt attvlqgvtl ppsavamlnt
601 pdglvqpstp aattgeatpv lavgpatqvp pavttplpmg lqqpqaqqpp qvptpqaatq
661 pqatppqasp slasspekiv lgqappaatt ailtqdslqm flpqersqqp lstegphlsv
721 pasvivsapp paqdpalatp vtkgaglgaq tpdsraspap apqipaaapl kapgpassps
781 lphqaplgds phmpsphpar ppsrppsrph srppsqpqsl tcppseptlh pcpppqgppt
841 lpgifvignq lgapppastp astapgppqp plrppsqppe gplppashlp pastpsavas
901 ssepsarlpv ptppdfqlqf ppsqgphksp tpppalhmvp eptappppp rtfqmvtapf
961 palpqpkall erfhqvpsgi ilqnkaggtp ttpqtsttlg tltgptasvl vsgqappgtp
1021 aasshvpast pmattglppl lpaenkafas nlptlsvaka tvsgpgkppa igydsklcsl
1081 kkqpllqpsk eacflehlhk hqgsvlhpdy ktafpsfeda lhrllpyhvy qgalpspndy
1141 hkvdeefetv stqllkrtqa mlnkyrllll eesrrvspsa emvmidrmfi qeekttlald
1201 kqlakekpde yvsssrslgf pvpvsseghr lpshgqssss stsgtsaqpp phlptklvir
1261 hggaggspsv twarasssls stssssssss aassldaded gpmptrnrpp iktyearsri
1321 glklkikqea glskvvhnta ldpvhqplpa ptpakgaepp phpappplpp atqaqmngtl
1381 dhpppavrkp tvpascprlp lrktyrenmg npgaaegaqg rprgagsptp lptkvdeats
1441 glirelaave delyqrvlkg gppppetpas atsqgpteps weapvlppak rrksespdvd
1501 qasfssdspq ddtltehlqs aidsilnlqq apgrtpagpy phtgptpgtp tspaplhrpd
1561 afppsshngg lgartlnr SEQ ID NO: 229 Human GLTSCR1L cDNA Sequence variant 1 (NM_001318819.1; CDS: 431-3670)
1 ccctgccctc cccgagctcg gtcccggcca ctccctccgc agctgggcgt cgccggccgc
61 gctggggcga gaaccgaagt ttggaggtag acgagcaggc gagcggtttg cccgggcgca
121 gagcatgaag gccgggcggg cgcggggagc ggcgccccgg cccggcgcgg gggtgagcga
181 gagagagagc ggagcgcgtg tggccggcgc cgctcggccg ggagctcccg cgctccggcc
241 cccggccccg cgcccgccgc cgccgccgcc gccgcccctg ttgcgatggc gcagaaaccc
301 cgttgacaag gcactgcttt ttcatgacgc aaaacgtcat attatttcac aaaaagccca
361 gcgatttcac ctgaagaagc ttgggaactc ctgccaaaaa ttgtagcact tctcacattg
421 caatgttgtc atggatgatg atgatgactc gtgtctcctt gatcttattg gagacccaca
481 agcattgaac tattttctac atggacctag taataaatct agcaatgatg acttgactaa
541 tgcaggatat tctgcagcca attcaaattc aattttcgcc aactctagta atgctgatcc
601 taagtcatcc ctcaaaggtg taagcaacca gcttggagaa gggcccagtg atggactgcc
661 actttcaagt agcctccagt ttcttgaaga tgaactcgag tcttctcctc ttcctgatct
721 cactgaggac caacctttcg acattcttca gaaatccttg caagaggcca atatcactga
781 acagacattg gcagaagagg catatttgga tgccagtata ggttcaagcc aacagtttgc
841 acaagctcag cttcatcctt cttcatcagc atcctttact caggcttcta atgtttctaa
901 ttactcaggt cagacgctgc agcctatagg ggtgacgcat gtgcctgttg gagcatcgtt
961 tgcaagcaat acagtgggtg tacaacatgg ctttatgcaa catgtgggga tcagtgttcc
1021 cagccagcat ttgtctaata gcagtcagat tagtggttct ggtcaaatac agttaattgg
1081 gtcatttggt aatcatcctt ccatgatgac tattaataac ctagatggat ctcaaatcat
1141 attaaagggc agcgggcagc aagccccatc aaatgtgagt ggagggctcc tggttcatag
1201 acagactcct aatggcaact ccttgtttgg gaactctagt tccagtccag tagcacagcc
1261 tgttaccgtt ccatttaaca gcacaaattt tcaaacatct ttacctgtgc ataacatcat
1321 catacaaagg ggtcttgcac caaattcaaa taaagtccca attaatatac agccaaagcc
1381 tatccagatg ggtcagcaaa atacatacaa tgtgaacaat ttgggaattc agcagcacca
1441 cgtacaacaa gggatctctt ttgcttctgc aagctcaccc cagggctcag tagttggtcc
1501 acacatgtct gtgaacattg taaaccaaca gaacacaaga aagccagtca cctcacaggc
1561 agtgagcagc actgggggca gtattgttat tcattccccc atgggccaac ctcacgcacc
1621 ccaaagtcag ttccttatac ctacaagcct ttctgtcagt tccaactcgg tacaccacgt
1681 ccagactata aatgggcaac ttcttcaaac tcaaccctct cagctcattt ctggccaagt
1741 ggcctcagag catgtcatgt tgaacagaaa ctcttccaac atgctcagga ccaaccaacc
1801 atatactgga ccgatgctta acaaccagaa tactgctgtc cacttagtgt ctgggcagac
1861 atttgctgcc tctggaagtc cagtgatagc caatcatgcc tctcctcagc ttgtgggtgg
1921 acagatgccc ttgcagcagg catccccaac tgtattacac ctgtcacctg ggcagagcag
1981 cgtttcccaa ggaagacctg gcttcgccac catgccatcg gtgacaagca tgtcaggacc
2041 tagtcggttc cctgctgtca gctcagccag cactgcccat cctagtcttg ggtctgcagt
2101 tcagtctggt tcatcaggat caaactttac aggagatcag ctgacccagc caaacaggac
2161 tccagtacca gtcagtgtgt ctcatcgtct tccagtttct tcttccaagt ctaccagcac
2221 cttcagtaac acacctggaa caggaaccca gcaacaattc ttctgccagg ctcagaaaaa
2281 atgtctgaat cagacttccc ccatttctgc tcccaagacc acagacggcc tgaggcaagc
2341 acagatccct gggctcttga gcaccacact gccagggcag gattctggaa gcaaagttat
2401 atccgcatcc ttaggaaccg cacaaccaca gcaggaaaaa gtagttggat catctcctgg
2461 ccatccagct gtgcaggtgg agagtcattc gggaggacaa aaaaggcctg ctgcgaaaca
2521 gctaacgaaa ggagctttca ttctccagca gttgcagagg gaccaagccc acactgtgac
2581 accagacaaa agtcacttcc gatcactaag tgatgcggta cagagactgc tctcctacca TABLE 1-continued

```
2641 cgtgtgccag ggctccatgc ccactgaaga agacttgaga aaagtggaca atgaatttga
2701 gacagttgcc actcagctcc taaaaaggac ccaagctatg cttaacaaat acagatgcct
2761 gctcctagaa gatgccatgc gaatcaatcc ctctgctgag atggtgatga tcgataggat
2821 gttcaaccag gaggaaagag cttccctgtc ccgagacaag cgtttggcac ttgtagaccc
2881 tgagggtttt caggctgatt tctgttgttc cttcaaactt gataaagctg ctcatgagac
2941 acagtttggc cggagtgacc agcatggcag taaagcaagc agctctctgc aaccgccagc
3001 caaggcccaa ggcagagacc gagccaaaac cggtgtgacg gaacccatga atcatgacca
3061 gtttcatcta gtgcctaatc acatcgtggt ctctgcagaa ggaaacattt ctaaaaaaac
3121 agaatgcctt ggcagagcac tgaaatttga caaagtgggc ttagtgcagt accagagcac
3181 gtctgaagag aaggccagcc ggagagagcc tctgaaggcc agtcagtgct ctcccggccc
3241 tgaggggcac cggaaaacct catccagatc ggatcatggt actgagagca aactgtcaag
3301 catcctagca gattcgcact tggagatgac gtgtaacaat tccttccagg acaaaagtct
3361 gaggaattct ccaaagaatg aagttttaca cacagacatc atgaaagggt caggcgaacc
3421 ccagccagat ctccagctga caaagagctt ggaaaccaca tttaagaaca tcttggaact
3481 caaaaaggcg ggacggcagc cccagagtga ccccacggtt agcggctctg ttgagttaga
3541 tttccccaac ttttctccta tggcttcaca ggaaaactgc ctggaaaagt tcatcccgga
3601 ccacagtgaa ggtgttgtag aaactgactc catttagaa gcagctgtaa atagtatcct
3661 agagtgttaa tagcagcagt cctccccta ccccgccccg agaccccacc ccgagacccc
3721 accccggacc agttacattc gttcctggca aaagcaaatg gaaatggtct cctgtctcca
3781 gcctgcttga tctttcatca caggttattc tttctaatct caatcctgtt ctttgtttaa
3841 gagcaatact tgtcgtgatt acagggagat cctttagtaa aattaatcct tggcagaaag
3901 cagtctgata ggccccactc atttcaagtg ttatgaaagt gcttataggc attttgttta
3961 tttgttttgt tttttaaaaa cactgtaact caatgagacc acagtatact tggcccttgg
4021 taaaattttg acaatcataa gtcatttgaa aagaacagac ttactaaaat caaacgagac
4081 ggatagaagc tacttttaa agaatatccc actgcatctg caaatttagt tttgggtttt
4141 tttattatta ttattttgag ttttttgtg tgtgttttgt tgttattgtt gaggggaaga
4201 ccacatggtt cttcccctc agccatcttt gagcagtaaa ttgctggctg tgctgccagg
4261 gacccgcagc cctggtggaa aagccagtag cacatacgca gggcattgca gggcttccct
4321 attgatggtt caagtgcttt tctgatgctt ccggagcaaa acctcatgct tttaggcata
4381 tctatgttga atttcaccta gggaatgttc tgttcttagt tacagcagca aaatttgaaa
4441 taatttcacc aggctaaata aaggaaaatg gaaaccagtt aagaggcaca gtgtacagag
4501 gaggccggga tagagccatg agggttataa tattaatatg tatatatgta aaagcatata
4561 tatgttaact attgagaaaa aacaagtttt gcattttata attggatata gtcaacatat
4621 aatgtatgtt tttgtttgtt gctggatttt gtttcattta acctctcttt gcaccctctc
4681 ccacaacaaa taccaagcat caaaagcact ttcatttgaa aattattatg ttgtaatttt
4741 tcagtttaaa ctttaaggag actctggcct tgtttatgct tcttgtctga gaacagtagt
4801 gacccctggc agcaattcat taccaaaaca cagacaaacc aaaggtaacc agctagccca
4861 ccactgaaag gaaagatctg agacatggga ttcccatttg agagccaaag gatatgccct
4921 gtcatggttt ctgtttggcc tgtgttcata ttagtgagca tggcttactg ctttatttat
4981 ttttatttct tgtcagggag tattctccgt tttcctttct cgtatacctg ccccaggtta
5041 tcccatttct gttgttacct ttattcttaa tgtcattgta accatcactt atctcctctc
5101 attgggaaag ctacatgata gtatttttat gcactcttct cccacacata cacacacgtg
5161 catgtatctg agctgctcgg atccagaggt catttttgtt acagtgtgtg cacactcact
5221 ctccttctta gtgtgcatac tctctcattt attctgttta tctccctggc tctggaggtg
5281 cagccactgg tcttcacttt aatgtgttgc cagaatctgc ttctggctgt cgccaacatg
5341 gggatgaccc ccattgtcat catgttgggc atttcttttc cagattggcc tgtgatggaa
5401 aggaaggctt ctaattagaa aacacagcaa cagaagacct ataccccggt gcccctgtgt
5461 cccactacac acagaaaacc ctgtgagatg gccagtcttc ataatagcaa cgtaccttca
5521 ccccagccac atgccccagc caatacaaat tggaaaatct ggcccatttt agggttacca
5581 ttttttcctt atttgtgcca atgtccaagt tgcagatttc cccttttcc tgtattgtaa
5641 catattagat aagttggtgt cgccagttgg tactttctgt ttgggtagtc ctagggtaac
5701 accctgccct aaactccatg atttcatagg cttttcttcc cttggggctc atgctcccct
5761 aattcctagc aagatgatcc ttcctaatca aattcttctc attgcagaac tttatccctg
5821 gaagccttca tgtgggctgc tagtgagtta cattaattac tgcaaatcag tggaattctc
5881 aagagacaag ataagcttca tgtacatttg tcacctctct ttcttcccta tcctgccctg
5941 ctgtcccaat cctagctttt ctatatacca tcctaaaggg tttttaagcc ctaacacttg
6001 tctagcaaat ggagagccta atttaccaaa atgaaacttg taaatttttg tgtcattgta
6061 tgtaagttta ctttttatgg aggaaggatt ctagataatg acaaatgaag attatgacat
6121 gtatttcact cctgtgatta ggttctacgc acatgggtca taactcgcat gtcgagcccc
6181 ctctagtgaa gggtaggaga gctcagcctc ggatggccaa cattcagttg ttcaggttca
6241 ttcgtcaaag ttaagtttta gaactatttg tactcagtaa caaaaatcat tttcttttt
6301 ttttttttt tctgttgtgg aaaagcgtga atttgttatt aagcatttga ttttctgtgt
6361 ccttaagtac ttcctgaaga tgaagcaaaa ttttaatctg gcaattatga aaaagaaata
6421 ttttagctct gaaggattta gtagattctg ttagattagg gaggccttac agactgactt
6481 tacttaaaga ggacgcgtca ctcgctgtca gtgtggtgtg ggctttattt gcttaaatac
6541 cttcatttgt atagtacgtc tcacttgaaa ttgctttgta tacattttgt aaaaatattt
6601 ataaaatgtt ttgtaaaaaa aaaaaaacta taacaaattg cagtttattt tgttatgttg
6661 gataaatact gttaaaagaa accagtcagt aactatattg ttaatccatg gttaggaaat
6721 gtttagttgg agattacaaa ttgaaacaac cattgcaata cagccaaaga tttgggaaaa
6781 tgtg
```

SEQ ID NO: 230 Human GLTSCR1L cDNA Sequence variant 2 (NM_015349.2; CDS: 164-3403)

```
   1 ggcatctttt caggatttca ttcctacgtc caactgccgt tcacaactgc cctttccaac
  61 tgctccagaa ctcttggccc tggcattccg tgatgtaaat tattccacac atggctcaaa
 121 agggtgtgaa gctgtgtgcc aggtgtcgga tcactagttt gtcatggatg atgatgatga
 181 ctcgtgtctc cttgatctta ttggagaccc acaagcattg aactattttc tacatggacc
 241 tagtaataaa tctagcaatg atgacttgac taatgcagga tattctgcag ccaattcaaa
 301 ttcaattttc gccaactcta gtaatgctga tcctaagtca tccctcaaag gtgtaagcaa
 361 ccagcttgga gaagggccca gtgatggact gccactttca agtagcctcc agtttcttga
```

TABLE 1-continued

| | |
|---|---|
| 421 | agatgaactc gagtcttctc ctcttcctga tctcactgag gaccaacctt tcgacattct |
| 481 | tcagaaatcc ttgcaagagg ccaatatcac tgaacagaca ttggcagaag aggcatattt |
| 541 | ggatgccagt ataggttcaa gccaacagtt tgcacaagct cagcttcatc cttcttcatc |
| 601 | agcatccttt actcaggctt ctaatgtttc taattactca ggtcagacgc tgcagcctat |
| 661 | aggggtgacg catgtgcctg ttggagcatc gtttgcaagc aatacagtgg gtgtacaaca |
| 721 | tggctttatg caacatgtgg ggatcagtgt tcccagccag catttgtcta atagcagtca |
| 781 | gattagtggt tctggtcaaa tacagttaat tgggtcattt ggtaatcatc cttccatgat |
| 841 | gactattaat aacctagatg gatctcaaat catattaaag ggcagcgggc agcaagcccc |
| 901 | atcaaatgtg agtggagggc tcctggttca tagacagact cctaatggca actccttgtt |
| 961 | tgggaactct agttccagtc cagtagcaca gcctgttacc gttccattta acagcacaaa |
| 1021 | ttttcaaaca tctttacctg tgcataacat catcatacaa aggggtcttg caccaaattc |
| 1081 | aaataaagtc ccaattaata tacagccaaa gcctatccag atgggtcagc aaaatacata |
| 1141 | caatgtgaac aatttgggaa ttcagcagca ccacgtacaa caagggatct cttttgcttc |
| 1201 | tgcaagctca ccccagggct cagtagttgg tccacacatg tctgtgaaca ttgtaaacca |
| 1261 | acagaacaca agaaagccag tcacctcaca ggcagtgagc agcactgggg gcagtattgt |
| 1321 | tattcattcc cccatgggcc aacctcacgc accccaaagt cagttcctta tacctacaag |
| 1381 | cctttctgtc agttccaact cggtacacca cgtccagact ataaatgggc aacttcttca |
| 1441 | aactcaaccc tctcagctca tttctggcca agtggcctca gagcatgtca tgttgaacag |
| 1501 | aaactcttcc aacatgctca ggaccaacca accatatact ggaccgatgc ttaacaacca |
| 1561 | gaatactgct gtccacttag tgtctgggca gacatttgct gcctctggaa gtccagtgat |
| 1621 | agccaatcat gcctctcctc agcttgtggg tggacagatg cccttgcagc aggcatcccc |
| 1681 | aactgtatta cacctgtcac ctgggcagag cagcgtttcc caaggaagac ctggcttcgc |
| 1741 | caccatgcca tcggtgacaa gcatgtcagg acctagtcgg ttccctgctg tcagctcagc |
| 1801 | cagcactgcc catcctagtc ttgggtctgc agttcagtct ggttcatcag gatcaaactt |
| 1861 | tacaggagat cagctgaccc agccaaacag gactccagta ccagtcagtg tgtctcatcg |
| 1921 | tcttccagtt tcttcttcca agtctaccag caccttcagt aacacacctg gaacaggaac |
| 1981 | ccagcaacaa ttcttctgcc aggctcagaa aaaatgtctg aatcagactt cccccatttc |
| 2041 | tgctcccaag accacagacg gcctgaggca agcacagatc cctgggctct tgagcaccac |
| 2101 | actgccaggg caggattctg gaagcaaagt tatatccgca tccttaggaa ccgcacaacc |
| 2161 | acagcaggaa aaagtagttg gatcatctcc tggccatcca gctgtgcagg tggagagtca |
| 2221 | ttcgggagga caaaaaaggc ctgctgcgaa acagctaacg aaaggagctt tcattctcca |
| 2281 | gcagttgcag agggaccaag cccacactgt gacaccagac aaaagtcact tccgatcact |
| 2341 | aagtgatgcg gtacagagac tgctctccta ccacgtgtgc cagggctcca tgcccactga |
| 2401 | agaagacttg agaaaagtgg acaatgaatt tgagacagtt gccactcagc tcctaaaaag |
| 2461 | gacccaagct atgcttaaca aatacagatg cctgctccta gaagatgcca tgcgaatcaa |
| 2521 | tccctctgct gagatggtga tgatcgatag gatgttcaac caggaggaaa gagcttccct |
| 2581 | gtcccgagac aagcgtttgg cacttgtaga ccctgagggt tttcaggctg atttctgttg |
| 2641 | ttccttcaaa cttgataaag ctgctcatga gacacagttt ggccggagtg accagcatgg |
| 2701 | cagtaaagca agcagctctc tgcaaccgcc agccaaggcc caaggcagag accgagccaa |
| 2761 | aaccggtgtg acggaaccca tgaatcatga ccagtttcat ctagtgccta atcacatcgt |
| 2821 | ggtctctgca gaaggaaaca tttctaaaaa aacagaatgc cttggcagag cactgaaatt |
| 2881 | tgacaaagtg ggcttagtgc agtaccagag cacgtctgaa gagaaggcca gccggagaga |
| 2941 | gcctctgaag gccagtcagt gctctcccgg ccctgagggg caccggaaaa cctcatccag |
| 3001 | atcggatcat ggtactgaga gcaaactgtc aagcatccta gcagattcgc acttggagat |
| 3061 | gacgtgtaac aattccttcc aggacaaaag tctgaggaat tctccaaaga atgaagtttt |
| 3121 | acacacagac atcatgaaag ggtcaggcga accccagcca gatctccagc tgacaaagag |
| 3181 | cttggaaacc acatttaaga acatcttgga actcaaaaag gcgggacggc agccccagag |
| 3241 | tgaccccacg gttagcggct ctgttgagtt agatttcccc aacttttctc ctatggcttc |
| 3301 | acaggaaaac tgcctggaaa agttcatccc ggaccacagt gaaggtgttg tagaaactga |
| 3361 | ctccatttta gaagcagctg taaatagtat cctagagtgt taatagcagc agtcctcccc |
| 3421 | ctaccccgcc ccgagacccc accccgagac cccaccccgg accagttaca ttcgttcctg |
| 3481 | gcaaaagcaa atggaaatgg tctcctgtct ccagcctgct tgatctttca tcacaggtta |
| 3541 | ttctttctaa tctcaatcct gttctttgtt taagagcaat acttgtcgtg attacaggga |
| 3601 | gatcctttag taaaattaat ccttggcaga aagcagtctg ataggcccca ctcatttcaa |
| 3661 | gtgttatgaa agtgcttata ggcattttgt ttatttgttt tgtttttaa aaacactgta |
| 3721 | actcaatgag accacagtat acttggccct tggtaaaatt ttgacaatca taagtcattt |
| 3781 | gaaaagaaca gacttactaa aatcaaacga gacggataga agctactttt taaagaatat |
| 3841 | cccactgcat ctgcaaattt agttttgggt tttttatta ttattatttt gagtttttt |
| 3901 | gtgtgtgttt tgttgttatt gttgagggga agaccacatg gttcttcccc ctcagccatc |
| 3961 | tttgagcagt aaattgctgg ctgtgctgcc agggacccgc agccctggtg gaaaagccag |
| 4021 | tagcacatac gcagggcatt gcagggcttc cctattgatg gttcaagtgc ttttctgatg |
| 4081 | cttccggagc aaaacctcat gcttttaggc atatctatgt tgaatttcac ctagggaatg |
| 4141 | ttctgttctt agttacagca gcaaaatttg aaataatttc accaggctaa ataaaggaaa |
| 4201 | atggaaacca gttaagaggc acagtgtaca gaggaggccg ggatagagcc atgagggtta |
| 4261 | taatattaat atgtatatat gtaaaagcat atatatgtta actattgaga aaaaacaagt |
| 4321 | tttgcatttt ataattggat atagtcaaca tataatgtat gtttttgttt gttgctggat |
| 4381 | tttgtttcat ttaacctctc tttgcaccct ctcccacaac aaataccaag catcaaaagc |
| 4441 | actttcattt gaaaattatt atgttgtaat ttttcagttt aaactttaag gagactctgg |
| 4501 | ccttgtttat gcttcttgtc tgagaacagt agtgacccct ggcagcaatt cattaccaaa |
| 4561 | acacagacaa accaaaggta accagctagc ccaccactga aaggaaagat ctgagacatg |
| 4621 | ggattcccat ttgagagcca aaggatatgc cctgtcatgg tttctgtttg gcctgtgttc |
| 4681 | atattagtga gcatggctta ctgctttatt tatttttatt tcttgtcagg gagtattctc |
| 4741 | cgttttcctt tctcgtatac ctgccccagg ttatcccatt tctgttgtta cctttattct |
| 4801 | taatgtcatt gtaaccatca cttatctcct ctcattggga aagctacatg atagtatttt |
| 4861 | tatgcactct tctcccacac atacacacac gtgcatgtat ctgagctgct cggatccaga |
| 4921 | ggtcattttt gttacagtgt gtgcacactc actctccttc ttagtgtgca tactctctca |
| 4981 | tttattctgt ttatctccct ggctctggag gtgcagccac tggtcttcac tttaatgtgt |
| 5041 | tgccagaatc tgcttctggc tgtcgccaac atggggatga cccccattgt catcatgttg |
| 5101 | ggcatttctt ttccagattg gcctgtgatg gaaaggaagg cttctaatta gaaaacacag |
| 5161 | caacagaaga cctatacccc ggtgcccctg tgtcccacta cacacagaaa accctgtgag |

TABLE 1-continued 5221 atggccagtc ttcataatag caacgtacct tcaccccagc cacatgcccc agccaataca
5281 aattggaaaa tctggcccat tttagggtta ccattttttc cttatttgtg ccaatgtcca
5341 agttgcagat ttcccctttt tcctgtattg taacatatta gataagttgg tgtcgccagt
5401 tggtactttc tgtttgggta gtcctagggt aacaccctgc cctaaactcc atgatttcat
5461 aggcttttct tcccttgggg ctcatgctcc cctaattcct agcaagatga tccttcctaa
5521 tcaaattctt ctcattgcag aactttatcc ctggaagcct tcatgtgggc tgctagtgag
5581 ttacattaat tactgcaaat cagtggaatt ctcaagagac aagataagct tcatgtacat
5641 ttgtcacctc tctttcttcc ctatcctgcc ctgctgtccc aatcctagct tttctatata
5701 ccatcctaaa gggtttttaa gccctaacac ttgtctagca aatggagagc ctaatttacc
5761 aaaatgaaac ttgtaaattt ttgtgtcatt gtatgtaagt ttactttttta tggaggaagg
5821 attctagata atgacaaatg aagattatga catgtatttc actcctgtga ttaggttcta
5881 cgcacatggg tcataactcg catgtcgagc cccctctagt gaagggtagg agagctcagc
5941 ctcggatggc caacattcag ttgttcaggt tcattcgtca aagttaagtt ttagaactat
6001 ttgtactcag taacaaaaat catttcttt ttttttttt ttttctgttg tggaaaagcg
6061 tgaatttgtt attaagcatt tgattttctg tgtccttaag tacttcctga agatgaagca
6121 aaattttaat ctggcaatta tgaaaaagaa atattttagc tctgaaggat ttagtagatt
6181 ctgttagatt agggaggcct tacagactga ctttacttaa agaggacgcg tcactcgctg
6241 tcagtgtggt gtgggcttta tttgcttaaa taccttcatt tgtatagtac gtctcacttg
6301 aaattgcttt gtatacattt tgtaaaaata tttataaaat gttttgtaaa aaaaaaaaaa
6361 ctataacaaa ttgcagttta ttttgttatg ttggataaat actgttaaaa gaaaccagtc
6421 agtaactata ttgttaatcc atggttagga aatgtttagt tggagattac aaattgaaac
6481 aaccattgca atacagccaa agatttggga aaatgtg SEQ ID NO: 231 Human GLTSCR1L Amino Acid Sequence (NP_001305748.1 and NP_056164.1)

1 mdddddscll dligdpqaln yflhgpsnks snddltnagy saansnsifa nssnadpkss
61 lkgvsnqlge gpsdglplss slqfledele ssplpdlted gpfdilqksl qeaniteqtl
121 aeeayldasi gssqqfaqaq lhpsssasft qasnvsnysg qtlqpigvth vpvgasfasn
181 tvgvqhgfmq hvgisvpsqh lsnssgisgs gqiqligsfg nhpsmmtinn ldgsqiilkg
241 sgqqapsnvs ggllvhrqtp ngnslfgnss sspvaqpvtv pfnstnfqts lpvhniiiqr
301 glapnsnkvp iniqpkpiqm gqqntynvnn lgiqqhhvgq gisfasassp qgsvvgphms
361 vnivnqqntr kpvtsgayss tggsivihsp mgqphapqsq fliptslsys snsvhhvqti
421 ngqllqtqps qlisgqvase hvmlnrnssn mlrtnqpytg pmlnnqntav hlvsgqtfaa
481 sgspvianha spqlvggqmp lqqasptvlh lspggssysq grpgfatmps vtsmsgpsrf
541 pavssastah pslgsavqsg ssgsnftgdq ltqpnrtpvp vsyshrlpvs ssksststfsn
601 tpgtgtqqqf fcqaqkkcln qtspisapkt tdglrgagip gllsttlpgq dsgskvisas
661 lgtaqpqqek vvgsspghpa vgveshsggq krpaakqltk gafilqqlqr dqahtvtpdk
721 shfrslsdav qrllsyhvcq gsmpteedlr kvdnefetva tqllkrtqam lnkyrcllle
781 damrinpsae mvmidrmfnq eeraslsrdk rlalvdpegf qadfccsfkl dkaahetqfg
841 rsdqhgskas sslqppakaq grdraktgvt epmnhdqfhl vpnhivvsae gniskktecl
901 gralkfdkvg lvqyqstsee kasrreplka sqcspgpegh rktssrsdhg tesklssila
961 dshlemtcnn sfqdkslrns pknevlhtdi mkgsgepqpd lqltkslett fknilelkka
1021 grqpqsdptv sgsveldfpn fspmasqenc lekfipdhse gvvetdsile aavnsilec SEQ ID NO: 232 Mouse GLTSCR1L cDNA Sequence (NM_001100452.1; CDS: 423-3647)

1 ggggtctcat gtagcccagg ctggcctcaa ccttgtcatg taggcaaggg tagccttcac
61 ctcctgatcc tcctgtctct gccttccaac tcctgggatc aaggtgtttg ccagtgtgtc
121 tggcttgctt ggctatttgt ttatttactt atgagctgcg gtcttgctat tgtccaggct
181 gaccttgaac tcttggactc aagttccctt ccttactgag tcctacctga gtggccagga
241 ctactggcaa atgacactgt gcccaccagc cacaacattt ttcccatggt aggcttgata
301 ggtgactagg gaaagctccc gtgctgacag ttgtgtggag gctcagcgtg ctccactgca
361 tccatattgc tggccgccct gctccgactc actgcctccc tccctctctc cttgcagttg
421 tcatggatga tgacgatgac tcctgtctcc tcgatcttat tggagaccca caagcattga
481 actattttct gcacggacct agcagtaaat cgggcagcga tgatgtgacg aacgcagggt
541 attctgcagc caattctaat tcaattttcg ccaactccac gaacgctgac cctaaatcgg
601 ccctcaaagg tgtgagtgac cagcttgggg aggggcccag tgatgggctg ccgcttgcaa
661 gcagccttca gtttcttgaa gatgaacttg agtcttcacc tctccccgat ctcagcgagg
721 accaaccctt tgacattctt cagaaatcct tgcaggaggc taatatcact gaacagacat
781 tggcagaaga ggcgtacctg gatgccagta taggctcaag ccaacagttt gcacaagccc
841 agcttcatcc ttcttcatca gcatccttta ctcaggcttc taatgtttct aattactcag
901 gtcagacact gcagcctatc ggggtgactc acgtgcctgt tggagcatcg tttgcaagca
961 atacagtggg tgtgcagcat ggctttatgc aacacgtggg gatcagtgtt cccagccagc
1021 atttgcctaa cagcagccag attagtggct ccggtcagat acagttaatc gggtccttcg
1081 gtaatcagcc ttccatgatg actataaata acctcgatgg ctctcaaatc atactgaaag
1141 gcagtgggca gcaagcccca tctaatgtga gtggggggct tctggttcac agacagactc
1201 ctaacggcaa ctctctgttt gggaactcca cttccagtcc tgtagcacag cctgtcaccg
1261 ttccatttaa cagcacaaat ttccaggcat ctttacccgt gcataacatc attattcaaa
1321 ggggtcttgc accaaattca aataaagtcc caattaatat ccagccaaag ccggtccaga
1381 tgggtcagca gagcgcgtac aatgtgaaca accttgggat ccagcagcac catgcccagc
1441 aggggatctc cttcgccccc acaagctcgc cccagggctc cgtggttggg ccgcacatgt
1501 ctgtgaacat tgtcaaccaa cagaacacga gaaagcctgt cacctcgcag gcagtgagcg
1561 gcacaggggg cagcatcgtc atccattccc ccatgggcca gcctcacact ccccaaagtc
1621 agttccttat acccacaagc ctttctgtca gctccaactc ggtgcaccat gtccaggcta
1681 taaacgggca gctgcttcag actcagccct cccagctcat ctctggccaa gtggcctctg
1741 agcatgtcat gctgaacagg aattcctcta acatgctcag gaccaaccaa ccatattccg
1801 gacagatgct taataaccag aataccgccg tccagctggt gtctgggcag acttttgcca
1861 cctctggaag tccagtgata gtcaaccacg cctctcctca gatcgtcggg ggacagatgc
1921 ccttgcagca ggcctcaccc accgtgttac acctgtcacc tggcgcagagc agtgtttccc
1981 agggaaggcc aggcttcgcc accatgcccg cggtgagcgg catggcagga cccgctcggt TABLE 1-continued

```
2041 tccccgccgt cagctcagct agcactgctc atcctactct tgggcctacg gtgcagtcgg
2101 gggcaccggg atcaaacttt acgggagacc agctgacaca agccaacaga acgccagcgc
2161 ccgtcagtgt gtcccaccgt cttccagtct ctgcttccaa atcccccagc accttgagca
2221 acaccccggg gacacagcag cagttcttct gtcaggctca gaagaagtgt ttgaaccaga
2281 cctcccccat tcccacatcc aagaccacag acggcttgag gccatcacag atccctgggc
2341 tcttgagcac cgcactgcca ggacaggatt ctggaagcaa aattatgcca gcgaccttgg
2401 gggccacaca ggcacaacca gaaagctcag ttggatcatc cccgagccag acagctgtgc
2461 aggtggatag tcatccagga cagaaaaggc ctgctgccaa acagctgact aaaggagctt
2521 tcatcctcca gcagttacag agggaccaag cccatgctgt gacacccgac aaaagccagt
2581 tccggtcact aaatgacacg gtgcagagac tgctctccta ccacgtgtgc cagggctcca
2641 tgcccacgga ggaagacctg aggcaagtgg acaatgaatt tgaagaggtc gccactcagc
2701 tcctcaaaag gacccaagct atgctgaaca aatacagatt cctgctccta gaagacgcca
2761 tgaggatcaa cccctctgca gagatggtga tgattgacag gatgttcaac caggaggaaa
2821 gagcttccct gtcgagggac aagcgtctgg cgctcgtaga tcctgagggt tttcaggccg
2881 atttctgttg ttccttcaaa cttgacgaag ctgtacctga gaccccgctt gacaggagtg
2941 accagcatcg cagcaaaacc agctcgctcc atcaggtgcc cagggcccaa agcagagacc
3001 gagccaagcc aggcatggca gaagcaacga atcatgacca gtttcatcta gtgcctaacc
3061 acatcgtggt ctctgcagag ggaaacattt ctaaaaagtc agaaggccac agtagaacac
3121 tgaaatttga cagaggggtc ttaggccaat accggggtcc gcctgaggac aagggcggcc
3181 ggagggaccc tgccaaggtc agcaggtgct ctccgggccc cgagggccac cgcaaaagct
3241 tgcccaggcc agatcacggc tctgagagca agctccccgg cgtcctggcc agctcgcaca
3301 tggagatgcc ctgtctcgac tccttccagg acaaagcgct gaggaattcc ccaaagaatg
3361 aggttttaca cacagacatc atgaaagggt cgggtgagcc ccagccagat ctccagctca
3421 ccaagagcct agagaaaacc tttaagaaca tcctggaact caagaactcg gggcggccgc
3481 caagcgaccc tacggccagc ggtgcggcgg acctggactt ccccagcttt tctccaatgg
3541 cttcgcagga aaactgccta gaaaaattca tcccggacca cagtgaaggc gttgtagaaa
3601 cggactccat tttagaagca gctgtaaata gtattctaga gtgttaatag cagccgtcct
3661 cctccagacc ctgccccgga ccagttacac tctctcccag caaagcaaat ggaaacggct
3721 cccgtctgtc tccagcctgc ttggtcctcc atcacaggtt atcctttcta atctcaccct
3781 gttcttttga agagcaatac atgtcgtcat ggctgcgggg agacccctca gtacacccac
3841 ctctctctag aaagcagtcc gataggccct ccacatttca agtgttacga aagtgcttac
3901 ggccattgtt gttcgttaat ttgttttgtg gtttgtttct tagcactgtc gctcaagacc
3961 acagtacact tggccctggg taaaattttg acaatcataa gtcatttcaa aagaacagac
4021 ttattaaaga aaaatcaaac aggactgatt taaagacttt ctcactgcag ctccaaagta
4081 gtggtttggt tttgttctgt tccaggggga gagggtatct gcgtagggaa gactctccct
4141 gaccagcccg ctgagtggtg ggtagccggt gctctgcctg gaagcccacc gccctggcta
4201 agacgccagg agcacagcca cagagcatcc tcctgacatc cagtgctgtg cgatgctgca
4261 aaagcaaagc cttgtgtttg tcttcaacac attcgtgctg aattctgtct gagaatggtc
4321 tgttcttagc cccaggtgta cgccctgaaa ttctcacagg ctcactaggg aacagtggaa
4381 gtcagttgta aggcagcgag ttggggaggc accggggtct ccgtgtattc catcaactta
4441 aaagaggttt gcattttata attgggtgaa gtcaacataa cctatgttct ttattatcgc
4501 tgaattctgt tccattcaac ctcgttgtcc cctttccctc agcccttagc caagcatcaa
4561 aaggctttca cttaaaaact gtgttgtact ctttcagttg aggcttttga acgggactct
4621 ggccttgttc gtgagaatag tagtcaacag tatcagtcat tcattcccaa acacagtaaa
4681 ccaaaggtca caaccagcag gccactgaag gaaggaaccg aggcaggaga cagggggcca
4741 tgtcctggcc ccgcccccgc tgtgtgtggt ccagttcacc atagcgatcg agccttcctc
4801 tttattattt ttgttccttt ccgggagtgg ccctcatcct tccctctgtg cgggcctgca
4861 ccagggcgtg ttctgttgct acttgcttct tcctgtgtgg taatggccca cagtgctgtg
4921 tctgcaaccc tcctcccacg tctccatcaa cctctgggat ccagaggtag ctttgatgcc
4981 tgtgagggct tcctccctct gttcatcccc aggctgtgta aatgcatccg ttgatctcct
5041 ctgcttcgtt atacccccaa aatggagttg tccctatggt catcatgtag agtgtttctt
5101 ttccagattg gcctgcaatg gaaaggaagg cttttgattt tgatttttat cttttttca
5161 cataacacag caacaatcta ggcatggtgg catacacctg taatcccaac agtcaggtga
5221 ctaaagcagg agagtcactg gttcaaggcc agcttgggct atataacaca cccctgcctc
5281 aaacacagaa ggagagaaat ttgagcaata gcagactgtg tgggcctttt ttacccctct
5341 gtccactaca caaaaaaact ctgtgagaca gccagtcttt gagagcgatg gaccttctcc
5401 cgcccacagc ccagccaacc aaactagaag agtctgggct gtcttcgagt tgtcctttc
5461 ttccttctct gtgccaatgt ccaagttgct gacttccttc ctgtattata acacattaga
5521 aagatgagtt gtttaccagt tagacctctg tctgggctgc cctgatctct ctgtcacagg
5581 ctcttctcat agccacatgg ttaccattca agatggcccc tggatgcctg cagcacatgg
5641 ctactaatga attactttaa ttattgcaaa tcagtggaat tctcaagaga caagaaagtc
5701 tcgtgtatat ttgttatctc ttccctccct ccccagcccc ggccctggcc ctagttttct
5761 ctcctgtgtg tcaggttaca gggcttctca ccatgacatt agtcccacac aaggagagcc
5821 tactgtacca aaatgaaact tgtaaatttt tgtgtccttg tatgtaagtt tactttttat
5881 ggaggaaaga ctctagataa tgacaaatga agattacaaa gtgtatttta ctcctgtgat
5941 taggttacac cacatgggtc ataactcact cccgagcccc cactgctgaa gggaagcgct
6001 ctgcctcagt ggccaacgtt ggtggttcag ggtcattagt cagttgagtt ctagaacgcg
6061 tgctcagtaa caaaaaaaaa aaatcacctt ttcttccctt tgtttttaat ccgtttgttg
6121 ttgtggaaaa gtatgaattt gttattacgc attgattttc tgtgtcctta agtactgcct
6181 aaagatgaag caaattttga actggcaatt acgataagga aaccctttag ttctggagac
6241 tttagtagac tctgttagat tagggaggcc tcacaggctg gccggctcca aggacggtca
6301 ctcactgtca gtgtggcgtg gctttatttg cttaaatacc ttcatttgta tagtatgtct
6361 cacttgaaat tgctttgtat acattttgta aaaatattta taaaatgttt tgtaaaaaaa
6421 aaaaaaagta taacaaattg cagtttattt tgttatgttg gataaatact gttaaaccag
6481 tcagtaccta tattgttaat ccatggttag ggtatgttca gttggagatt acaaaatgaa
6541 acaaccattg caatacagcc aaagatttgg gaaaacgtg
```

SEQ ID NO: 233 Mouse GLTSCR1L Amino Acid Sequence (NP_001093922.1)

```
 1 mdddddscll dligdpqaln yflhgpssks gsddvtnagy saansnsifa nstnadpksa
61 lkgvsdqlge gpsdglplas slqfledele ssplpdlsed gpfdilqksl qeanitegtl
```

TABLE 1-continued 121 aeeayldasi gssqqfaqaq lhpsssasft qasnvsnysg qtlqpigvth vpvgasfasn
181 tvgvqhgfmq hvgisvpsqh lpnssgisgs gqiqligsfg nqpsmmtinn ldgsqiilkg
241 sgqqapsnvs ggllvhrqtp ngnslfgnst sspvaqpvtv pfnstnfqas lpvhniiiqr
301 glapnsnkvp iniqpkpvqm gqqsaynvnn lgiqqhhaqq gisfaptssp qgsvvgphms
361 vnivnqqntr kpvtsgaysg tggsivihsp mgqphtpqsq fliptslsys snsvhhvqai
421 ngqllqtqps qlisgqvase hvmlnrnssn mlrtnqpysg qmlnnqntav qlvsgqtfat
481 sgspvivnha spqivggqmp lqqasptvlh lspggssysq grpgfatmpa vsgmagparf
541 pavssastah ptlgptvqsg apgsnftgdq ltqanrtpap vsyshrlpvs askspstlsn
601 tpgtqqqffc qaqkkclnqt spiptskttd glrpsqipgl lstalpgqds gskimpatlg
661 atqaqpessv gsspsqtavq vdshpgqkrp aakqltkgaf ilqqlqrdqa havtpdksqf
721 rslndtvqrl lsyhvcqgsm pteedlrqvd nefeevatql lkrtqamlnk yrflllledam
781 rinpsaemvm idrmfngeer aslsrdkrla lvdpegfqad fccsfkldea vpetpldrsd
841 qhrsktsslh qvpraqsrdr akpgmaeatn hdqfhlvpnh ivvsaegnis kkseghsrtl
901 kfdrgvlgqy rgppedkggr rdpakvsrcs pgpeghrksl prpdhgsesk lpgvlasshm
961 empcldsfqd kalrnspkne vlhtdimkgs gepqpdlqlt ksleктfkni lelknsgrpp
1021 sdptasgaad ldfpsfspma sqenclekfi pdhsegvvet dsileaavns ilec SEQ ID NO: 234 Human BRD9 cDNA Sequence variant 1 (NM_023924.4; CDS: 168-1961)

1 ctgccgcggc cccgcctcgc cccgtttccg gcgcggccca gcgagctcgg caacctcggc
61 gcagcgagcg cgggcggcca gccagggcca gggggcggtg gcggccaagg tccgaccggg
121 tgccagctgt tcccagcccc cgcctcgggc ccgccgccgg cgccgccatg ggcaagaagc
181 acaagaagca caaggccgag tggcgctcgt cctacgagga ttatgccgac aagcccctgg
241 agaagcctct aaagctagtc ctgaaggtcg gaggaagtga agtgactgaa ctctcaggat
301 ccggccacga ctccagttac tatgatgaca ggtcagacca tgagcgagag aggcacaaag
361 aaaagaaaaa gaagaagaag aagaagtccg agaaggagaa gcatctggac gatgaggaaa
421 gaaggaagcg aaaggaagag aagaagcgga agcgagagag ggagcactgt gacacggagg
481 gagaggctga cgactttgat cctgggaaga aggtggaggt ggagccgccc ccagatcggc
541 cagtccgagc gtgccggaca cagccagccg aaaatgagag cacacctatt cagcaactcc
601 tggaacactt cctccgccag cttcagagaa aagatcccca tggatttttt gcttttcctg
661 tcacggatgc aattgctcct ggatattcaa tgataataaa acatcccatg gattttggca
721 ccatgaaaga caaaattgta gctaatgaat acaagtcagt tacggaattt aaggcagatt
781 tcaagctgat gtgtgataat gcaatgacat acaataggcc agataccgtg tactacaagt
841 tggcgaagaa gatccttcac gcaggcttta agatgatgag caaacaggca gctcttttgg
901 gcaatgaaga tacagctgtt gaggaacctg tccctgaagt tgtaccagta caagtagaaa
961 ctgccaagaa atccaaaaag ccgagtagag aagttatcag ctgcatgttt gagcctgaag
1021 ggaatgcctg cagcttgacg gacagtaccg cagaggagca cgtgctggcg ctggtggagc
1081 acgcagctga cgaagctcgg gacaggatca accggttcct cccaggcggc aagatgggct
1141 atctgaagag gaacggggac gggagcctgc tctacagcgt ggtcaacacg gccgagccgg
1201 acgctgatga ggaggagacc cacccggtgg acttgagctc gctctccagt aagctactcc
1261 caggcttcac cacgctgggc ttcaaagacg agagaagaaa caaagtcacc tttctctcca
1321 gtgccactac tgcgctttcg atgcagaata attcagtatt tggcgacttg aagtcggacg
1381 agatggagct gctctactca gcctacggag atgagacagg cgtgcagtgt gcgctgagcc
1441 tgcaggagtt tgtgaaggat gctgggagct acagcaagaa agtggtggac gacctcctgg
1501 accagatcac aggcggagac cactctagga cgctcttcca gctgaagcag agaagaaatg
1561 ttcccatgaa gcctccagat gaagccaagg ttggggacac cctaggagac agcagcagct
1621 ctgttctgga gttcatgtcg atgaagtcct atcccgacgt ttctgtggat atctccatgc
1681 tcagctctct ggggaaggtg aagaaggagc tggaccctga cgacagccat ttgaacttgg
1741 atgagacgac gaagctcctg caggacctgc acgaagcaca ggcggagcgc ggcggctctc
1801 ggccgtcgtc caacctcagc tccctgtcca acgcctccga gagggaccag caccacctgg
1861 gaagcccttc tcgcctgagt gtcggggagc agccagacgt cacccacgac ccctatgagt
1921 ttcttcagtc tccagagcct gcggcctctg ccaagaccta actctagacc accttcagct
1981 cttttatttt attttttag ttttattttg cacgtgtaga gtttttgtca tcagacaagg
2041 actttgatcc tgtccccttt ggcatgcggg aagcagccgc ggggaggtaa tgaattgtct
2101 gtggtatcat gtcagcagag tctccaagcc ccacgaaccc tgaggagtgg agtcatacgc
2161 gaaggccata tggccatcgt gtcagcagag agagtctctg tacacagccc cgtgaaccct
2221 gaggagtgga gtcatacacg aagggcgtgt ggccatcgtg tcagcagaga gagtctctgt
2281 acacagcccc gtgaaccctg aggagtggag tcatacgcga agggtgtgtg gccaggctgc
2341 agagctgcgt gccgtttgtg tccgagcatc acgtgtggct ccagcccttg tttctgccag
2401 tgtagacacc tctgtctgcc ccactgtcct ggggtcgctc ttgggaggca caggcatggg
2461 tgtgtctggc ctcattctgt atcagtccag tgtgttcctg tcatagtttg tgtctcccag
2521 gcaggccatg gtaggggcct cgcaggggcc attggggagc acagggccag gctggggtga
2581 ggagagctcc cctgttttct gtttaattga tgagcctggg aaaggagtgt gttctgcctg
2641 cccgttacag tggagcgttc cgtgtccata aaacgttttc taactgggtg tttaaaaaa SEQ ID NO: 235 Human BRD9 Amino Acid Sequence isoform 1 (NP_076413.3)

1 mgkkhkkhka ewrssyedya dkplekplkl vlkvggsevt elsgsghdss yyddrsdher
61 erhkekkkkk kkksekekhl ddeerrkrke ekkrkrereh cdtegeaddf dpgkkvevep
121 ppdrpvracr tqpaenestp iqqllehflr qlqrkdphgf fafpvtdaia pgysmiikhp
181 mdfgtmkdki vaneykssvte fkadfklmcd namtynrpdt vyyklakkil hagfkmmskq
241 aallgnedta veepvpevvp vqvetakksk kpsreviscm fepegnacsl tdstaeehvl
301 alvehaadea rdrinrflpg gkmgylkrng dgsllysvvn taepdadeee thpvdlssls
361 skllpgfttl gfkderrnkv tflssattal smqnnsvfgd lksdemelly saygdetgvq
421 calslgefvk dagsyskkvv ddlldqitgg dhsrtlfqlk qrrnvpmkpp deakvgdtlg
481 dssssvlefm smksypdvsv dismlsslgk vkkeldpdds hlnldettkl lqdlheaqae
541 rggsrpssnl sslsnaserd qhhlgspsrl svgeqpdvth dpyeflqspe paasakt TABLE 1-continued SEQ ID NO: 236 Human BRD9 cDNA Sequence variant 2 (NM_001009877.2; CDS: 154-1788)

```
   1 acgggggagg agttccgggc acgcggacgg gggtcctggg caccgggcga gattatgccg
  61 acaagcccct ggagaagcct ctaaagctag tcctgaaggt cggaggaagt gaagtgactg
 121 aactctcagg atccggccac gactccagtt actatgatga caggtcagac catgagcgag
 181 agaggcacaa agaaaagaaa aagaagaaga agaagaagtc cgagaaggag aagcatctgg
 241 acgatgagga aagaaggaag cgaaaggaag agaagaagcg gaagcgagag agggagcact
 301 gtgacacgga gggagaggct gacgactttg atcctgggaa gaaggtggag gtggagccgc
 361 ccccagatcg gccagtccga gcgtgccgga cacagccagc cgaaaatgag agcacaccta
 421 ttcagcaact cctggaacac ttcctccgcc agcttcagag atccccatgg attttttgct
 481 tttcctgtca cggatgcaat tgctcctgga tattcaatga taataaaaca tcccatggat
 541 tttggcacca tgaaagacaa aattgtagct aatgaataca agtcagttac ggaatttaag
 601 gcagatttca agctgatgtg tgataatgca atgacataca ataggccaga taccgtgtac
 661 tacaagttgg cgaagaagat ccttcacgca ggctttaaga tgatgagcaa acaggcagct
 721 cttttgggca atgaagatac agctgttgag gaacctgtcc ctgaagttgt accagtacaa
 781 gtagaaactg ccaagaaatc caaaaagccg agtagagaag ttatcagctg catgtttgag
 841 cctgaaggga atgcctgcag cttgacggac agtaccgcag aggagcacgt gctggcgctg
 901 gtggagcacg cagctgacga agctcgggac aggatcaacc ggttcctccc aggcggcaag
 961 atgggctatc tgaagaggaa cggggacggg agcctgctct acagcgtggt caacacggcc
1021 gagccggacg ctgatgagga ggagacccac ccggtggact tgagctcgct ctccagtaag
1081 ctactcccag gcttcaccac gctgggcttc aaagacgaga gaagaaacaa agtcaccttt
1141 ctctccagtg ccactactgc gctttcgatg cagaataatt cagtatttgg cgacttgaag
1201 tcggacgaga tggagctgct ctactcagcc tacggagatg agacaggcgt gcagtgtgcg
1261 ctgagcctgc aggagtttgt gaaggatgct gggagctaca gcaagaaagt ggtggacgac
1321 ctcctggacc agatcacagg cggagaccac tctaggacgc tcttccagct gaagcagaga
1381 agaaatgttc ccatgaagcc tccagatgaa gccaaggttg gggacaccct aggagacagc
1441 agcagctctg ttctggagtt catgtcgatg aagtcctatc ccgacgtttc tgtggatatc
1501 tccatgctca gctctctggg gaaggtgaag aaggagctgg accctgacga cagccatttg
1561 aacttggatg agacgacgaa gctcctgcag gacctgcacg aagcacaggc ggagcgcggc
1621 ggctctcggc cgtcgtccaa cctcagctcc ctgtccaacg cctccgagag ggaccagcac
1681 cacctgggaa gcccttctcg cctgagtgtc ggggagcagc cagacgtcac ccacgacccc
1741 tatgagtttc ttcagtctcc agagcctgcg gcctctgcca agacctaact ctagaccacc
1801 ttcagctctt ttattttatt tttttagttt tattttgcac gtgtagagtt tttgtcatca
1861 gacaaggact ttgatcctgt cccctttggc atgcgggaag cagccgcggg gaggtaatga
1921 attgtctgtg gtatcatgtc agcagagtct ccaagcccca cgaaccctga ggagtggagt
1981 catacgcgaa ggccatatgg ccatcgtgtc agcagagaga gtctctgtac acagccccgt
2041 gaaccctgag gagtggagtc atacacgaag ggcgtgtggc catcgtgtca gcagagagag
2101 tctctgtaca cagccccgtg aaccctgagg agtggagtca tacgcgaagg gtgtgtggcc
2161 aggctgcaga gctgcgtgcc gtttgtgtcc gagcatcacg tgtggctcca gcccttgttt
2221 ctgccagtgt agacacctct gtctgcccca ctgtcctggg gtcgctcttg ggaggcacag
2281 gcatgggtgt gtctggcctc attctgtatc agtccagtgt gttcctgtca tagtttgtgt
2341 ctcccaggca ggccatggta ggggcctcgc aggggccatt ggggagcaca gggccaggct
2401 ggggtgagga gagctcccct gttttctgtt taattgatga gcctgggaaa ggagtgtgtt
2461 ctgcctgccc gttacagtgg agcgttccgt gtccataaaa cgttttctaa ctgggtgttt
2521 aaaaaa
```

SEQ ID NO: 237 Human BRD9 Amino Acid Sequence isoform 2 (NP_001009877.2)

```
   1 mmtgqtmser gtkkrkrrrr rsprrrsiwt mrkegserkr rsgsergstv trrerlttli
  61 lgrrwrwsrp qigqseragh sqpkmrahlf snswntssas frdphgffaf pvtdaiapgy
 121 smiikhpmdf gtmkdkivan eyksvtefka dfklmcdnam tynrpdtvyy klakkilhag
 181 fkmmskqaal lgnedtavee pvpevvpvqv etakkskkps reviscmfep egnacsltds
 241 taeehvlalv ehaadeardr inrflpggkm gylkrngdgs llysvvntae pdadeeethp
 301 vdlsslsskl lpgfttlgfk derrnkvtfl ssattalsmq nnsvfgdlks demellysay
 361 gdetgvqcal slqefvkdag syskkvvddl ldqitggdhs rtlfqlkgrr nvpmkppdea
 421 kvgdtlgdss ssvlefmsmk sypdvsvdis mlsslgkvkk eldpddshln ldettkllqd
 481 lheaqaergg srpssnlssl snaserdqhh lgspsrlsvg eqpdvthdpy eflqspepaa
 541 sakt
```

SEQ ID NO: 238 Human BRD9 cDNA Sequence variant 3 (NM_001317951.1; CDS: 635-2140)

```
   1 ctgccgcggc cccgcctcgc cccgtttccg gcgcggccca gcgagctcgg caacctcggc
  61 gcagcgagcg cgggcggcca gccagggcca gggggcggtg gcggccaagg tccgaccggg
 121 tgccagctgt tcccagcccc cgcctcgggc ccgccgccgg cgccgccatg ggcaagaagc
 181 acaagaagca caaggccgag tggcgctcgt cctacgagga ttatgccgac aagcccctgg
 241 agaagcctct aaagctagtc ctgaaggtcg gaggaagtga agtgactgaa ctctcaggat
 301 ccggccacga ctccagttac tatgatgaca ggtcagacca tgagcgagag aggcacaaag
 361 aaaagaaaaa gaagaagaag aagaagtccg agaaggagaa gcatctggac gatgaggaaa
 421 gaaggaagcg aaaggaagag aagaagcgga agcgagagag ggagcactgt gacacggagg
 481 gagaggctga cgactttgat cctgggaaga aggtggaggt ggagccgccc ccagatcggc
 541 cagtccgagc gtgccggaca cagccagttc tcggtggaac ttaaaatgct gtgagacacc
 601 agacagacag atactgtgaa cttggagctc tctaatgaag ggataccaaa gtcttgtatt
 661 caattttttt ttccttaaat tgtcagccga aaatgagagc acacctattc agcaactcct
 721 ggaacacttc ctccgccagc ttcagagaaa agatccccat ggattttttg cttttcctgt
 781 cacggatgca attgctcctg gatattcaat gataataaaa catcccatgg attttggcac
 841 catgaaagac aaaattgtag ctaatgaata caagtcagtt acggaattta aggcagattt
 901 caagctgatg tgtgataatg caatgacata caataggcca gataccgtgt actacaagtt
 961 ggcgaagaag atccttcacg caggctttaa gatgatgagc aaagagcggc tgttagcttt
1021 gaagcgcagc atgtcgttta tgcaggacat ggatttttct cagcaggcag ctcttttggg
1081 caatgaagat acagctgttg aggaacctgt ccctgaagtt gtaccagtac aagtagaaac
1141 tgccaagaaa tccaaaaagc cgagtagaga agttatcagc tgcatgtttg agcctgaagg
```

TABLE 1-continued

```
1201 gaatgcctgc agcttgacgg acagtaccgc agaggagcac gtgctggcgc tggtggagca
1261 cgcagctgac gaagctcggg acaggatcaa ccggttcctc ccaggcggca agatgggcta
1321 tctgaagagg aacggggacg ggagcctgct ctacagcgtg gtcaacacgg ccgagccgga
1381 cgctgatgag gaggagaccc acccggtgga cttgagctcg ctctccagta agctactccc
1441 aggcttcacc acgctgggct tcaaagacga gagaagaaac aaagtcacct ttctctccag
1501 tgccactact gcgctttcga tgcagaataa ttcagtattt ggcgacttga agtcggacga
1561 gatggagctg ctctactcag cctacggaga tgagacaggc gtgcagtgtg cgctgagcct
1621 gcaggagttt gtgaaggatg ctgggagcta cagcaagaaa gtggtggacg acctcctgga
1681 ccagatcaca ggcggagacc actctaggac gctcttccag ctgaagcaga gaagaaatgt
1741 tcccatgaag cctccagatg aagccaaggt tggggacacc ctaggagaca gcagcagctc
1801 tgttctggag ttcatgtcga tgaagtccta tcccgacgtt tctgtggata tctccatgct
1861 cagctctctg gggaaggtga agaaggagct ggaccctgac gacagccatt tgaacttgga
1921 tgagacgacg aagctcctgc aggacctgca cgaagcacag gcggagcgcg gcggctctcg
1981 gccgtcgtcc aacctcagct ccctgtccaa cgcctccgag agggaccagc accacctggg
2041 aagcccttct cgcctgagtg tcggggagca gccagacgtc acccacgacc cctatgagtt
2101 tcttcagtct ccagagcctg cggcctctgc caagacctaa ctctagacca ccttcagctc
2161 ttttatttta ttttttagt tttattttgc acgtgtagag tttttgtcat cagacaagga
2221 ctttgatcct gtcccctttg gcatgcggga agcagccgcg gggaggtaat gaattgtctg
2281 tggtatcatg tcagcagagt ctccaagccc cacgaaccct gaggagtgga gtcatacgcg
2341 aaggccatat ggccatcgtg tcagcagaga gagtctctgt acacagcccc gtgaaccctg
2401 aggagtggag tcatacacga agggcgtgtg gccatcgtgt cagcagagag agtctctgta
2461 cacagccccg tgaaccctga ggagtggagt catacgcgaa gggtgtgtgg ccaggctgca
2521 gagctgcgtg ccgtttgtgt ccgagcatca cgtgtggctc cagcccttgt ttctgccagt
2581 gtagacacct ctgtctgccc cactgtcctg gggtcgctct tgggaggcac aggcatgggt
2641 gtgtctggcc tcattctgta tcagtccagt gtgttcctgt catagtttgt gtctcccagg
2701 caggccatgg taggggcctc gcaggggcca ttggggagca cagggccagg ctggggtgag
2761 gagagctccc ctgttttctg tttaattgat gagcctggga aaggagtgtg ttctgcctgc
2821 ccgttacagt ggagcgttcc gtgtccataa aacgttttct aactgggtgt ttaaaaaa
```

SEQ ID NO: 239 Human BRD9 Amino Acid Sequence isoform 3 (NP_001304880.1)

```
  1 mkgyqslvfn ffflklsaen estpiqqlle hflrqlqrkd phgffafpvt daiapgysmi
 61 ikhpmdfgtm kdkivaneyk svtefkadfk lmcdnamtyn rpdtvyykla kkilhagfkm
121 mskerllalk rsmsfmqdmd fsqqaallgn edtaveepvp evvpvgveta kkskkpsrev
181 iscmfepegn acsltdstae ehvlalveha adeardrinr flpggkmgyl krngdgslly
241 svvntaepda deeethpvdl sslsskllpg fttlgfkder rnkvtflssa ttalsmqnns
301 vfgdlksdem ellysaygde tgvqcalslq efvkdagsys kkvvddlldq itggdhsrtl
361 fqlkgrrnvp mkppdeakvg dtlgdssssv lefmsmksyp dvsvdismls slgkvkkeld
421 pddshlnlde ttkllqdlhe aqaerggsrp ssnlsslsna serdqhhlgs psrlsvgeqp
481 dvthdpyefl qspepaasak t
```

SEQ ID NO: 240 Mouse BRD9 Amino Acid Sequence isoform 1 (NP_001019679.2)

```
  1 mgkkhkkhka ewrssyedyt dtplekplkl vlkvggsevt elsgsghdss yyddrsdher
 61 erhrekkkkk kkksekekhl deeerrkrke ekkrkrekeh cdsegeadaf dpgkkvevep
121 ppdrpvracr tqpaenestp iqrllehflr qlqrkdphgf fafpvtdaia pgysmiikhp
181 mdfgtmkdki vaneyksvte fkadfklmcd namtynrpdt vyyklakkil hagfkmmskq
241 aallgsedpa aeepvpevvp vqvettkksk kpsreviscm fepegnacsl tdstaeehvl
301 alvehaadea rdrinrflpg gkmgylkklg dgsllysvvn apepdadeee thpvdlssls
361 skllpgfttl gfkderrnkv tflssastal smqnnsvfgd lksdemelly saygdetgvq
421 calslqefvk dagsyskkmv ddlldqitgg dhsrmifqlk qrrsipmrpa demkvgdplg
481 esggpvldfm smkgypdvsl dvsmlsslgk vkkeldheds hlnldetarl lqdlheagae
541 rggsrpssnl sslstasere hpppgspsrl svgeqpdvah dpyeflqspe paapakn
```

SEQ ID NO: 241 Mouse BRD9 cDNA Sequence variant 1 (NM_001024508.3; CDS: 84-1877)

```
   1 gcggtggcga aggcgctact tccgactggc gcaggtcgag ctaccggcag ccgcttctca
  61 ccggatcccg tgctatctca gccatgggca aaaagcacaa gaagcacaag gcggaatggc
 121 gctcgtccta cgaagattat acagacacgc cactggagaa gcctctgaag ctggtgctca
 181 aggtgggagg aagtgaagtg acagagctct caggatctgg ccacgactcc agctactacg
 241 acgatcgctc agaccacgaa cgggagagac acagagaaaa gaagaaaaag aagaagaaaa
 301 agtcagagaa ggagaagcac ctcgatgagg aggagaggag gaagcggaag gaagagaaga
 361 aacggaaacg ggagaaggaa cactgcgact cagaggggga ggctgatgct ttcgaccctg
 421 gaaagaaggt ggaggtggag ccacccccag accgaccagt gagagcctgc cgaacacagc
 481 cagctgagaa cgagagcaca cctatccaga ggcttctgga acacttcctc cgccagctac
 541 agagaaaaga tcctcatgga ttttttgctt ttcctgttac ggatgcaatt gctcctgggt
 601 attcaatgat aataaaacat cctatggact ttggcacgat gaaagacaag attgtagcta
 661 atgaatataa atcagtcaca gaatttaagg cagatttcaa attaatgtgt gataatgcga
 721 tgacgtacaa tagaccagac accgtgtact acaaattagc caagaagatc ctgcacgcgg
 781 gctttaagat gatgagcaaa caggcagctc tcttgggcag tgaagaccca gcagctgagg
 841 aacctgttcc cgaggttgtc ccagtgcaag tagaaactac caagaaatcc aaaaagccga
 901 gtagagaagt tatcagctgc atgtttgagc ctgaagggaa tgcctgcagc ctgacagaca
 961 gcacggcaga ggagcatgtg ctagccctgg tagagcacgc agctgatgag gctcgggaca
1021 ggattaaccg gtttctcccg ggtggcaaga tggggtacct gaagaagctt ggagatggaa
1081 gtctgctcta cagcgtggtg aacgcacctg agcctgatgc tgatgaggag gagacacacc
1141 ctgtggacct gagttcactg tctagcaagt tgctcccagg ttttacaaca ttgggtttca
1201 aagatgaaag aagaaataaa gtcacattcc tctccagtgc cagcactgca ctttcaatgc
1261 agaacaactc tgtgtttggg gacctgaagt cagatgagat ggagcttctg tattccgcct
1321 atggagatga gactggtgtg cagtgtgcac tgagcctgca ggaattcgtg aaggatgctg
1381 gaagctatag caagaagatg gtagatgacc tcctggacca aatcacaggt ggtgatcact
1441 caaggatgat cttccagctg aagcagagga ggagcatccc catgagacct gcagatgaga
1501 tgaaggttgg ggatccactg ggagagagtg gtggccctgt tctggacttc atgtcaatga
```

TABLE 1-continued

```
 1561 aacagtatcc tgatgtctcc ctggatgtgt ccatgctcag ctctctcggg aaagtaaaga
 1621 aggagctgga ccatgaagat agccacttga acttggatga gacagccagg ctcctgcagg
 1681 acttacacga agcacaagca gagcgaggag gctctcggcc atcctccaac cttagctctc
 1741 tgtccactgc ctctgagagg gagcatcctc ctccaggaag tccttctcgc cttagtgttg
 1801 gggagcagcc ggatgtcgcc cacgaccctt atgaattcct tcagtctcca gaacctgcag
 1861 ctcctgccaa gaactaactt gtggtgttcc cagatggttt attttatttt tctacatttt
 1921 atttgataca gtttttgtca caagacagaa acttttgtct catcctctct ggcaagtagc
 1981 agcctgagga agatgctggc ttgtctgtac cgtcacgtct gcagcagagg cccagtagca
 2041 ccgaatggtg tccaataagc tctgagcagt ggcaatagaa tgtcaacgga ttgcaatcag
 2101 atggctcaac tctgtgtctc ctgagcacca gcagccaagc ctgttcatga tgatgtgcac
 2161 acagtcattc tacaggagct ttgcacagcc ttcctgcagt tctcaaaggg gagcctgcag
 2221 actaggcctt cagagggttc cttctgtttc ctatttgggc actgagccag aggatggagt
 2281 tgtctccctg acaaataatg aaccacccca ccttttagaa tgaagtataa atgaagtcat
 2341 aaaatgtttc aatgttttgc tgagtacctg tttgtattta taaaaaacat gaacacaggt
 2401 cctaataaag agatgcctaa ggcggtaaaa aaaaaaaaaa aaaaaaaa
```

SEQ ID NO: 242 Mouse BRD9 Amino Acid Sequence isoform 2 (NP_001294970.1)

```
    1 mgkkhkkhka ewrssyedyt dtplekplkl vlkvggsevt elsgsghdss yyddrsdher
   61 erhrekkkkk kkksekekhl deeerrkrke ekkrkrekeh cdsegeadaf dpgkkvevep
  121 ppdrpvracr tqpaenestp iqrllehflr qlqrkdphgf fafpvtdaia pgysmiikhp
  181 mdfgtmkdki vaneyksvte fkadfklmcd namtynrpdt vyyklakkil hagfkmmska
  241 allgsedpaa eepvpevvpv qvettkkskk psreviscmf epegnacslt dstaeehvla
  301 lvehaadear drinrflpgg kmgylkklgd gsllysvvna pepdadeeet hpvdlsslss
  361 kllpgfttlg fkderrnkvt flssastals mqnnsvfgdl ksdemellys aygdetgvqc
  421 alslgefvkd agsyskkmvd dlldqitggd hsrmifqlkg rrsipmrpad emkvgdplge
  481 sggpvldfms mkgypdvsld vsmlsslgkv kkeldhedsh lnldetarll qdlheagaer
  541 ggsrpssnls slstasereh pppgspsrls vgeqpdvand pyeflqspep aapakn
```

SEQ ID NO: 243 Mouse BRD9 cDNA Sequence variant 2 (NM_001308041.1; CDS: 84-1874)

```
    1 gcggtggcga aggcgctact tccgactggc gcaggtcgag ctaccggcag ccgcttctca
   61 ccggatcccg tgctatctca gccatgggca aaaagcacaa gaagcacaag gcggaatggc
  121 gctcgtccta cgaagattat acagacacgc cactggagaa gcctctgaag ctggtgctca
  181 aggtgggagg aagtgaagtg acagagctct caggatctgg ccacgactcc agctactacg
  241 acgatcgctc agaccacgaa cgggagagac acagagaaaa gaagaaaaag aagaagaaaa
  301 agtcagagaa ggagaagcac ctcgatgagg aggagaggag gaagcggaag gaagagaaga
  361 aacggaaacg ggagaaggaa cactgcgact cagaggggga ggctgatgct ttcgaccctg
  421 gaaagaaggt ggaggtggag ccacccccag accgaccagt gagagcctgc cgaacacagc
  481 cagctgagaa cgagagcaca cctatccaga ggcttctgga acacttcctc cgccagctac
  541 agagaaaaga tcctcatgga tttttttgctt ttcctgttac ggatgcaatt gctcctgggt
  601 attcaatgat aataaaacat cctatggact ttggcacgat gaaagacaag attgtagcta
  661 atgaatataa atcagtcaca gaatttaagg cagatttcaa attaatgtgt gataatgcga
  721 tgacgtacaa tagaccagac accgtgtact acaaattagc caagaagatc ctgcacgcgg
  781 gctttaagat gatgagcaaa gcagctctct tgggcagtga agacccagca gctgaggaac
  841 ctgttcccga ggttgtccca gtgcaagtag aaactaccaa gaaatccaaa aagccgagta
  901 gagaagttat cagctgcatg tttgagcctg aagggaatgc ctgcagcctg acagacagca
  961 cggcagagga gcatgtgcta gccctggtag agcacgcagc tgatgaggct cgggacagga
 1021 ttaaccggtt tctcccgggt ggcaagatgg ggtacctgaa gaagcttgga gatggaagtc
 1081 tgctctacag cgtggtgaac gcacctgagc ctgatgctga tgaggaggag acacaccctg
 1141 tggacctgag ttcactgtct agcaagttgc tcccaggttt tacaacattg ggtttcaaag
 1201 atgaaagaag aaataaagtc acattcctct ccagtgccag cactgcactt tcaatgcaga
 1261 acaactctgt gtttggggac ctgaagtcag atgagatgga gcttctgtat tccgcctatg
 1321 gagatgagac tggtgtgcag tgtgcactga gcctgcagga attcgtgaag gatgctggaa
 1381 gctatagcaa gaagatggta gatgacctcc tggaccaaat cacaggtggt gatcactcaa
 1441 ggatgatctt ccagctgaag cagaggagga gcatccccat gagacctgca gatgagatga
 1501 aggttgggga tccactggga gagagtggtg gccctgttct ggacttcatg tcaatgaaac
 1561 agtatcctga tgtctccctg gatgtgtcca tgctcagctc tctcgggaaa gtaaagaagg
 1621 agctggacca tgaagatagc cacttgaact tggatgagac agccaggctc ctgcaggact
 1681 tacacgaagc acaagcagag cgaggaggct ctcggccatc ctccaacctt agctctctgt
 1741 ccactgcctc tgagagggag catcctcctc caggaagtcc ttctcgcctt agtgttgggg
 1801 agcagccgga tgtcgcccac gacccttatg aattccttca gtctccagaa cctgcagctc
 1861 ctgccaagaa ctaacttgtg gtgttcccag atggtttatt ttatttttct acattttatt
 1921 tgatacagtt tttgtcacaa gacagaaact tttgtctcat cctctctggc aagtagcagc
 1981 ctgaggaaga tgctggcttg tctgtaccgt cacgtctgca gcagaggccc agtagcaccg
 2041 aatggtgtcc aataagctct gagcagtggc aatagaatgt caacggattg caatcagatg
 2101 gctcaactct gtgtctcctg agcaccagca gccaagcctg ttcatgatga tgtgcacaca
 2161 gtcattctac aggagctttg cacagccttc ctgcagttct caaaggggag cctgcagact
 2221 aggccttcag agggttcctt ctgtttccta tttgggcact gagccagagg atggagttgt
 2281 ctccctgaca aataatgaac caccccacct tttagaatga agtataaatg aagtcataaa
 2341 atgtttcaat gttttgctga gtacctgttt gtatttataa aaaacatgaa cacaggtcct
 2401 aataaagaga tgcctaaggc ggtaaaaaaa aaaaaaaaaa aaaaa
```

SEQ ID NO: 244 Human ARID1A C-terminal Amino Acid Sequence (aa1611-2285)

```
 1561                                                        mkmqkagppv
 1621 pashiapapv qppmirrdit fppgsveatq pvlkgrrrlt mkdigtpeaw rvmmslksgl
 1681 laestwaldt inillyddns imtfnlsqlp gllellveyf rrclieifgi lkeyevgdpg
 1741 qrtlldpgrf skvsspapme ggeeeeellg pkleeeeeee vvendeeiaf sgkdkpasen
 1801 seekliskfd klpvkivqkn dpfvvdcsdk lgrvqefdsg llhwrigggd ttehiqthfe
 1861 sktellpsrp hapcppaprk hvttaegtpg ttdgegpppd gppekritat mddmlstrss
 1921 tltedgakss eaikesskfp fgispaqshr nikiledeph skdetplctl ldwqdslakr
```

TABLE 1-continued

| | |
|---|---|
| 1981 | cvcvsntirs lsfvpgndfe mskhpgllli lgklillhhk hperkqaplt yekeeeqdqg |
| 2041 | vscnkvewww dclemlrent lvtlanisgq ldlspypesi clpvldgllh wavcpsaeaq |
| 2101 | dpfstlgpna vlspqrlvle tlsklsiqdn nvdlilatpp fsrleklyst mvrflsdrkn |
| 2161 | pvcremavvl lanlaggdsl aaraiavqkg signllgfle dslaatqfqq sgasllhmqn |
| 2221 | ppfeptsvdm mrraaralla lakvdenhse ftlyesrlld isysplmnsl vsqvicdvlf |
| 2281 | ligqs |
| SEQ ID NO: 245 Human mARID2 Amino Acid Sequence (N-terminal aa1-626 fused to C-terminal aa1592-1835) | |
| 1 | manstgkapp derrkglafl delrqfhhsr gspfkkipav ggkeldlhgl ytrvttlggf |
| 61 | akvseknqwg eiveefnfpr scsnaafalk qyylryleky ekvhhfgedd devppgnpkp |
| 121 | qlpigaipss ynyqqhsysd ylrqsyglsm dfnspndynk lvlsllsglp nevdfainvc |
| 181 | tllsneskhv mqlekdpkii tlllanagvf ddtlgsfstv fgeewkektd rdfvkfwkdi |
| 241 | vddnevrdli sdrnkshegt sgewiweslf hpprklgind ieggrvlqia vilrnlsfee |
| 301 | gnvkllaanr tclrflllsa hshfislrql gldtlgniaa ellldpvdfk tthlmfhtvt |
| 361 | kclmsrdrfl kmrgmeilgn lckaedngvl iceyvdqdsy reiichltlp dvllvistle |
| 421 | vlymltemgd vactkiakve ksidmlvclv smdiqmfgpd alaavklieh pssshqmlse |
| 481 | irpqaieqvq tqthvasapa sravvaqhva pppgiveids ekfacqwlna hfevnpdcsv |
| 541 | sraemyseyl stcsklargg iltstgfykc lrtvfpnhtv krvedsssng qahihvvgvk |
| 601 | rraiplpiqm yyqqqpvsts vvrvdsntpm ppspavqvqg qpnssqpspf sgsssqpgdpm |
| 661 | rkpgqnfmcl wqsckkwfqt psqvfyhaat ehggkdvypg qclwegcepf qrqrfsfith |
| 721 | lqdkhcskda llaglkqdep gqagsqksst kqptvggtss tpraqkaivn hpsaalmalr |
| 781 | rgsrnlvfrd ftdekegpit khirltaali lknigkysec grrllkrhen nlsvlaisnm |
| 841 | eass tlakcl yelnftvqsk eqekdsemlq |

* Included in Table 1 are RNA nucleic acid molecules (e.g., thymines replaced with uridines), nucleic acid molecules encoding orthologs of the encoded proteins, as well as DNA or RNA nucleic acid sequences comprising a nucleic acid sequence having at least 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity across their full length with the nucleic acid sequence of any SEQ ID NO listed in Table 1, or a portion thereof. Such nucleic acid molecules can have a function of the full-length nucleic acid as described further herein.
* Included in Table 1 are orthologs of the proteins, as well as polypeptide molecules comprising an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity across their full length with an amino acid sequence of any SEQ ID NO listed in Table 1, or a portion thereof. Such polypeptides can have a function of the full-length polypeptide as described further herein.

II. Isolated Modified Protein Complexes

The present invention relates, in part, to an isolated modified protein complex selected from the group consisting of protein complexes listed in Table 2 and Table 3, wherein the isolated modified protein complex comprises at least one subunit that is modified.

In certain embodiments, at least one subunit of a complex of the invention is a homolog, a derivative, e.g., a functionally active derivative, a fragment, e.g., a functionally active fragment, of a protein subunit of a complex of the invention. In certain embodiments of the invention, a homolog, derivative or fragment of a protein subunit of a complex of the invention is still capable of forming a complex with the other subunit(s). Complex-formation can be tested by any method known to the skilled artisan. Such methods include, but are not limited to, non-denaturing PAGE, FRET, and Fluorescence Polarization Assay.

Homologs (e.g., nucleic acids encoding subunit proteins from other species) or other related sequences (e.g., paralogs) which are members of a native cellular protein complex can be identified and obtained by low, moderate or high stringency hybridization with all or a portion of the particular nucleic acid sequence as a probe, using methods well known in the art for nucleic acid hybridization and cloning.

Exemplary moderately stringent hybridization conditions are as follows: prehybridization of filters containing DNA is carried out for 8 hours to overnight at 65° C. in buffer composed of 6×SSC, 50 mM Tris-HCl (pH 7.5), 1 mM EDTA, 0.02% PVP, 0.02% Ficoll, 0.02% BSA, and 500 μg/ml denatured salmon sperm DNA. Filters are hybridized for 48 hours at 65° C. in prehybridization mixture containing 100 μg/ml denatured salmon sperm DNA and 5-20×$10^6$ cpm of $^{32}$P-labeled probe. Washing of filters is done at 37° C. for 1 hour in a solution containing 2×SSC, 0.01% PVP, 0.01% Ficoll, and 0.01% BSA. This is followed by a wash in 0.1×SSC at 50° C. for 45 min before autoradiography. Alternatively, exemplary conditions of high stringency are as follows: e.g., hybridization to filter-bound DNA in 0.5 M $NaHPO_4$, 7% sodium dodecyl sulfate (SDS), 1 mM EDTA at 65° C., and washing in 0.1×SSC/0.1% SDS at 68° C. (Ausubel et al., eds., 1989, *Current Protocols in Molecular Biologyl*, Vol. I, Green Publishing Associates, Inc., and John Wiley & sons, Inc., New York, at p. 2.10.3). Other conditions of high stringency which may be used are well known in the art. Exemplary low stringency hybridization conditions comprise hybridization in a buffer comprising 35% formamide, 5×SSC, 50 mM Tris-HCl (pH 7.5), 5 mM EDTA, 0.02% PVP, 0.02% Ficoll, 0.2% BSA, 100 μg/ml denatured salmon sperm DNA, and 1 0% (wt/vol) dextran sulfate for 18-20 hours at 40° C., washing in a buffer consisting of 2×SSC, 25 mM Tris-HCl (pH 7.4), 5 mM EDTA, and 0.1% SDS for 1.5 hours at 55° C., and washing in a buffer consisting of 2×SSC, 25 mM Tris-HCl (pH 7.4), 5 mM EDTA, and 0.1% SDS for 1.5 hours at 60° C.

In certain embodiments, a homolog of a subunit binds to the same proteins to which the subunit binds. In certain, more specific embodiments, a homolog of a subunit binds to the same proteins to which the subunit binds wherein the binding affinity between the homolog and the binding partner of the subunit is at least 10%, at least 20%, at least 30%, at least 40%, at least 50%, at least 60%, at least 70%, at least 80%, at least 90%, at least 95% or at least 98% of the binding affinity between the subunit and the binding partner. Binding affinities between proteins can be determined by any method known to the skilled artisan.

In certain embodiments, a fragment of a protein subunit of the complex consists of at least 6 (continuous) amino acids, of at least 10, at least 20 amino acids, at least 30 amino acids, at least 40 amino acids, at least 50 amino acids, at least 75 amino acids, at least 100 amino acids, at least 150 amino acids, at least 200 amino acids, at least 250 amino acids, at least 300 amino acids, at least 400 amino acids, or at least 500 amino acids of the protein subunit of the naturally occurring protein complex. In specific embodiments. Such fragments are not larger than 40 amino acids, 50 amino acids, 75 amino acids, 100 amino acids, 150 amino acids, 200 amino acids, 250 amino acids, 300 amino acids, 400 amino acids, or than 500 amino acids. In more specific embodiments, the functional fragment is capable of forming a complex of the invention, i.e., the fragment can still bind to at least one other protein subunit to form a complex of the invention. In some embodiments, the fragment comprises at least one interacting domain provided in Table 4. In some embodiments, the fragment comprises all interacting domains of the subunit provided in Table 4. In a specific embodiment, fragments are provided herein, which share an identical region of 20, 30, 40, 50 or 60 contiguous amino acids of the interacting domains listed in Table 4.

Derivatives or analogs of subunit proteins include, but are not limited, to molecules comprising regions that are substantially homologous to the subunit proteins, in various embodiments, by at least 30%, 40%, 50%, 60%, 70%, 80%, 90% or 95% identity over an amino acid sequence of identical size or when compared to an aligned sequence in which the alignment is done by a computer homology program known in the art, or whose encoding nucleic acid is capable of hybridizing to a sequence encoding the subunit protein under stringent, moderately stringent, or nonstringent conditions.

Derivatives of a protein subunit include, but are not limited to, fusion proteins of a protein subunit of a complex of the invention to a heterologous amino acid sequence, mutant forms of a protein subunit of a complex of the invention, and chemically modified forms of a protein subunit of a complex of the invention. In a specific embodiment, the functional derivative of a protein subunit of a complex of the invention is capable of forming a complex of the invention, i.e., the derivative can still bind to at least one other protein subunit to form a complex of the invention.

In certain embodiments of the invention, at least two subunits of a complex of the invention are linked to each other via at least one covalent bond. A covalent bond between subunits of a complex of the invention increases the stability of the complex of the invention because it prevents the dissociation of the subunits. Any method known to the skilled artisan can be used to achieve a covalent bond between at least two subunits of the invention.

In specific embodiments, covalent cross-links are introduced between adjacent subunits. Such cross-links can be between the side chains of amino acids at opposing sides of the dimer interface. Any functional groups of amino acid residues at the dimer interface in combination with suitable cross-linking agents can be used to create covalent bonds between the protein subunits at the dimer interface. Existing amino acids at the dimer interface can be used or, alternatively, suitable amino acids can be introduced by site-directed mutagenesis.

In exemplary embodiments, cysteine residues at opposing sides of the dimer interface are oxidized to form disulfide bonds. See, e.g., Reznik et al., (1996) *Nat Bio Technol* 14:1007-1011, at page 1008. 1,3-dibromoacetone can also be used to create an irreversible covalent bond between two sulfhydryl groups at the dimer interface. In certain other embodiments, lysine residues at the dimer inter face are used to create a covalent bond between the protein subunits of the complex. Crosslinkers that can be used to create covalent bonds between the epsilon amino groups of lysine residues are, e.g., but are not limited to, bis(sulfosuccinimidyl) suberate; dimethyladipimidate-2HD1; disuccinimidyl glutarate; N-hydroxysuccinimidyl 2,3-dibromoproprionate.

In other specific embodiments, two or more interacting subunits, or homologues, derivatives or fragments thereof, are directly fused together, or covalently linked together through a peptide linker, forming a hybrid protein having a single unbranched polypeptide chain. Thus, the protein complex may be formed by "intramolecular interactions between two portions of the hybrid protein. In still another embodiment, at least one of the fused or linked interacting subunit in this protein complex is a homologue, derivative or fragment of a native protein.

In specific embodiments, at least one subunit, or a homologue, derivative or fragment thereof, may be expressed as fusion or chimeric protein comprising the subunit, homologue, derivative or fragment, joined via a peptide bond to a heterologous amino acid sequence.

As used herein, a "chimeric protein" or "fusion protein" comprises all or part (preferably a biologically active part) of a polypeptide corresponding to a subunit or a fragment, homologue or derivative thereof, operably linked to a heterologous polypeptide (i.e., a polypeptide other than the polypeptide corresponding to the subunit or a fragment, homologue or derivative thereof). Within the fusion protein, the term "operably linked" is intended to indicate that the polypeptide encompassed by the present invention and the heterologous polypeptide are fused in-frame to each other. The heterologous polypeptide can be fused to the amino-terminus or the carboxyl-terminus of the polypeptide encompassed by the present invention.

In one embodiment, the heterologous amino acid sequence comprises an affinity tag that can be used for affinity purification. In another embodiment, the heterologous amino acid sequence includes a fluorescent label. In still another embodiment, the fusion protein contains a heterologous signal sequence, immunoglobulin fusion protein, toxin, or other useful protein sequences.

A variety of peptide tags known in the art may be used to generate fusion proteins of the protein subunits of a complex of the invention, such as but not limited to the immunoglobulin constant regions, polyhistidine sequence (Petty, 1996, Metal-chelate affinity chromatography, in Current Protocols in Molecular Biology, Vol. 2, Ed. Ausubel et al., Greene Publish. Assoc. & Wiley Interscience), glutathione S-transferase (GST: Smith, 1993, *Methods Mol. Cell* Bio. 4:220-229), the *E. coli* maltose binding protein (Guan et al., 1987, *Gene* 67:21-30), and various cellulose binding domains (U.S. Pat. Nos. 5,496,934:5, 202.247; 5,137,819; Tomme et al., 1994, *Protein Eng.* 7:117-123), etc.

One possible peptide tags are short amino acid sequences to which monoclonal antibodies are available, such as but not limited to the following well known examples, the FLAG epitope, the myc epitope at amino acids 408-439, the influenza virus hemaglutinin (HA) epitope. Other peptide tags are recognized by specific binding partners and thus facilitate isolation by affinity binding to the binding partner, which is preferably immobilized and/or on a solid support. As will be appreciated by those skilled in the art, many methods can be used to obtain the coding region of the above-mentioned peptide tags, including but not limited to, DNA cloning, DNA amplification, and synthetic methods. Some of the peptide tags and reagents for their detection and isolation are available commercially.

In certain embodiments, a combination of different peptide tags is used for the purification of the protein subunits of a complex of the invention or for the purification of a complex. In certain embodiments, at least one subunit has at least two peptide tags, e.g., a FLAG tag and a His tag. The different tags can be fused together or can be fused in different positions to the protein subunit. In the purification procedure, the different peptide tags are used subsequently or concurrently for purification. In certain embodiments, at least two different subunits are fused to a peptide tag, wherein the peptide tags of the two subunits can be identical or different. Using different tagged subunits for the purification of the complex ensures that only complex will be purified and minimizes the amount of uncomplexed protein subunits, such as monomers or homodimers.

Various leader sequences known in the art can be used for the efficient secretion of a protein subunit of a complex of the invention from bacterial and mammalian cells (von Heijne, 1985, J. Mol. Biol. 184:99-105). Leader peptides are selected based on the intended host cell, and may include bacterial, yeast, viral, animal, and mammalian sequences. For example, the herpes virus glycoprotein D leader peptide is suitable for use in a variety of mammalian cells. A preferred leader peptide for use in mammalian cells can be obtained from the V-J2-C region of the mouse immunoglobulin kappa chain (Bernard et al., 1981. *Proc. Natl. Acad. Sci.* 78:5812-5816).

DNA sequences encoding desired peptide tag or leader peptide which are known or readily available from libraries or commercial suppliers are suitable in the practice of this invention.

In certain embodiments, the protein subunits of a complex of the invention are derived from the same species. In more specific embodiments, the protein subunits are all derived from human. In another specific embodiment, the protein subunits are all derived from a mammal.

In certain other embodiments, the protein subunits of a complex of the invention are derived from a non-human species, such as, but not limited to, cow, pig, horse, cat, dog, rat, mouse, a primate (e.g., a chimpanzee, a monkey Such as a cynomolgous monkey). In certain embodiments, one or more subunits are derived from human and the other subunits are derived from a mammal other than a human to give rise to chimeric complexes.

Included within the scope of the invention is an isolated modified protein complex in which the subunits, or homologs, derivatives, or fragments thereof, are differentially modified during or after translation, e.g., by glycosylation, acetylation, phosphorylation, amidation, derivatization by known protecting/blocking groups, proteolytic cleavage, linkage to an antibody molecule or other cellular ligand, etc. Any of numerous chemical modifications may be carried out by known techniques, including but not limited to specific chemical cleavage by cyanogen bromide, trypsin, chymotrypsin, papain, V8 protease, NaBH4, acetylation, formylation, oxidation, reduction, metabolic synthesis in the presence of tunicamycin, etc. In still another embodiment, the protein sequences are modified to have a heterofunctional reagent; such heterofunctional reagents can be used to crosslink the members of the complex.

The protein complexes encompassed by the present invention can also be in a modified form. For example, an antibody selectively immunoreactive with the protein complex can be bound to the protein complex. In another example, a non-antibody modulator capable of enhancing the interaction between the interacting partners in the protein complex may be included.

The above-described protein complexes may further include any additional components, e.g., other proteins, nucleic acids, lipid molecules, monosaccharides or polysaccharides, ions, etc.

TABLE 2

| Protein complex | Subunits of the protein complex |
|---|---|
| BAF | Subunit_1: SMARCC1 or SMARCC2<br>Subunit_2: SMARCC1 or SMARCC2<br>Subunit_3: SMARCD1, SMARCD2, or SMARCD3<br>Subunit_4: SMARCB1<br>Subunit_5: SMARCE1<br>Subunit_6: ARID1A or ARID1B<br>Subunit_7: DPF1, DPF2, or DPF3<br>Subunit_8: ACTL6A<br>Subunit_9: β-Actin<br>Subunit_10: BCL7A, BCL7B, orBCL7C<br>Subunit_11: SMARCA2 or SMARCA4<br>Subunit_12: SS18 or SS18L1 |
| PBAF | Subunit_1: SMARCC1 or SMARCC2<br>Subunit_2: SMARCC1 or SMARCC2<br>Subunit_3: SMARCD1, SMARCD2, or SMARCD3<br>Subunit_4: SMARCB1<br>Subunit_5: SMARCE1<br>Subunit_6: ARID2<br>Subunit_7: BRD7<br>Subunit_8: PHF10<br>Subunit_9: ACTL6A<br>Subunit_10: β-Actin<br>Subunit_11: BCL7A, BCL7B, or BCL7C<br>Subunit_12: SMARCA2 or SMARCA4<br>Subunit_13: PBRM1<br>Subunit_14: PBRM1 |

TABLE 3

| Protein complex | Subunits of the protein complex |
|---|---|
| SMARCC dimer | Subunit_1: SMARCC1 or SMARCC2<br>Subunit_2: SMARCC1 or SMARCC2 |
| Initial BAF Core | Subunit_1: SMARCC1 or SMARCC2<br>Subunit_2: SMARCC1 or SMARCC2<br>Subunit_3: SMARCD1, SMARCD2, or SMARCD3 |
| BAF Core | Subunit_1: SMARCC1 or SMARCC2<br>Subunit_2: SMARCC1 or SMARCC2<br>Subunit_3: SMARCD1, SMARCD2, or SMARCD3<br>Subunit_4: SMARCB1<br>Subunit_5: SMARCE1 |
| ARID/BAF Core intermediate_1 | Subunit_1: SMARCC1 or SMARCC2<br>Subunit_2: SMARCC1 or SMARCC2<br>Subunit_3: SMARCD1, SMARCD2, or SMARCD3<br>Subunit_4: SMARCB1<br>Subunit_5: SMARCE1<br>Subunit_6: ARID1A or ARID1B |
| ARID/BAF Core intermediate_2 | Subunit_1: SMARCC1 or SMARCC2<br>Subunit_2: SMARCC1 or SMARCC2<br>Subunit_3: SMARCD1, SMARCD2, or SMARCD3<br>Subunit_4: SMARCB1<br>Subunit_5: SMARCE1<br>Subunit_6: ARID1A or ARID1B<br>Subunit_7: DPF1, DPF2, or DPF3 |
| ARID/PBAF Core intermediate_1 | Subunit_1: SMARCC1 or SMARCC2<br>Subunit_2: SMARCC1 or SMARCC2<br>Subunit_3: SMARCD1, SMARCD2, or SMARCD3<br>Subunit_4: SMARCB1<br>Subunit_5: SMARCE1<br>Subunit_6: ARID2<br>Subunit_7: BRD7 |
| ARID/PBAF Core intermediate_2 | Subunit_1: SMARCC1 or SMARCC2<br>Subunit_2: SMARCC1 or SMARCC2<br>Subunit_3: SMARCD1, SMARCD2, or SMARCD3<br>Subunit_4: SMARCB1<br>Subunit_5: SMARCE1<br>Subunit_6: ARID2<br>Subunit_7: BRD7<br>Subunit_8: PHF10 |

TABLE 3-continued

| Protein complex | Subunits of the protein complex |
|---|---|
| Non canonical BAF (ncBAF) Core | Subunit_1: SMARCC1 or SMARCC2 |
| | Subunit_2: SMARCC1 or SMARCC2 |
| | Subunit_3: SMARCD1, SMARCD2, or SMARCD3 |
| | Subunit_4: GLTSCR1 or GLTSCR1L |
| BRD9/ncBAF Core | Subunit_1: SMARCC1 or SMARCC2 |
| | Subunit_2: SMARCC1 or SMARCC2 |
| | Subunit_3: SMARCD1, SMARCD2, or SMARCD3 |
| | Subunit_4: GLTSCR1 or GLTSCR1L |
| | Subunit_5: BRD9 |
| ATPase module | Subunit_1: ACTL6A |
| | Subunit_2: β-Actin |
| | Subunit_3: BCL7A, BCL7B, or BCL7C |
| | Subunit_4: SMARCA2 or SMARCA4 |
| SS18 ATPase module | Subunit_1: ACTL6A |
| | Subunit_2: β-Actin |
| | Subunit_3: BCL7A, BCL7B, or BCL7C |
| | Subunit_4: SMARCA2 or SMARCA4 |
| | Subunit_4: SS18 or SS18L1 |
| Non canonical BAF (ncBAF) | Subunit_1: SMARCC1 or SMARCC2 |
| | Subunit_2: SMARCC1 or SMARCC2 |
| | Subunit_3: SMARCD1, SMARCD2, or SMARCD3 |
| | Subunit_4: GLTSCR1 or GLTSCR1L |
| | Subunit_5: BRD9 |
| | Subunit_6: ACTL6A |
| | Subunit_7: β-Actin |
| | Subunit_8: BCL7A, BCL7B, or BCL7C |
| | Subunit_9: SMARCA2 or SMARCA4 |
| | Subunit_10: SS18 or SS18Ll |

TABLE 4

| Interacting Domain Pair | | |
|---|---|---|
| Pair No. | Interacting Domain 1 | Interacting Domain 2 |
| 1 | SMARCC R3 (DR) | SMARCC R3 (DR) |
| 2 | SMARCC R3 (DR) | ARID R3 |
| 3 | SMARCC R3 (DR) | SMARCE1 CC |
| 4 | SMARCC R3 (DR) | SMARCA R2 |
| 5 | SMARCC R3 (DR) | DPF2 R2 |
| 6 | SMARCC R3 (DR) | SMARCD R2 |
| 7 | SMARCC R3 (DR) | ACTL6A |
| 8 | SMARCC CAR | SMARCD SWIB |
| 9 | SMARCC CAR | ARID1 R3 |
| 10 | SMARCC CAR | SMARCE1 CC |
| 11 | SMARCC CAR | SMARCD R1 |
| 12 | SMARCC CAR | ACTL6A |
| 13 | SMARCC CAR | ARID1 CBRB |
| 14 | SMARCC CAR | SMARCB1 CC |
| 15 | SMARCC R2 | ARID1 R3 |
| 16 | SMARCC R2 | SMARCA R2 |
| 17 | SMARCC R1 | DPF2 R2 |
| 18 | SMARCC R1 | SMARCD R1 |
| 19 | SMARCC R1 | ACTL6A |
| 20 | SMARCC R1 | SMARCC R1 |
| 21 | SMARCA Bromo | SMARCC R1 |
| 22 | SMARCC SWIRM | BCL7 BCL N |
| 23 | SMARCC R2 | SMARCC R2 |
| 24 | SMARCA R5 | SMARCC R2 |
| 25 | SMARCC SANT | SMARCD R2 |
| 26 | ARID1 CBR A | SMARCD1 R1 |
| 27 | ARID1 CBR A | SMARCE1 R2 |
| 28 | ARID1 CBR A | SMARCA R2 |
| 29 | ARID1 CBR A | DPF2 R2 |
| 30 | ARID1 R3 | SMARCD R1 |
| 31 | ARID1 R3 | SMARCE CC |
| 32 | ARID1 R3 | DPF2 Requiem |
| 33 | ARID1 R3 | SMARCB1 WH |
| 34 | ARID1 CBR B | SMARCD1 R1 |
| 35 | ARID1 CBR B | SMARCD1 R2 |
| 36 | ARID1 CBR B | SMARCA R2 |
| 37 | ARID1 CBR B | SMARCE1 R2 |
| 38 | ARID1 CBR B | SMARCC R1 |
| 39 | ARID1 CBR B | SMARCA R1 |

TABLE 4-continued

| Interacting Domain Pair | | |
|---|---|---|
| Pair No. | Interacting Domain 1 | Interacting Domain 2 |
| 40 | ARID1 R4 | SMARCA R2 |
| 41 | ARID1 R4 | SMARCA HSA |
| 42 | ARID1 R4 | SMARCE R2 |
| 43 | ARID1 R4 | ACTL6A |
| 44 | ARID1 R2 | SMARCD R1 |
| 45 | ARID1 R2 | ACTL6A |
| 46 | ARID1 R2 | SMARCC R3 |
| 47 | ARID1 R1 | SMARCD R1 |
| 48 | ARID1 R1 | SMARCC R1 |
| 49 | ARID1 R1 | ACTL6A |
| 50 | ARID1 ARID | SMARCC R1 |
| 51 | ARID1 ARID | SMARCA R2 |
| 52 | ARID2 CBR | SMARCD R2 |
| 53 | ARID2 CBR | SMARCC R3 |
| 54 | ARID2 R3 | SMARCC R3 |
| 55 | ARID2 R4 | SMARCD R1 |
| 56 | ARID2 R4 | PHF10 R4 |
| 57 | SMARCA HSA | ACTL6A |
| 58 | SMARCA HSA | BCL7 BCL N |
| 59 | SMARCA HSA | ACTB |
| 60 | SMARCA HSA | SMARCB1 WH |
| 61 | SMARCA HSA | SMARCC R1 |
| 62 | SMARCA HSA | SMARCB1 R2 |
| 63 | SMARCA R2 | SMARCD R1 |
| 64 | SMARCA R2 | DPF2 R2 |
| 65 | SMARCA R2 | BRD7 DUF3512 |
| 66 | SMARCA R2 | SMARCE1 R2 |
| 67 | SMARCA R2 | PBRM1 R10 |
| 68 | SMARCA R2 | BCL7 BCL N |
| 69 | SMARCA R2 | SMARCC R1 |
| 70 | SMARCA R3 | ACTB |
| 71 | SMARCA R3 | SMARCC R1 |
| 72 | SMARCA Hel ATP | BCL7 BCL N |
| 73 | SMARCA Hel ATP | ACTB |
| 74 | SMARCA Hel ATP | ACTL6A |
| 75 | SMARCA Hel ATP | SMARCC R1 |
| 76 | SMARCA Hel ATP | SMARCB1 R2 |
| 77 | SMARCA Hel ATP | PHF10 SAY |
| 78 | SMARCA Hel Cterm | ACTL6A |
| 79 | SMARCA R4 | SMARCC R2 |
| 80 | SMARCA R5 | ACTL6A |
| 81 | SMARCA R1 | SMARCD R1 |
| 82 | SMARCA QLQ | SMARCC R2 |
| 83 | SMARCA Bromo | ACTL6A |
| 84 | SMARCA Bromo | DPF2 R2 |
| 85 | SMARCA R6 | DPF2 R2 |
| 86 | SMARCA R6 | SMARCC R1 |
| 87 | SMARCA R6 | DPF2 PHD1 |
| 88 | ACTB | ACTL6A |
| 89 | SMARCA R1 | SS18 N |

* Table 4 further encompasses any interacting domain pair described herein, which includes interacting domain pairs described in the Tables, the Examples, and the detailed description.

III. Methods of Preparing Protein Complexes

The protein complexes and subunit proteins encompassed by the present invention can be obtained by methods well known in the art for protein purification and recombinant protein expression, as well as the methods described in details in the Examples. For example, the protein complexes encompassed by the present invention can be isolated using the TAP method described in Section 5, infra, and in WO 00/09716 and Rigaut et al., 1999, *Nature Biotechnol.* 17:1030-1032, which are each incorporated by reference in their entirety. Additionally, the protein complexes can be isolated by immunoprecipitation of the subunit proteins and combining the immunoprecipitated proteins. The protein complexes can also be produced by recombinantly expressing the subunit proteins and combining the expressed proteins.

In certain embodiments, the complexes can be generated by co-expressing the subunits of the complex in a cell and subsequently purifying the complex. In certain, more specific embodiments, the cell expresses at least one subunit of the complex by recombinant DNA technology. In other embodiments, the cells normally express the subunits of the complex. In certain other embodiments, the subunits of the complex are expressed separately, wherein the subunits can be expressed using recombinant DNA technology or wherein at least one subunit is purified from a cell that normally expresses the subunit. The individual subunits of the complex are incubated in vitro under conditions conducive to the binding of the subunits of a complex of the invention to each other to generate a complex of the invention.

If one or more of the subunits is expressed by recombinant DNA technology, any method known to the skilled artisan can be used to produce the recombinant protein. The nucleic and amino acid sequences of the subunit proteins of the protein complexes encompassed by the present invention are provided herein, such as in Table 1, and can be obtained by any method known in the art, e.g., by PCR amplification using synthetic primers hybridizable to the 3' and 5' ends of each sequence, and/or by cloning from a cDNA or genomic library using an oligonucleotide specific for each nucleotide sequence.

For recombinant expression of one or more of the proteins, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals can also be supplied by the native promoter of the subunit protein gene, and/or flanking regions.

A variety of host-vector systems may be utilized to express the protein coding sequence. These include but are not limited to mammalian cell systems infected with virus (e.g., vaccinia virus, adenovirus, etc.); insect cell systems infected with virus (e.g., baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system utilized, any one of a number of suitable transcription and translation elements may be used.

In a preferred embodiment, a complex encompassed by the present invention is obtained by expressing the entire coding sequences of the subunit proteins in the same cell, either under the control of the same promoter or separate promoters. In yet another embodiment, a derivative, fragment or homologue of a subunit protein is recombinantly expressed. Preferably the derivative, fragment or homologue of the protein forms a complex with the other subunits of the complex, and more preferably forms a complex that binds to an anti-complex antibody.

Any method available in the art can be used for the insertion of DNA fragments into a vector to construct expression vectors containing a chimeric gene consisting of appropriate transcriptional/translational control signals and protein coding sequences. These methods may include in vitro recombinant DNA and synthetic techniques and in vivo recombinant techniques (genetic recombination). Expression of nucleic acid sequences encoding a subunit protein, or a derivative, fragment or homologue thereof, may be regulated by a second nucleic acid sequence so that the gene or fragment thereof is expressed in a host transformed with the recombinant DNA molecule(s). For example, expression of the proteins may be controlled by any promoter/enhancer known in the art. In a specific embodiment, the promoter is not native to the gene for the subunit protein. Promoters that may be used can be selected from among the many known in the art, and are chosen so as to be operative in the selected host cell.

In a specific embodiment, a vector is used that comprises a promoter operably linked to nucleic acid sequences encoding a subunit protein, or a fragment, derivative or homologue thereof, one or more origins of replication, and optionally, one or more selectable markers (e.g., an antibiotic resistance gene).

In another specific embodiment, an expression vector containing the coding sequence, or a portion thereof, of a subunit protein, either together or separately, is made by subcloning the gene sequences into the EcoRI restriction site of each of the three pGEX vectors (glutathione S-transferase expression vectors; Smith and Johnson, 1988, *Gene* 7:31-40). This allows for the expression of products in the correct reading frame.

Expression vectors containing the sequences of interest can be identified by three general approaches: (a) nucleic acid hybridization, (b) presence or absence of "marker" gene function, and (c) expression of the inserted sequences. In the first approach, coding sequences can be detected by nucleic acid hybridization to probes comprising sequences homologous and complementary to the inserted sequences. In the second approach, the recombinant vector/host system can be identified and selected based upon the presence or absence of certain "marker" functions (e.g., resistance to antibiotics, occlusion body formation in baculovirus, etc.) caused by insertion of the sequences of interest in the vector.

For example, if a subunit protein gene, or portion thereof, is inserted within the marker gene sequence of the vector, recombinants containing the encoded protein or portion will be identified by the absence of the marker gene function (e.g., loss of β-galactosidase activity). In the third approach, recombinant expression vectors can be identified by assaying for the subunit protein expressed by the recombinant vector. Such assays can be based, for example, on the physical or functional properties of the interacting species in in vitro assay systems, e.g., formation of a complex comprising the protein or binding to an anti-complex antibody.

Once recombinant subunit protein molecules are identified and the complexes or individual proteins isolated, several methods known in the art can be used to propagate them. Using a suitable host system and growth conditions, recombinant expression vectors can be propagated and amplified in quantity. As previously described, the expression vectors or derivatives which can be used include, but are not limited to, human or animal viruses such as vaccinia virus or adenovirus; insect viruses such as baculovirus, yeast vectors; bacteriophage vectors such as lambda phage; and plasmid and cosmid vectors.

In addition, a host cell strain may be chosen that modulates the expression of the inserted sequences, or modifies or processes the expressed proteins in the specific fashion desired. Expression from certain promoters can be elevated in the presence of certain inducers; thus expression of the genetically-engineered subunit proteins may be controlled. Furthermore, different host cells have characteristic and specific mechanisms for the translational and post-translational processing and modification (e.g., glycosylation, phosphorylation, etc.) of proteins. Appropriate cell lines or host systems can be chosen to ensure that the desired modification and processing of the foreign protein is achieved. For example, expression in a bacterial system can be used to produce an unglycosylated core protein, while expression in mammalian cells ensures "native" glycosylation of a heterologous protein. Furthermore, different vector/host expression systems may effect processing reactions to different extents.

In other specific embodiments, a subunit protein or a fragment, homologue or derivative thereof, may be expressed as fusion or chimeric protein product comprising the protein, fragment, homologue, or derivative joined via a peptide bond to a heterologous protein sequence of a different protein. Such chimeric products can be made by ligating the appropriate nucleic acid sequences encoding the desired amino acids to each other by methods known in the art, in the proper coding frame, and expressing the chimeric products in a suitable host by methods commonly known in the art. Alternatively, such a chimeric product can be made by protein synthetic techniques, e.g., by use of a peptide synthesizer. Chimeric genes comprising a portion of a subunit protein fused to any heterologous protein-encoding sequences may be constructed.

In particular, protein subunit derivatives can be made by altering their sequences by substitutions, additions or deletions that provide for functionally equivalent molecules. Due to the degeneracy of nucleotide coding sequences, other DNA sequences that encode substantially the same amino acid sequence as a subunit gene or cDNA can be used in the practice encompassed by the present invention. These include but are not limited to nucleotide sequences comprising all or portions of the subunit protein gene that are altered by the substitution of different codons that encode a functionally equivalent amino acid residue within the sequence, thus producing a silent change. Likewise, the derivatives of the invention include, but are not limited to, those containing, as a primary amino acid sequence, all or part of the amino acid sequence of a subunit protein, including altered sequences in which functionally equivalent amino acid residues are substituted for residues within the sequence resulting in a silent change. For example, one or more amino acid residues within the sequence can be substituted by another amino acid of a similar polarity that acts as a functional equivalent, resulting in a silent alteration. Substitutes for an amino acid within the sequence may be selected from other members of the class to which the amino acid belongs. For example, the nonpolar (hydrophobic) amino acids include alanine, leucine, isoleucine, valine, proline, phenylalanine, tryptophan and methionine. The polar neutral amino acids include glycine, serine, threonine, cysteine, tyrosine, asparagine, and glutamine. The positively charged (basic) amino acids include arginine, lysine and histidine. The negatively charged (acidic) amino acids include aspartic acid and glutamic acid.

In a specific embodiment, up to 1%, 2%, 5%, 10%, 15% or 20% of the total number of amino acids in the wild type protein are substituted or deleted; or 1, 2, 3, 4, 5, or 6 or up to 10 or up to 20 amino acids are inserted, substituted or deleted relative to the wild type protein.

The protein subunit derivatives and analogs of the invention can be produced by various methods known in the art. The manipulations which result in their production can occur at the gene or protein level. For example, the cloned gene sequences can be modified by any of numerous strategies known in the art (Sambrook et al., 1989, Molecular Cloning, A Laboratory Manual, 2d Ed., Cold Spring Harbor Laboratory Press, Cold Spring Harbor, New York). The sequences can be cleaved at appropriate sites with restriction endonuclease(s), followed by further enzymatic modification if desired, isolated, and ligated in vitro. In the production of the gene encoding a derivative, homologue or analog of a subunit protein, care should be taken to ensure that the modified gene retains the original translational reading frame, uninterrupted by translational stop signals, in the gene region where the desired activity is encoded.

Additionally, the encoding nucleic acid sequence can be mutated in vitro or in vivo, to create and/or destroy translation, initiation, and/or termination sequences, or to create variations in coding regions and/or form new restriction endonuclease sites or destroy pre-existing ones, to facilitate further in vitro modification. Any technique for mutagenesis known in the art can be used, including but not limited to, chemical mutagenesis and in vitro site-directed mutagenesis (Hutchinson et al., 1978*, J. Bioi. Chern.* 253:6551-6558), amplification with PCR primers containing a mutation, etc.

Once a recombinant cell expressing a subunit protein, or fragment or derivative thereof, is identified, the individual gene product or complex can be isolated and analyzed. This is achieved by assays based on the physical and/or functional properties of the protein or complex, including, but not limited to, radioactive labeling of the product followed by analysis by gel electrophoresis, immunoassay, cross-linking to marker-labeled product, etc.

The subunit proteins and complexes may be isolated and purified by standard methods known in the art (either from natural sources or recombinant host cells expressing the complexes or proteins) or methods described in the examples herein, including but not restricted to column chromatography (e.g., ion exchange, affinity, gel exclusion, reversed-phase high pressure, fast protein liquid, etc.), differential centrifugation, differential solubility, or by any other standard technique used for the purification of proteins. In some embodiment, the isolation methods include the density sedimentation-based approaches. Functional properties may be evaluated using any suitable assay known in the art.

Alternatively, once a subunit protein or its derivative, is identified, the amino acid sequence of the protein can be deduced from the nucleic acid sequence of the chimeric gene from which it was encoded. As a result, the protein or its derivative can be synthesized by standard chemical methods known in the art (e.g., Hunkapiller et al., 1984*, Nature* 310:105-111).

In addition, complexes of analogs and derivatives of subunit proteins can be chemically synthesized. For example, a peptide corresponding to a portion of a subunit protein, which comprises the desired domain or mediates the desired activity in vitro (e.g., complex formation) can be synthesized by use of a peptide synthesizer.

Furthermore, if desired, non-classical amino acids or chemical amino acid analogs can be introduced as a substitution or addition into the protein sequence. Non-classical amino acids include but are not limited to the D-isomers of the common amino acids, α-amino isobutyric acid, 4-aminobutyric acid (4-Abu), 2-aminobutyric acid (2-Abu), 6-amino hexanoic acid (Ahk), 2-amino isobutyric acid (2-Aib), 3-amino propionoic acid, ornithine, norleucine, norvaline, hydroxyproline, sarcosine, citrulline, cysteic acid. t-butylglycine, t-butylalanine, phenylglycine, cyclohexylalanine, β-alanine, fluoro-amino acids, designer amino acids such as β-methyl amino acids, Ca-methyl amino acids. Na-methylamino acids, and amino acid analogs in general. Furthermore, the amino acid can be D (dextrorotary) or L (levorotary).

In cases where natural products are suspected of being mutant or are purified from new species, the amino acid sequence of a subunit protein purified from the natural Source. as well as those expressed in vitro, or from synthesized expression vectors in vVivo or in vitro, can be determined from analysis of the DNA sequence, or alternatively, by direct sequencing of the purified protein. Such analysis can be performed by manual sequencing or through use of an automated amino acid sequenator.

The complexes can also be analyzed by hydrophilicity analysis (Hopp and Woods, 1981, Proc. Natl. Acad. Sci. USA 78:3824-3828). A hydrophilicity profile can be used to identify the hydrophobic and hydrophilic regions of the proteins, and help predict their orientation in designing substrates for experimental manipulation, such as in binding experiments, antibody synthesis, etc. Secondary structural analysis can also be done to identify regions of the subunit proteins, or their derivatives, that assume specific structures (Chou and Fasman, 1974, Biochemistry 13:222-23). Manipulation, translation, secondary structure prediction, hydrophilicity and hydrophobicity profile predictions, open reading frame prediction and plotting, and determination of sequence homologies, etc., can be accomplished using computer software programs available in the art.

Other methods of structural analysis including but not limited to X-ray crystallography (Engstrom, 1974, Biochem. Exp. Bioi. 11:7-13), mass spectroscopy and gas chromatography (Methods in Protein Science, J. Wiley and Sons, New York, 1997), and computer modeling (Fietterick and Zoller, eds., 1986, Computer Graphics and Molecular Modeling, In: Current Communications in Molecular Biology, Cold Spring Harbor Laboratory, Cold Spring Harbor Press, New York) can also be employed.

In certain embodiments, at least one subunit of the complex is generated by recombinant DNA technology and is a derivative of the naturally occurring protein. In certain embodiments, the derivative is a fusion protein, wherein the amino acid sequence of the naturally occurring protein is fused to a second amino acid sequence. The second amino acid sequence can be a peptide tag that facilitates the purification, immunological detection and identification as well as visualization of the protein. A variety of peptide tags with different functions and affinities can be used in the invention to facilitate the purification of the subunit or the complex comprising the subunit by affinity chromatography. A specific peptide tag comprises the constant regions of an immunoglobulin. In other embodiments, the subunit is fused to a leader sequence to promote secretion of the protein subunit from the cell that expresses the protein subunit. Other peptide tags that can be used with the invention include, but are not limited to, FLAG epitope or HA tag.

If the subunits of the complex are co-expressed, the complex can be purified by any method known to the skilled artisan, including immunoprecipitation, ammonium Sulfate precipitation, acid extraction, anion or cation exchange chromatography, phosphocellulose chromatography, immunoaffinity chromatography, hydroxyapatite chromatography, and lectin chromatography.

The methods described herein can be used to purify the individual subunits of the complex of the invention. The methods can also be used to purify the entire complex. Generally, the purification conditions as well as the dissociation constant of the complex will determine whether the complex remains intact during the purification procedure. Such conditions include, but are not limited to, salt concentration, detergent concentration, pH and redox-potential.

If at least one subunit of the complex comprises a peptide tag, the invention the invention also contemplates methods for the purification of the complexes of the invention which are based on the properties of the peptide tag. One approach is based on specific molecular interactions between a tag and its binding partner. The other approach relies on the immunospecific binding of an antibody to an epitope present on the tag. The principle of affinity chromatography well known in the art is generally applicable to both of these approaches. In another embodiment, the complex is purified using immunoprecipitation.

In certain embodiments, the individual subunits of a complex of the invention are expressed separately. The subunits are subsequently incubated under conditions conducive to the binding of the subunits of the complex to each other to generate the complex. In certain, more specific embodiments, the subunits are purified before complex formation. In other embodiments the supernatants of cells that express the subunit (if the subunit is secreted) or cell lysates of cells that express the subunit (if the subunit is not secreted) are combined first to give rise to the complex, and the complex is purified subsequently. Parameters affecting the ability of the subunits of the invention to bind to each other include, but are not limited to, salt concentration, detergent concentration, pH, and redox-potential. Once the complex has formed, the complex can be purified or concentrated by any method known to the skilled artisan. In certain embodiments, the complex is separated from the remaining individual subunits by filtration. The pore size of the filter should be such that the individual subunits can still pass through the filter, but the complex does not pass through the filter. Other methods for enriching the complex include Sucrose gradient centrifugation and chromatography.

IV. Screening Methods a. Modulators of Complex Formation

A complex encompassed by the present invention, the component proteins of the complex and nucleic acids encoding the component proteins, as well as derivatives and fragments of the amino and nucleic acids, can be used to screen for compounds that bind to, or modulate the amount of, activity of, formation of, or stability of, said complex, and thus, have potential use as modulators, i.e., agonists or antagonists, of complex activity, complex stability, and/or complex formation, i.e., the amount of complex formed, and/or protein component composition of the complex.

Thus, the present invention is also directed to methods for screening for molecules that bind to, or modulate the amount of activity of, or protein component composition of a complex encompassed by the present invention. In one embodiment of the invention, the method for screening for a molecule that modulates directly or indirectly the function, activity or formation of a complex encompassed by the present invention comprises exposing said complex, or a cell or organism containing the complex machinery, to one or more test agents under conditions conducive to modulation; and determining the amount of activity of or identities of the protein components of said complex, wherein a change in said amount, activity, or identities relative to said amount, activity or identities in the absence of the test agents indicates that the test agents modulate function, activity or formation of said complex. Such screening assays can be carried out using cell-free and cell-based methods that are commonly known in the art.

In one embodiment, the method for screening for molecules that bind to, or modulate the amount of, activity of, formation of, or stability of, a complex encompassed by the present invention further comprises incubating subunits of the isolated modified protein complex in the presence of a test agent under conditions conductive to form the modified protein complex prior to step of contacting described above. In another embodiment, the method further comprises a step of determining the presence and/or amount of the individual subunits in the isolated modified protein complex.

The present invention is further directed to methods for screening for molecules that modulate the expression of a subunit of a complex encompassed by the present invention. In one embodiment of the invention, the method for screening for a molecule that modulates the expression of a subunit of a complex of the invention comprises exposing a cell or organism containing the nucleic acid encoding the component, to one or more compounds under conditions conducive to modulation; and determining the amount of activity of, or identities of the protein components of said complex, wherein a change in said amount, activity, or identities relative to said amount, activity or identities in the absence of said compounds indicates that the compounds modulate expression of said complex. Such screening assays can be carried out using cell-free and cell based methods that are commonly known in the art. If activity of the complex or component is used as read-out of the assay, subsequent assays, such as western blot analysis or northern blot analysis, may be performed to verify that the modulated expression levels of the component are responsible for the modulated activity.

In a further specific embodiment, a modulation of the formation or stability of a complex can be determined. In some embodiment, the agent inhibits the formation or stability of the isolated modified protein complex. In specific embodiments, the agent inhibits the formation or stability of the isolated modified protein complex by inhibiting the interaction between at least one interacting domain pair listed in Table 4. The agent may be, e.g., a small molecule inhibitor, a small molecule degrader, CRISPR guide RNA (gRNA), RNA interfering agent, oligonucleotide, peptide or peptidomimetic inhibitor, aptamer, antibody, or intrabody. In a specific embodiment, the agent comprises an antibody and/or intrabody, or an antigen binding fragment thereof, which specifically binds to at least one subunit of the isolated modified protein complex. In some other embodiments, the agent enhances the formation or stability of the isolated modified protein complex. In specific embodiments, the agent enhances the formation or stability of the protein complex by stabilizing the interaction between at least one interacting domain pair listed in Table 4. The agent may be a small molecule compound, e.g., a small molecule stabilizer.

Such a modulation can either be a change in the typical time course of its formation or a change in the typical steps leading to the formation of the complete complex. Such changes can for example be detected by analyzing and comparing the process of complex formation in untreated wild type cells of a particular type and/or cells showing or having the predisposition to develop a certain disease phenotype and/or cells which have been treated with particular conditions and/or particular agents in a particular situation. Methods to study such changes in time course are well known in the art and include for example Western-blot analysis of the proteins in the complex isolated at different steps of its formation.

In a specific embodiment, fragments and/or analogs of protein components of a complex, especially peptidomimetics, are screened for activity as competitive or non-competitive inhibitors of complex formation, which thereby inhibit complex activity or formation.

In another embodiment, the present invention is directed to a method for screening for a molecule that binds a protein complex encompassed by the present invention comprising exposing said complex, or a cell or organism containing the complex machinery, to one or more candidate molecules; and determining whether said complex is bound by any of said candidate molecules.

Screening the libraries can be accomplished by any of a variety of commonly known methods. See, e.g., the following references, which disclose screening of peptide libraries: Parmley and Smith, 1989, *Adv. Exp. Med. Biol.* 251:215-218: Scott and Smith, 1990, *Science* 249:386-390; Fowlkes et al., 1992, *BioTechniques* 13:422-427; Oldenburg et al., 1992, *Proc. Natl. Acad. Sci. USA* 89:5393-5397: Yu et al., 1994, *Cell* 76:933-945; Staudt et al., 1988, *Science* 241:577-580; Bock et al., 1992, *Nature* 355:564-566: Tuerk et al., 1992, *Proc. Natl. Acad. Sci. USA* 89:6988-6992: Ellington et al., 1992, *Nature* 355:850-852; U.S. Pat. Nos. 5,096,815, 5,223,409, and 5,198,346, all to Ladner et al.; Rebar and Pabo, 1993, *Science* 263:671-673; and International Patent Publication No. WO 94/18318.

In a specific embodiment, screening can be carried out by contacting the library members with a complex immobilized on a solid phase, and harvesting those library members that bind to the protein (or encoding nucleic acid or derivative). Examples of such screening methods, termed "panning" techniques, are described by way of example in Parmley and Smith, 1988, *Gene* 73:305-318; Fowlkes et al., 1992, *BioTechniques* 13:422-427; International Patent Publication No. WO 94/18318; and in references cited herein above.

In a specific embodiment, fragments and/or analogs of protein components of a complex, especially peptidomimetics, are screened for activity as competitive or non-competitive inhibitors of complex formation (amount of complex or composition of complex) or activity in the cell, which thereby inhibit complex activity or formation in the cell.

In one embodiment, agents that modulate (i.e., antagonize or agonize) complex activity or formation can be screened for using a binding inhibition assay, wherein agents are screened for their ability to modulate formation of a complex under aqueous, or physiological, binding conditions in which complex formation occurs in the absence of the agent to be tested. Agents that interfere with the formation of complexes of the invention are identified as antagonists of complex formation. Agents that promote the formation of complexes are identified as agonists of complex formation. Agents that completely block the formation of complexes are identified as inhibitors of complex formation.

Methods for screening may involve labeling the component proteins of the complex with radioligands (e.g., $^{125}I$ or $^{3}H$), magnetic ligands (e.g., paramagnetic beads covalently attached to photobiotin acetate), fluorescent ligands (e.g., fluorescein or rhodamine), or enzyme ligands (e.g., luciferase or β-galactosidase). The reactants that bind in solution can then be isolated by one of many techniques known in the art, including but not restricted to, co-immunoprecipitation of the labeled complex moiety using antisera against the unlabeled binding partner (or labeled binding partner with a distinguishable marker from that used on the second labeled complex moiety), immunoaffinity chromatography, size exclusion chromatography, and gradient density centrifugation. In a preferred embodiment, the labeled binding partner is a small fragment or peptidomimetic that is not retained by a commercially available filter. Upon binding, the labeled species is then unable to pass through the filter, providing for a simple assay of complex formation.

In certain embodiments, the protein components of a complex of the invention are labeled with different fluorophores such that binding of the components to each other results in FRET (Fluorescence Resonance Energy Transfer). If the addition of a compound results in a difference in FRET compared to FRET in the absence of the compound, the compound is identified as a modulator of complex formation. If FRET in the presence of the compound is decreased in comparison to FRET in the absence of the compound, the compound is identified as an inhibitor of complex formation. If FRET in the presence of the compound is increased in comparison to FRET in the absence of the compound, the compound is identified as an activator of complex formation.

In certain other embodiments, a protein component of a complex of the invention is labeled with a fluorophore such that binding of the component to another protein component to form a complex of the invention results in FP (Fluorescence Polarization). If the addition of a compound results in a difference in FP compared to FP in the absence of the compound, the compound is identified as a modulator of complex formation.

Methods commonly known in the art are used to label at least one of the component members of the complex. Suitable labeling methods include, but are not limited to, radiolabeling by incorporation of radiolabeled amino acids, e.g., $^{3}$H-leucine or $^{35}$8-methionine, radiolabeling by post-translational iodination with $^{125}$I or $^{131}$I using the chloramine T method, Bolton-Hunter reagents, etc., or labeling with $^{32}$P using phosphorylase and inorganic radiolabeled phosphorous, biotin labeling with photobiotin-acetate and sunlamp exposure, etc. In cases where one of the members of the complex is immobilized, e.g., as described infra, the free species is labeled. Where neither of the interacting species is immobilized, each can be labeled with a distinguishable marker such that isolation of both moieties can be followed to provide for more accurate quantification, and to distinguish the formation of homomeric from heteromeric complexes. Methods that utilize accessory proteins that bind to one of the modified interactants to improve the sensitivity of detection, increase the stability of the complex, etc., are provided.

The physical parameters of complex formation can be analyzed by quantification of complex formation using assay methods specific for the label used, e.g., liquid scintillation counting for radioactivity detection, enzyme activity for enzyme-labeled moieties, etc. The reaction results are then analyzed utilizing Scatchard analysis, Hill analysis, and other methods commonly known in the arts (see, e.g., Proteins, Structures, and Molecular Principles, 2nd Edition (1993) Creighton, Ed., W.H. Freeman and Company, New York).

Agents/molecules (candidate molecules) to be screened can be provided as mixtures of a limited number of specified compounds, or as compound libraries, peptide libraries and the like. Agents/molecules to be screened may also include all forms of antisera, antisense nucleic acids, etc., that can modulate complex activity or formation. Exemplary candidate molecules and libraries for screening are set forth below.

In certain embodiments, the compounds are screened in pools. Once a positive pool has been identified, the individual molecules of that pool are tested separately. In certain embodiments, the pool size is at least 2, at least 5, at least 10, at least 25, at least 50, at least 75, at least 100, at least 150, at least 200, at least 250, or at least 500 compounds.

In certain embodiments of the invention, the screening method further comprises determining the structure of the candidate molecule. The structure of a candidate molecule can be determined by any technique known to the skilled artisan.

i. Test Agents

Any molecule known in the art can be tested for its ability to modulate (increase or decrease) the amount of, activity of, or protein component composition of a complex encompassed by the present invention as detected by a change in the amount of, activity of, or protein component composition of said complex. By way of example, a change in the amount of the complex can be detected by detecting a change in the amount of the complex that can be isolated from a cell expressing the complex machinery. In other embodiments, a change in signal intensity (e.g., when using FRET or FP) in the presence of a compound compare to the absence of the compound indicates that the compound is a modulator of complex formation. For identifying a molecule that modulates complex activity, candidate molecules can be directly provided to a cell expressing the complex, or, in the case of candidate proteins, can be provided by providing their encoding nucleic acids under conditions in which the nucleic acids are recombinantly expressed to produce the candidate proteins within the cell expressing the complex machinery, the complex is then purified from the cell and the purified complex is assayed for activity using methods well known in the art, not limited to those described, Supra.

In certain embodiments, the invention provides screening assays using chemical libraries for molecules which modulate, e.g., inhibit, antagonize, or agonize, the amount of, activity of, or protein component composition of the complex. The chemical libraries can be peptide libraries, peptidomimetic libraries, chemically synthesized libraries, recombinant, e.g., phage display libraries, and in vitro translation-based libraries, other non-peptide synthetic organic libraries, etc.

Exemplary libraries are commercially available from several sources (ArOule, Tripos/PanLabs, ChemDesign, and Pharmacopoeia). In some cases, these chemical libraries are generated using combinatorial strategies that encode the identity of each member of the library on a substrate to which the member compound is attached, thus allowing direct and immediate identification of a molecule that is an effective modulator. Thus, in many combinatorial approaches, the position on a plate of a compound specifies that compound's composition. Also, in one example, a single plate position may have from 1-20 chemicals that can be screened by administration to a well containing the interactions of interest. Thus, if modulation is detected, Smaller and Smaller pools of interacting pairs can be assayed for the modulation activity. By Such methods, many candidate molecules can be screened.

Many diversity libraries suitable for use are known in the art and can be used to provide compounds to be tested according to the present invention. Alternatively, libraries can be constructed using standard methods. Chemical (synthetic) libraries, recombinant expression libraries, or polysome based libraries are exemplary types of libraries that can be used.

The libraries can be constrained or semirigid (having some degree of structural rigidity), or linear or non-constrained. The library can be a cDNA or genomic expression library, random peptide expression library or a chemically synthesized random peptide library, or non-peptide library.

Expression libraries are introduced into the cells in which the assay occurs, where the nucleic acids of the library are expressed to produce their encoded proteins.

In one embodiment, peptide libraries that can be used in the present invention may be libraries that are chemically synthesized in vitro. Examples of such libraries are given in Houghten et al., 1991, *Nature* 354:84-86, which describes mixtures of free hexapeptides in which the first and second residues in each peptide were individually and specifically defined; Lam et al., 1991, *Nature* 354:82-84, which describes a "one bead, one peptide' approach in which a solid phase split synthesis scheme produced a library of peptides in which each bead in the collection had immobilized thereon a single, random sequence of amino acid residues; Medynski, 1994, *Bio Technology* 12:709-710, which describes split synthesis and T-bag synthesis methods; and Gallop et al., 1994, *J. Medicinal Chemistry* 37 (9): 1233-1251. Simply by way of other examples, a combinatorial library may be prepared for use, according to the methods of Ohlmeyer et al., 1993, *Proc. Natl. Acad. Sci. USA* 90:10922-10926; Erb et al., 1994, *Proc. Natl. Acad. Sci. USA* 91:11422-11426; Houghten et al., 1992, *Biotechniques* 13:412; Jayawickreme et al., 1994, *Proc. Natl. Acad. Sci. USA* 91:1614-1618; or Salmon et al., 1993. *Proc. Natl. Acad. Sci. USA* 90:11708-11712. PCT Publication No. WO 93/20242 and Brenner and Lerner. 1992, *Proc. Natl. Acad. Sci. USA* 89:5381-5383 describe "encoded combinatorial chemical libraries," that contain oligonucleotide identifiers for each chemical polymer library member.

In a preferred embodiment, the library screened is a biological expression library that is a random peptide phage display library, where the random peptides are constrained (e.g., by virtue of having disulfide bonding).

Further, more general, structurally constrained, organic diversity (e.g., nonpeptide) libraries, can also be used.

Conformationally constrained libraries that can be used include but are not limited to those containing invariant cysteine residues which, in an oxidizing environment, cross link by disulfide bonds to form cystines, modified peptides (e.g., incorporating fluorine, metals, isotopic labels, are phosphorylated, etc.), peptides containing one or more non-naturally occurring amino acids, non-peptide structures, and peptides containing a significant fraction of Y-carboxyglutamic acid.

Libraries of non-peptides, e.g., peptide derivatives (for example that contain one or more non-naturally occurring amino acids) can also be used. One example of these are peptoid libraries (Simon et al., 1992, *Proc. Natl. Acad. Sci. USA* 89:9367-9371). Peptoids are polymers of non-natural amino acids that have naturally occurring side chains attached not to the alpha carbon but to the backbone amino nitrogen.

Since peptoids are not easily degraded by human digestive enzymes, they are advantageously more easily adaptable to drug use. Another example of a library that can be used, in which the amide functionalities in peptides have been permethylated to generate a chemically transformed combinatorial library, is described by Ostresh et al., 1994, *Proc. Natl. Acad. Sci. USA* 91:11138-11142).

The members of the peptide libraries that can be screened according to the invention are not limited to containing the 20 naturally occurring amino acids. In particular, chemically synthesized libraries and polysome based libraries allow the use of amino acids in addition to the 20 naturally occurring amino acids (by their inclusion in the precursor pool of amino acids used in library production). In specific embodiments, the library members contain one or more non-natural or non-classical amino acids or cyclic peptides. Non-classical amino acids include but are not limited to the D-isomers of the common amino acids, a-amino isobutyric acid, 4-aminobutyric acid, Abu, 2-amino butyric acid; Y-Abu, ε-Ahk, 6-amino hexanoic acid; Aib, 2-amino isobutyric acid: 3-amino propionic acid: ornithine; norleucine: norvaline, hydroxyproline, sarcosine, citrulline, cysteic acid, t-butylglycine, t-butylalanine, phenylglycine, cyclohexylalanine, β-alanine, designer amino acids such as β-methyl amino acids, Ca-methyl amino acids, Na-methyl amino acids, fluoro-amino acids and amino acid analogs in general. Furthermore, the amino acid can be D (dextrorotary) or L (levorotary).

In a specific embodiment, fragments and/or analogs of protein components of complexes of the invention, especially peptidomimetics, are screened for activity as competitive or non-competitive inhibitors of complex activity or formation.

In another embodiment encompassed by the present invention, combinatorial chemistry can be used to identify modulators of the complexes. Combinatorial chemistry is capable of creating libraries containing hundreds of thousands of compounds, many of which may be structurally similar. While high throughput screening programs are capable of screening these vast libraries for affinity for known targets, new approaches have been developed that achieve libraries of smaller dimension but which provide maximum chemical diversity. (See, e.g., Matter, 1997, *Journal of Medicinal Chemistry* 40:1219-1229).

One method of combinatorial chemistry, affinity fingerprinting, has previously been used to test a discrete library of small molecules for binding affinities for a defined panel of proteins. The fingerprints obtained by the Screen are used to predict the affinity of the individual library members for other proteins or receptors of interest (in the instant invention, the protein complexes encompassed by the present invention and protein components thereof) The fingerprints are compared with fingerprints obtained from other compounds known to react with the protein of interest to predict whether the library compound might similarly react. For example, rather than testing every ligand in a large library for interaction with a complex or protein component, only those ligands having a fingerprint similar to other compounds known to have that activity could be tested. (See, e.g., Kauvar et al., 1995, *Chemistry and Biology* 2:107-118; Kauvar, 1995, *Affinity finger printing, Pharmaceutical Manufacturing International.* 8:25-28; and Kauvar, Toxic-Chemical Detection by Pattern Recognition in New Frontiers in Agrochemical Immunoassay, D. Kurtz. L. Stanker and J. H. Skerritt. Editors, 1995, AOAC: Washington, D.C., 305-312).

Kay et al., 1993, *Gene* 128:59-65 (Kay) discloses a method of constructing peptide libraries that encode peptides of totally random sequence that are longer than those of any prior conventional libraries. The libraries disclosed in Kay encode totally synthetic random peptides of greater than about 20 amino acids in length. Such libraries can be advantageously screened to identify complex modulators. (See also U.S. Pat. No. 5,498,538 dated Mar. 12, 1996; and PCT Publication No. WO 94/18318 dated Aug. 18, 1994).

A comprehensive review of various types of peptide libraries can be found in Gallop et al., 1994, *J. Med. Chem.* 37:1233-1251.

Libraries screened using the methods encompassed by the present invention can comprise a variety of types of compounds. Examples of libraries that can be screened in accordance with the methods of the invention include, but are not limited to, peptoids; random biooligomers; diversomers such as hydantoins, benzodiazepines and dipeptides; vinylogous polypeptides; nonpeptidal peptidomimetics; oligocarbamates; peptidyl phosphonates; peptide nucleic acid libraries; antibody libraries; carbohydrate libraries; and small molecule libraries (preferably, small organic molecule libraries). In some embodiments, the compounds in the libraries screened are nucleic acid or peptide molecules. In a non-limiting example, peptide molecules can exist in a phage display library. In other embodiments, the types of compounds include, but are not limited to, peptide analogs including peptides comprising non-naturally occurring amino acids, e.g., D-amino acids, phosphorous analogs of amino acids, such as α-amino phosphoric acids and α-amino phosphoric acids, or amino acids having non-peptide linkages, nucleic acid analogs such as phosphorothioates and PNAs, hormones, antigens, synthetic or naturally occurring drugs, opiates, dopamine, serotonin, catecholamines, thrombin, acetylcholine, prostaglandins, organic molecules, pheromones, adenosine, sucrose, glucose, lactose and galactose. Libraries of polypeptides or proteins can also be used in the assays of the invention.

In a preferred embodiment, the combinatorial libraries are small organic molecule libraries including, but not limited to, benzodiazepines, isoprenoids, thiazolidinones, metathiazanones, pyrrolidines, morpholino compounds, and benzodiazepines. In another embodiment, the combinatorial libraries comprise peptoids; random bio-oligomers; benzodiazepines; diversomers such as hydantoins, benzodiazepines and dipeptides; vinylogous polypeptides; nonpeptidal peptidomimetics; oligocarbamates; peptidyl phosphonates; peptide nucleic acid libraries; antibody libraries; or carbohydrate libraries. Combinatorial libraries are themselves commercially available (see, e.g., ComGenex, Princeton, N.J.; Asinex, Moscow, Ru, Tripos, Inc., St. Louis, Mo.; ChemStar, Ltd, Moscow, Russia; 3D Pharmaceuticals, Exton, Pa.; Martek Biosciences, Columbia, Md.; etc.).

In a preferred embodiment, the library is preselected so that the compounds of the library are more amenable for cellular uptake. For example, compounds are selected based on specific parameters such as, but not limited to, size, lipophilicity, hydrophilicity, and hydrogen bonding, which enhance the likelihood of compounds getting into the cells. In another embodiment, the compounds are analyzed by three-dimensional or four-dimensional computer computation programs.

The combinatorial compound library for use in accordance with the methods encompassed by the present invention may be synthesized. There is a great interest in synthetic methods directed toward the creation of large collections of small organic compounds, or libraries, which could be screened for pharmacological, biological or other activity. The synthetic methods applied to create vast combinatorial libraries are performed in solution or in the solid phase, i.e., on a solid support. Solid-phase synthesis makes it easier to conduct multi-step reactions and to drive reactions to completion with high yields because excess reagents can be easily added and washed away after each reaction step. Solid-phase combinatorial synthesis also tends to improve isolation, purification and screening. However, the more traditional solution phase chemistry supports a wider variety of organic reactions than solid-phase chemistry.

Combinatorial compound libraries encompassed by the present invention may be synthesized using the apparatus described in U.S. Pat. No. 6,190,619 to Kilcoin et al., which is hereby incorporated by reference in its entirety. U.S. Pat. No. 6,190,619 discloses a synthesis apparatus capable of holding a plurality of reaction vessels for parallel synthesis of multiple discrete compounds or for combinatorial libraries of compounds.

In one embodiment, the combinatorial compound library can be synthesized in solution. The method disclosed in U.S. Pat. No. 6,194,612 to Boger et al., which is hereby incorporated by reference in its entirety, features compounds useful as templates for solution phase synthesis of combinatorial libraries.

The template is designed to permit reaction products to be easily purified from unreacted reactants using liquid/liquid or solid/liquid extractions. The compounds produced by combinatorial synthesis using the template will preferably be small organic molecules. Some compounds in the library may mimic the effects of non-peptides or peptides.

In contrast to solid phase synthesize of combinatorial compound libraries, liquid phase synthesis does not require the use of specialized protocols for monitoring the individual steps of a multistep solid phase synthesis (Egner et al., 1995, *J. Org. Chem.* 60:2652; Anderson et al., 1995, *J. Org. Chem.* 60:2650; Fitch et al., 1994, *J. Org. Chem.* 59:7955; Look et al., 1994, *J. Org. Chem.* 49:7588; Metzger et al., 1993, *Angew. Chem., Int. Ed. Engl.* 32:894; Youngquist et al., 1994, *Rapid Commun. Mass Spect.* 8:77; Chu et al., 1995, *J. Am. Chern. Soc.* 117:5419; Brummel et al., 1994, *Science* 264:399; and Stevanovic et al., 1993, *Bioorg*. Med. Chern. Lett. 3:431).

Combinatorial compound libraries useful for the methods encompassed by the present invention can be synthesized on solid supports. In one embodiment, a split synthesis method, a protocol of separating and mixing solid supports during the synthesis, is used to synthesize a library of compounds on solid supports (see e.g., Lam et al., 1997. *Chem. Rev.* 97:41-448; Ohlmeyer et al., 1993, *Proc. Nat. Acad. Sci. USA* 90:10922-10926 and references cited therein). Each solid support in the final library has substantially one type of compound attached to its surface. Other methods for synthesizing combinatorial libraries on solid supports, wherein one product is attached to each support, will be known to those of skill in the art (see, e.g., Nefzi eta!., 1997, *Chem. Rev.* 97:449-472).

As used herein, the term "solid support" is not limited to a specific type of solid support. Rather a large number of supports are available and are known to one skilled in the art. Solid supports include silica gels, resins, derivatized plastic films, glass beads, cotton, plastic beads, polystyrene beads, alumina gels, and polysaccharides. A suitable solid support may be selected on the basis of desired end use and suitability for various synthetic protocols. For example, for peptide synthesis, a solid support can be a resin such as p-methylbenzhydrylamine (pMBHA) resin (Peptides International, Louisville, Ky.), polystyrenes (e.g., PAM-resin obtained from Bachem Inc., Peninsula Laboratories, etc.), including chloromethylpolystyrene, hydroxymethylpolystyrene and aminomethylpolystyrene, poly(dimethylacrylamide)-grafted styrene co-divinyl-benzene (e.g., POLYHIPE resin, obtained from Aminotech, Canada), polyamide resin (obtained from Peninsula Laboratories), polystyrene resin grafted with polyethylene glycol (e.g., TENTAGEL or ARGOGEL, Bayer, Tubingen, Germany) polydimethylacrylamide resin (obtained from Milligen/Biosearch, California), or Sepharose (Pharmacia, Sweden).

In some embodiments encompassed by the present invention, compounds can be attached to solid supports via linkers. Linkers can be integral and part of the solid support, or they may be nonintegral that are either synthesized on the solid support or attached thereto after synthesis. Linkers are useful not only for providing points of compound attachment to the solid support, but also for allowing different groups of molecules to be cleaved from the solid support under different conditions, depending on the nature of the linker. For example, linkers can be, inter alia, electrophilically cleaved, nucleophilically cleaved, photocleavable, enzymatically cleaved, cleaved by metals, cleaved under reductive conditions or cleaved under oxidative conditions. In a preferred embodiment, the compounds are cleaved from the solid support prior to high throughput screening of the compounds.

In certain embodiments of the invention, the agent is a small molecule.

ii. Cell-Free Assays

In certain embodiments, the method for identifying a modulator of the formation or stability of a complex of the invention can be carried out in vitro, particularly in a cell-free system. In certain, more specific embodiments, the complex is purified. In certain embodiments the candidate molecule is purified.

In a specific embodiment, screening can be carried out by contacting the library members with a complex immobilized on a solid phase, and harvesting those library members that bind to the protein (or encoding nucleic acid or derivative). Examples of such screening methods, termed "panning techniques, are described by way of example in Parmley and Smith, 1988, Gene 73:305-318: Fowlkes et al., 1992, *BioTechniques* 13:422-427: International Patent Publication No. WO 94/18318; and in references cited herein above.

In one embodiment, agents that modulate (i.e., antagonize or agonize) complex activity or formation can be screened for using a binding inhibition assay, wherein agents are screened for their ability to modulate formation of a complex under aqueous, or physiological, binding conditions in which complex formation occurs in the absence of the agent to be tested. Agents that interfere with the formation of complexes of the invention are identified as antagonists of complex formation. Agents that promote the formation of complexes are identified as agonists of complex formation. Agents that completely block the formation of complexes are identified as inhibitors of complex formation. In an exemplary embodiment, the binding conditions are, for example, but not by way of limitation, in an aqueous salt solution of 10-250 mM NaCl, 5-50 mM Tris-HCl, pH 5-8, and 0.5% Triton X-100 or other detergent that improves specificity of interaction. Metal chelators and/or divalent cations may be added to improve binding and/or reduce proteolysis. Reaction temperatures may include 4, 10, 15, 22, 25, 35, or 42 degrees Celsius, and time of incubation is typically at least 15 seconds, but longer times are preferred to allow binding equilibrium to occur. Particular complexes can be assayed using routine protein binding assays to determine optimal binding conditions for reproducible binding.

Determining the interaction between two molecules can be accomplished using standard binding or enzymatic analysis assays. These assays may include thermal shift assays (measure of variation of the melting temperature of the protein alone and in the presence of a molecule) (R. Zhang, F. Monsma, (2010) *Curr. Opin. Drug Discov. Devel.*, 13:389-402), SPR (surface plasmon resonance) (T. Neumann, et al. (2007), *Curr. Top Med. Chem.*, 7:1630-1642), FRET/BRET (Fluorescence or Bioluminescence Resonance Excitation Transfer) (A. L. Mattheyses, A. I. Marcus, (2015), *Methods Mol. Biol.*, 1278:329-339; J. Bacart, et al. (2008), *Biotechnol. J.*, 3:311-324), Elisa (Enzyme-linked immunosorbent assay) (Z. Weng, Q. Zhao, (2015), *Methods Mol. Biol.*, 1278:341-352), fluorescence polarization (Y. Du, (2015), *Methods Mol. Biol.*, 1278:529-544), and Far western (U. Mahlknecht, O. G. Ottmann, D. Hoelzer J. (2001), *Biotechnol.*, 88:89-94) or other techniques. More sophisticated (and lower throughput) biophysical methods that provide structural or thermodynamic details of the molecule binding mode (using isothermal calorimetry (ITC), Nuclear Magnetic Resonance (NMR), and X-ray crystallography) may also be needed for further validation and characterization of potential hits.

For example, in a direct binding assay, one subunit (or their respective binding partners) can be coupled with a radioisotope or enzymatic label such that binding can be determined by detecting the labeled subunit in a complex. For example, the subunits can be labeled with $^{125}I$, $^{35}S$, $^{14}C$, or $^{3}H$, either directly or indirectly, and the radioisotope detected by direct counting of radioemmission or by scintillation counting. Alternatively, the subunits can be enzymatically labeled with, for example, horseradish peroxidase, alkaline phosphatase, or luciferase, and the enzymatic label detected by determination of conversion of an appropriate substrate to product.

In certain embodiments, another common approach to in vitro binding assays is used. In this assay, one of the binding species is immobilized on a filter, in a microtiter plate well, in a test tube, to a chromatography matrix, etc., either covalently or non-covalently. Proteins can be covalently immobilized using any method well known in the art, for example, but not limited to the method of Kadonaga and Tjian, 1986, *Proc. Natl. Acad. Sci. USA* 83:5889-5893, i.e., linkage to a cyanogen-bromide derivatized substrate such as CNBr-Sepharose 48 (Pharmacia). Where needed, the use of spacers can reduce steric hindrance by the substrate. Non-covalent attachment of proteins to a substrate include, but are not limited to, attachment of a protein to a charged surface, binding with specific antibodies, binding to a third unrelated interacting protein, etc.

Assays of agents (including cell extracts or a library pool) for competition for binding of one member of a complex (or derivatives thereof) with another member of the complex labeled by any means (e.g., those means described above) are provided to screen for competitors or enhancers of complex formation. In specific embodiments, blocking agents to inhibit non-specific binding of reagents to other protein components, or absorptive losses of reagents to plastics, immobilization matrices, etc., are included in the assay mixture. Blocking agents include, but are not restricted to bovine serum albumin, 13-casein, nonfat dried milk, Denhardt's reagent, Ficoll, polyvinylpyrolidine, nonionic detergents (NP40, Triton X-100, Tween 20, Tween 80, etc.), ionic detergents (e.g., SDS, LOS, etc.), polyethylene glycol, etc. Appropriate blocking agent concentrations allow complex formation.

After binding is performed, unbound, labeled protein is removed in the supernatant, and the immobilized protein retaining any bound, labeled protein is washed extensively. The amount of bound label is then quantified using standard methods in the art to detect the label.

In preferred embodiments, polypeptide derivatives that have superior stabilities but retain the ability to form a complex (e.g., one or more component proteins modified to be resistant to proteolytic degradation in the binding assay buffers, or to be resistant to oxidative degradation), are used to screen for modulators of complex activity or formation. Such resistant molecules can be generated, e.g., by substitution of amino acids at proteolytic cleavage sites, the use of chemically derivatized amino acids at proteolytic susceptible sites, and the replacement of amino acid residues subject to oxidation, i.e. methionine and cysteine.

iii. Cell-Based Assays

In certain embodiments, assays can be carried out using recombinant cells expressing the protein components of a complex, to screen for molecules that bind to, or interfere with, or promote complex activity or formation. In certain embodiments, at least one of the protein components expressed in the recombinant cell as fusion protein, wherein the protein component is fused to a peptide tag to facilitate purification and subsequent quantification and/or immunological visualization and quantification.

A particular aspect encompassed by the present invention relates to identifying molecules that inhibit or promote formation or degradation of a complex encompassed by the present invention, e.g., using the method described for isolating the complex and identifying members of the complex using the TAP assay described in Section 4, infra, and in WO 00/09716 and Rigaut et al., 1999, Nature Biotechnol. 17:1030-1032, which are each incorporated by reference in their entirety.

In another embodiment of the invention, a modulator is identified by administering a test agent to a transgenic non-human animal expressing the recombinant component proteins of a complex of the invention. In certain embodiments, the complex components are distinguishable from the homologous endogenous protein components. In certain embodiments, the recombinant component proteins are fusion proteins, wherein the protein component is fused to a peptide tag. In certain embodiments, the amino acid sequence of the recombinant protein component is different from the amino acid sequence of the endogenous protein component such that antibodies specific to the recombinant protein component can be used to determine the level of the protein component or the complex formed with the component. In certain embodiments, the recombinant protein component is expressed from promoters that are not the native promoters of the respective proteins. In a specific embodiment, the recombinant protein component is expressed in tissues where it is normally not expressed. In a specific embodiment, the compound is also recombinantly expressed in the transgenic non-human animal.

In certain embodiments, a mutant form of a protein component of a complex of the invention is expressed in a cell, wherein the mutant form of the protein component has a binding affinity that is lower than the binding affinity of the naturally occurring protein to the other protein component of a complex of the invention. In a specific embodiment, a dominant negative mutant form of a protein component is expressed in a cell. A dominant negative form can be the domain of the protein component that binds to the other protein component, i.e., the binding domain. Without being bound by theory, the binding domain will compete with the naturally occurring protein component for binding to the other protein component of the complex thereby preventing the formation of complex that contains full length protein components. Instead, with increasing level of the dominant negative form in the cell, an increasing amount of complex lacks those domains that are normally provided to the complex by the protein component which is expressed as dominant negative.

The binding domain of a protein component can be identified by any standard technique known to the skilled artisan. In a non-limiting example, alanine-scanning mutagenesis (Cunningham and Wells, (1989) *Science* 244:1081-1085) is conducted to identify the region(s) of the protein that is/are required for dimerization with another protein component. In other embodiments, different deletion mutants of the protein component are generated Such that the combined deleted regions would span the entire protein. In a specific embodiment, the different deletions overlap with each other. Once mutant forms of a protein component are generated, they are tested for their ability to form a dimer with another protein component. If a particular mutant fails to form a dimer with another protein component or binds the other protein component with reduced affinity compared to the naturally occurring form, the mutation of this mutant form is identified as being in a region of the protein that is involved in the dimer formation. To exclude that the mutation simply interfered with proper folding of the protein, any structural analysis known to the skilled artisan can be performed to determine the three-dimensional conformation of the protein. Such techniques include, but are not limited to, circular dichroism (CD), NMR, and X-ray crystallography.

In certain embodiments, a mutated form of a component of a complex of the invention can be expressed in a cell under an inducible promoter. Any method known to the skilled artisan can be used to mutate the nucleotide sequence encoding the component. Any inducible promoter known to the skilled artisan can be used. In particular, the mutated form of the component of a complex of the invention has reduced activity, e.g., reduced RNA-nucleolytic activity and/or reduced affinity to the other components of the complex.

In certain embodiments, the assays of the invention are performed in high-throughput format. For example, high throughput cellular screens measuring the loss of interaction using reverse two hybrid or BRET may be used and offer the advantage of selecting only cell penetrable molecules (A. R. Horswill, S. N. Savinov, S. Benkovic (2004), *Proc. Natl. Acad. Sci. USA,* 101:15591-15596; A. Hamdi, P. Colas (2012), *Trends Pharmacol. Sci.,* 33:109-118). The latter approaches require further validation to assess the "on target" effect. In one or more embodiments of the above described assay methods, it may be desirable to immobilize polypeptides or molecules to facilitate separation of complexed from uncomplexed forms of one or both of the proteins or molecules, as well as to accommodate automation of the assay.

b. Use of Complexes to Identify New Binding Partners

In certain embodiments of the invention, a complex of the invention is used to identify new components the complex. In certain embodiments, new binding partners of a complex of the invention are identified and thereby implicated in chromatin remodeling processing. Any technique known to the skilled artisan can be used to identify such new binding partners. In certain embodiments, a binding partner of a complex of the invention binds to a complex of the invention but not to an individual protein component of a complex of the invention. In a specific embodiment, immunoprecipitation is used to identify binding partners of a complex of the invention.

In certain embodiments, the assays of the invention are performed in high-throughput format.

The screening methods encompassed by the present invention can also use other cell-free or cell-based assays known in the art, e.g., those disclosed in WO 2004/009622, US 2002/0177692 A1, US 2010/0136710 A1, all of which are incorporated herein by reference.

The present invention further pertains to novel agents identified by the above-described screening assays. Accordingly, it is within the scope of this invention to further use an agent identified as described herein in an appropriate animal model. For example, an agent identified as described herein can be used in an animal model to determine the efficacy, toxicity, or side effects of treatment with such an agent. Alternatively, an antibody identified as described herein can be used in an animal model to determine the mechanism of action of such an agent.

V. Protein Microchip

In accordance with another embodiment encompassed by the present invention, a protein microchip or microarray is provided having one or more of the protein complexes and/or antibodies selectively immunoreactive with the protein complexes encompassed by the present invention. Protein microarrays are becoming increasingly important in both proteomics research and protein based detection and diagnosis of diseases. The protein microarrays in accordance with this embodiment encompassed by the present invention will be useful in a variety of applications including, e.g., large-scale or high throughput screening for compounds capable of binding to the protein complexes or modulating the interactions between the interacting protein members in the protein complexes.

The protein microarray encompassed by the present invention can be prepared in a number of methods known in the art. An example of a suitable method is that disclosed in MacBeath and Schreiber, (2000) Science, 289:1760-1763. Essentially, glass microscope slides are treated with an aldehyde-containing Silane reagent (Super Aldehyde substrates purchased from TeleChem International, Cupertino, Calif.). Nanoliter volumes of protein samples in a phosphate-buffered saline with 40% glycerol are then spotted onto the treated slides using a high-precision contact-printing robot. After incubation, the slides are immersed in a bovine serum albumin (BSA)-containing buffer to quench the unreacted aldehydes and to form a BSA layer that functions to prevent non-specific protein binding in subsequent applications of the microchip. Alternatively, as disclosed in MacBeath and Schreiber, proteins or protein complexes encompassed by the present invention can be attached to a BSA-NHS slide by covalent linkages. BSA-NHS slides are fabricated by first attaching a molecular layer of BSA to the surface of glass slides and then activating the BSA with N,N'-disuccinimidyl carbonate. As a result, the amino groups of the lysine, aspartate, and glutamate residues on the BSA are activated and can form covalent urea or amide linkages with protein Samples Spotted on the slides. See MacBeath and Schreiber, (2000) *Science,* 289:1760-1763.

Another example of a useful method for preparing the protein microchip encompassed by the present invention is that disclosed in PCT Publication Nos. WO 00/4389A2 and WO 00/04382, both of which are assigned to Zyomyx and are incorporated herein by reference. First, a substrate or chip base is covered with one or more layers of thin organic film to eliminate any Surface defects, insulate proteins from the base materials, and to ensure uniform protein array. Next, a plurality of protein-capturing agents (e.g., antibodies, pep tides, etc.) are arrayed and attached to the base that is covered with the thin film. Proteins or protein complexes can then be bound to the capturing agents forming a protein microarray. The protein microchips are kept in flow chambers with an aqueous Solution.

The protein microarray encompassed by the present invention can also be made by the method disclosed in PCT Publication No. WO 99/36576 assigned to Packard Bioscience Company, which is incorporated herein by reference. For example, a three-dimensional hydrophilic polymer matrix, i.e., a gel, is first dispensed on a Solid Substrate Such as a glass slide. The polymer matrix gel is capable of expanding or contracting and contains a coupling reagent that reacts with amine groups. Thus, proteins and protein complexes can be contacted with the matrix gel in an expanded aqueous and porous State to allow reactions between the amine groups on the protein or protein complexes with the coupling reagents thus immobilizing the proteins and protein complexes on the Substrate. Thereafter, the gel is contracted to embed the attached proteins and protein complexes in the matrix gel.

Alternatively, the proteins and protein complexes encompassed by the present invention can be incorporated into a commercially available protein microchip, e.g., the ProteinChip System from Ciphergen Biosystems Inc., Palo Alto, Calif. The ProteinChip System comprises metal chips having a treated Surface, which interact with proteins. Basically, a metal chip Surface is coated with a Silicon dioxide film. The molecules of interest Such as proteins and protein complexes can then be attached covalently to the chip Surface via a silane coupling agent.

The preparation of such an array containing different types of proteins is well known in the art and is apparent to a person skilled in the art (see e.g. Ekins et al., 1989*, J. Pharm. Biomed. Anal.* 7:155-168; Mitchell et al. 2002*, Nature Biotechnol.* 20:225-229; Petricoin et al., 2002*, Lancet* 359:572-577; Templin et al., 2001*, Trends Biotechnol.* 20:160-166; Wilson and Nock, 2001*, Curr. Opin. Chern. Biol.* 6:81-85; Lee et al., 2002 *Science* 295:1702-1705; MacBeath and Schreiber, 2000*, Science* 289:1760; Blawas and Reichert, 1998*, Biomaterials* 19:595; Kane et al., 1999*, Biomaterials* 20:2363; Chen et al., 1997*, Science* 276:1425; Vaugham et al., 1996*, Nature Biotechnol.* 14:309-314; Mahler et al., 1997*, Immunotechnology* 3:31-43; Roberts et al., 1999*, Curr. Opin. Chern. Biol.* 3:268-273; Nord et al., 1997*, Nature Biotechnol.* 15:772-777; Nord et al., 2001*, Eur. J. Biochem.* 268:4269-4277; Brody and Gold, 2000*, Rev. Mol. Biotechnol.* 74:5-13; Karlstroem and Nygren, 2001*, Anal. Biochem.* 295:22-30; Nelson et al., 2000*, Electrophoresis* 21:1155-1163; Honore et al., 2001*, Expert Rev. Mol. Diagn.* 3:265-274; Albala, 2001*, Expert Rev. Mol. Diagn.* 2:145-152, Figeys and Pinto, 2001*, Electrophoresis* 2:208-216 and references in the publications listed here).

The protein microchips encompassed by the present invention can also be prepared with other methods known in the art, e.g., those disclosed in U.S. Pat. Nos. 6,087,102, 6,139,831, 6,087,103; PCT Publication Nos. WO 99/60156, WO 99/39210, WO 00/54046, WO 00/53625, WO 99/51773, WO 99/35289, WO 97/42507, WO 01/01142, WO 00/63694, WO 00/61806, WO 99/61148, WO 99/40434, US 2002/0177692 A1, WO 2004/009622, all of which are incorporated herein by reference.

Complexes can be attached to an array by different means as will be apparent to a person skilled in the art. Complexes can for example be added to the array via a TAP-tag (as described in W0/0009716 and in Rigaut et al., 1999*, Nature Biotechnol.* 10:1030-1032) after the purification step or by another suitable purification scheme as will be apparent to a person skilled in the art.

Optionally, the proteins of the complex can be cross-linked to enhance the stability of the complex. Different methods to cross-link proteins are well known in the art. Reactive end-groups of cross-linking agents include but are not limited to —COOH, —SH, —NH2 or N-oxy-succinamate. The spacer of the cross-linking agent should be chosen with respect to the size of the complex to be cross-linked. For small protein complexes, comprising only a few proteins, relatively short spacers are preferable in order to reduce the likelihood of cross-linking separate complexes in the reaction mixture. For larger protein complexes, additional use of larger spacers is preferable in order to facilitate cross-linking between proteins within the complex.

It is preferable to check the success-rate of cross-linking before linking the complex to the carrier. As will be apparent to a person skilled in the art, the optimal rate of cross-linking need to be determined on a case by case basis. This can be achieved by methods well known in the art, some of which are exemplary described below.

A sufficient rate of cross-linking can be checked for example by analysing the cross-linked complex vs. a non-cross-linked complex on a denaturating protein gel. If cross-linking has been performed successfully, the proteins of the complex are expected to be found in the same lane, whereas the proteins of the non-cross-linked complex are expected to be separated according to their individual characteristics. Optionally the presence of all proteins of the complex can be further checked by peptide-sequencing of proteins in the respective bands using methods well known in the art such as mass spectrometry and/or Edman degradation.

In addition, a rate of crosslinking which is too high should also be avoided. If cross-linking has been carried out too extensively, there will be an increasing amount of cross-linking of the individual protein complex, which potentially interferes with a screening for potential binding partners and/or modulators etc. using the arrays.

The presence of such structures can be determined by methods well known in the art and include e.g., gel-filtration experiments comparing the gel filtration profile solutions containing cross-linked complexes vs. uncross-linked complexes.

Optionally, functional assays as will be apparent to a person skilled in the art, some of which are exemplarily provided herein, can be performed to check the integrity of the complex.

Alternatively, members of the protein complex can be expressed as a single fusion protein and coupled to the matrix as will be apparent to a person skilled in the art.

Optionally, the attachment of the complex or proteins as outlined above can be further monitored by various methods apparent to a person skilled in the art. Those include, but are not limited to surface plasmon resonance (see e.g., McDannel, 2001, *Curr. Opin. Chern. Biol.* 5:572-577; Lee, 2001, *Trends Biotechnol.* 19:217-222; Weinberger et al., 2000, 1:395-416; Pearson et al., 2000, *Ann. Clin. Biochem.* 37:119-145; Vely et al., 2000, *Methods Mol. Biol.* 121:313-321; Slepak, 2000, *J. Mol Recognit.* 13:20-26.)

VI. Pharmaceutical Compositions

In another aspect, the present invention provides pharmaceutically acceptable compositions which comprise an isolated modified protein complex selected from the group consisting of protein complexes listed in Table 2 and Table 3, wherein the isolated modified protein complex comprises at least one subunit that is modified, formulated together with one or more pharmaceutically acceptable carriers (additives) and/or diluents.

As described in detail below, the pharmaceutical compositions encompassed by the present invention may be specially formulated for administration in solid or liquid form, including those adapted for the following: (1) oral administration, for example, drenches (aqueous or non-aqueous solutions or suspensions), tablets, boluses, powders, granules, pastes; (2) parenteral administration, for example, by subcutaneous, intramuscular or intravenous injection as, for example, a sterile solution or suspension; (3) topical application, for example, as a cream, ointment or spray applied to the skin; (4) intravaginally or intrarectally, for example, as a pessary, cream or foam; or (5) aerosol, for example, as an aqueous aerosol, liposomal preparation or solid particles containing the compound.

The phrase "therapeutically-effective amount" as used herein means that amount of an agent that modulates (e.g., inhibits or enhances) protein complex formation and/or activity which is effective for producing some desired therapeutic effect, e.g., cancer treatment, at a reasonable benefit/risk ratio.

The phrase "pharmaceutically acceptable" is employed herein to refer to those agents, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition or vehicle, such as a liquid or solid filler, diluent, excipient, solvent or encapsulating material, involved in carrying or transporting the subject chemical from one organ, or portion of the body, to another organ, or portion of the body. Each carrier must be "acceptable" in the sense of being compatible with the other ingredients of the formulation and not injurious to the subject. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) phosphate buffer solutions; and (21) other non-toxic compatible substances employed in pharmaceutical formulations.

The term "pharmaceutically-acceptable salts" refers to the relatively non-toxic, inorganic and organic acid addition salts of the agents that modulates (e.g., inhibits) protein complex expression and/or activity. These salts can be prepared in situ during the final isolation and purification of the respiration uncoupling agents, or by separately reacting a purified respiration uncoupling agent in its free base form with a suitable organic or inorganic acid, and isolating the salt thus formed. Representative salts include the hydrobromide, hydrochloride, sulfate, bisulfate, phosphate, nitrate, acetate, valerate, oleate, palmitate, stearate, laurate, benzoate, lactate, phosphate, tosylate, citrate, maleate, fumarate, succinate, tartrate, napthylate, mesylate, glucoheptonate, lactobionate, and laurylsulphonate salts and the like (See, for example, Berge et al. (1977) "Pharmaceutical Salts", *J. Pharm. Sci.* 66:1-19).

In other cases, the agents useful in the methods encompassed by the present invention may contain one or more acidic functional groups and, thus, are capable of forming pharmaceutically-acceptable salts with pharmaceutically-acceptable bases. The term "pharmaceutically-acceptable salts" in these instances refers to the relatively non-toxic, inorganic and organic base addition salts of a polypeptide subunit of an isolated modified protein complex encompassed by the present invention. These salts can likewise be prepared in situ during the final isolation and purification of the respiration uncoupling agents, or by separately reacting the purified respiration uncoupling agent in its free acid form with a suitable base, such as the hydroxide, carbonate or bicarbonate of a pharmaceutically-acceptable metal cation, with ammonia, or with a pharmaceutically-acceptable organic primary, secondary or tertiary amine. Representative alkali or alkaline earth salts include the lithium, sodium, potassium, calcium, magnesium, and aluminum salts and the like. Representative organic amines useful for the formation of base addition salts include ethylamine, diethylamine, ethylenediamine, ethanolamine, diethanolamine, piperazine and the like (see, for example, Berge et al., supra).

Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

Examples of pharmaceutically-acceptable antioxidants include: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

Formulations useful in the methods encompassed by the present invention include those suitable for oral, nasal, topical (including buccal and sublingual), rectal, vaginal, aerosol and/or parenteral administration. The formulations may conveniently be presented in unit dosage form and may be prepared by any methods well-known in the art of pharmacy. The amount of active ingredient which can be combined with a carrier material to produce a single dosage form will vary depending upon the host being treated, the particular mode of administration. The amount of active ingredient, which can be combined with a carrier material to produce a single dosage form will generally be that amount of the compound which produces a therapeutic effect. Generally, out of one hundred percent, this amount will range from about 1 percent to about ninety-nine percent of active ingredient, preferably from about 5 percent to about 70 percent, most preferably from about 10 percent to about 30 percent.

Methods of preparing these formulations or compositions include the step of bringing into association an isolated modified protein complex encompassed by the present invention, with the carrier and, optionally, one or more accessory ingredients. In general, the formulations are prepared by uniformly and intimately bringing into association a respiration uncoupling agent with liquid carriers, or finely divided solid carriers, or both, and then, if necessary, shaping the product.

Formulations suitable for oral administration may be in the form of capsules, cachets, pills, tablets, lozenges (using a flavored basis, usually sucrose and acacia or tragacanth), powders, granules, or as a solution or a suspension in an aqueous or non-aqueous liquid, or as an oil-in-water or water-in-oil liquid emulsion, or as an elixir or syrup, or as pastilles (using an inert base, such as gelatin and glycerin, or sucrose and acacia) and/or as mouth washes and the like, each containing a predetermined amount of a respiration uncoupling agent as an active ingredient. A compound may also be administered as a bolus, electuary or paste.

In solid dosage forms for oral administration (capsules, tablets, pills, dragees, powders, granules and the like), the active ingredient is mixed with one or more pharmaceutically-acceptable carriers, such as sodium citrate or dicalcium phosphate, and/or any of the following: (1) fillers or extenders, such as starches, lactose, sucrose, glucose, mannitol, and/or silicic acid; (2) binders, such as, for example, carboxymethylcellulose, alginates, gelatin, polyvinyl pyrrolidone, sucrose and/or acacia; (3) humectants, such as glycerol; (4) disintegrating agents, such as agar-agar, calcium carbonate, potato or tapioca starch, alginic acid, certain silicates, and sodium carbonate; (5) solution retarding agents, such as paraffin; (6) absorption accelerators, such as quaternary ammonium compounds; (7) wetting agents, such as, for example, acetyl alcohol and glycerol monostearate; (8) absorbents, such as kaolin and bentonite clay; (9) lubricants, such a talc, calcium stearate, magnesium stearate, solid polyethylene glycols, sodium lauryl sulfate, and mixtures thereof; and (10) coloring agents. In the case of capsules, tablets and pills, the pharmaceutical compositions may also comprise buffering agents. Solid compositions of a similar type may also be employed as fillers in soft and hard-filled gelatin capsules using such excipients as lactose or milk sugars, as well as high molecular weight polyethylene glycols and the like.

A tablet may be made by compression or molding, optionally with one or more accessory ingredients. Compressed tablets may be prepared using binder (for example, gelatin or hydroxypropylmethyl cellulose), lubricant, inert diluent, preservative, disintegrant (for example, sodium starch glycolate or cross-linked sodium carboxymethyl cellulose), surface-active or dispersing agent. Molded tablets may be made by molding in a suitable machine a mixture of the powdered peptide or peptidomimetic moistened with an inert liquid diluent.

Tablets, and other solid dosage forms, such as dragees, capsules, pills and granules, may optionally be scored or prepared with coatings and shells, such as enteric coatings and other coatings well-known in the pharmaceutical-formulating art. They may also be formulated so as to provide slow or controlled release of the active ingredient therein using, for example, hydroxypropylmethyl cellulose in varying proportions to provide the desired release profile, other polymer matrices, liposomes and/or microspheres. They may be sterilized by, for example, filtration through a bacteria-retaining filter, or by incorporating sterilizing agents in the form of sterile solid compositions, which can be dissolved in sterile water, or some other sterile injectable medium immediately before use. These compositions may also optionally contain opacifying agents and may be of a composition that they release the active ingredient(s) only, or preferentially, in a certain portion of the gastrointestinal tract, optionally, in a delayed manner. Examples of embedding compositions, which can be used include polymeric substances and waxes. The active ingredient can also be in micro-encapsulated form, if appropriate, with one or more of the above-described excipients.

Liquid dosage forms for oral administration include pharmaceutically acceptable emulsions, microemulsions, solutions, suspensions, syrups and elixirs. In addition to the active ingredient, the liquid dosage forms may contain inert diluents commonly used in the art, such as, for example, water or other solvents, solubilizing agents and emulsifiers, such as ethyl alcohol, isopropyl alcohol, ethyl carbonate, ethyl acetate, benzyl alcohol, benzyl benzoate, propylene glycol, 1,3-butylene glycol, oils (in particular, cottonseed, groundnut, corn, germ, olive, castor and sesame oils), glycerol, tetrahydrofuryl alcohol, polyethylene glycols and fatty acid esters of sorbitan, and mixtures thereof.

Besides inert diluents, the oral compositions can also include adjuvants such as wetting agents, emulsifying and suspending agents, sweetening, flavoring, coloring, perfuming and preservative agents.

Suspensions, in addition to the active agent may contain suspending agents as, for example, ethoxylated isostearyl alcohols, polyoxyethylene sorbitol and sorbitan esters, microcrystalline cellulose, aluminum metahydroxide, bentonite, agar-agar and tragacanth, and mixtures thereof.

Formulations for rectal or vaginal administration may be presented as a suppository, which may be prepared by mixing one or more respiration uncoupling agents with one or more suitable nonirritating excipients or carriers comprising, for example, cocoa butter, polyethylene glycol, a suppository wax or a salicylate, and which is solid at room temperature, but liquid at body temperature and, therefore, will melt in the rectum or vaginal cavity and release the active agent.

Formulations which are suitable for vaginal administration also include pessaries, tampons, creams, gels, pastes, foams or spray formulations containing such carriers as are known in the art to be appropriate.

Dosage forms for the topical or transdermal administration of an isolated mofidied protein complexes encompassed by the present invention include powders, sprays, ointments, pastes, creams, lotions, gels, solutions, patches and inhalants. The active component may be mixed under sterile conditions with a pharmaceutically-acceptable carrier, and with any preservatives, buffers, or propellants which may be required.

The ointments, pastes, creams and gels may contain, in addition to a respiration uncoupling agent, excipients, such as animal and vegetable fats, oils, waxes, paraffins, starch, tragacanth, cellulose derivatives, polyethylene glycols, silicones, bentonites, silicic acid, talc and zinc oxide, or mixtures thereof.

Powders and sprays can contain, in addition to an isolated modified protein complex, excipients such as lactose, talc, silicic acid, aluminum hydroxide, calcium silicates and polyamide powder, or mixtures of these substances. Sprays can additionally contain customary propellants, such as chlorofluorohydrocarbons and volatile unsubstituted hydrocarbons, such as butane and propane.

The isolated modified protein complex, can be alternatively administered by aerosol. This is accomplished by preparing an aqueous aerosol, liposomal preparation or solid particles containing the compound. A nonaqueous (e.g., fluorocarbon propellant) suspension could be used. Sonic nebulizers are preferred because they minimize exposing the agent to shear, which can result in degradation of the compound.

Ordinarily, an aqueous aerosol is made by formulating an aqueous solution or suspension of the agent together with conventional pharmaceutically acceptable carriers and stabilizers. The carriers and stabilizers vary with the requirements of the particular compound, but typically include nonionic surfactants (Tweens, Pluronics, or polyethylene glycol), innocuous proteins like serum albumin, sorbitan esters, oleic acid, lecithin, amino acids such as glycine, buffers, salts, sugars or sugar alcohols. Aerosols generally are prepared from isotonic solutions.

Transdermal patches have the added advantage of providing controlled delivery of a respiration uncoupling agent to the body. Such dosage forms can be made by dissolving or dispersing the agent in the proper medium. Absorption enhancers can also be used to increase the flux of the peptidomimetic across the skin. The rate of such flux can be controlled by either providing a rate controlling membrane or dispersing the peptidomimetic in a polymer matrix or gel.

Ophthalmic formulations, eye ointments, powders, solutions and the like, are also contemplated as being within the scope of this invention.

Pharmaceutical compositions of this invention suitable for parenteral administration comprise one or more respiration uncoupling agents in combination with one or more pharmaceutically-acceptable sterile isotonic aqueous or non-aqueous solutions, dispersions, suspensions or emulsions, or sterile powders which may be reconstituted into sterile injectable solutions or dispersions just prior to use, which may contain antioxidants, buffers, bacteriostats, solutes which render the formulation isotonic with the blood of the intended recipient or suspending or thickening agents.

Examples of suitable aqueous and nonaqueous carriers which may be employed in the pharmaceutical compositions of the invention include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

These compositions may also contain adjuvants such as preservatives, wetting agents, emulsifying agents and dispersing agents. Prevention of the action of microorganisms may be ensured by the inclusion of various antibacterial and antifungal agents, for example, paraben, chlorobutanol, phenol sorbic acid, and the like. It may also be desirable to include isotonic agents, such as sugars, sodium chloride, and the like into the compositions. In addition, prolonged absorption of the injectable pharmaceutical form may be brought about by the inclusion of agents which delay absorption such as aluminum monostearate and gelatin.

In some cases, in order to prolong the effect of a drug, it is desirable to slow the absorption of the drug from subcutaneous or intramuscular injection. This may be accomplished by the use of a liquid suspension of crystalline or amorphous material having poor water solubility. The rate of absorption of the drug then depends upon its rate of dissolution, which, in turn, may depend upon crystal size and crystalline form. Alternatively, delayed absorption of a parenterally-administered drug form is accomplished by dissolving or suspending the drug in an oil vehicle.

Injectable depot forms are made by forming microencapsule matrices of an isolated modified protein complex, in biodegradable polymers such as polylactide-polyglycolide. Depending on the ratio of drug to polymer, and the nature of the particular polymer employed, the rate of drug release can be controlled. Examples of other biodegradable polymers include poly(orthoesters) and poly(anhydrides). Depot injectable formulations are also prepared by entrapping the drug in liposomes or microemulsions, which are compatible with body tissue.

When the respiration uncoupling agents encompassed by the present invention are administered as pharmaceuticals, to humans and animals, they can be given per se or as a pharmaceutical composition containing, for example, 0.1 to 99.5% (more preferably, 0.5 to 90%) of active ingredient in combination with a pharmaceutically acceptable carrier.

Actual dosage levels of the active ingredients in the pharmaceutical compositions of this invention may be determined by the methods encompassed by the present invention so as to obtain an amount of the active ingredient, which is effective to achieve the desired therapeutic response for a particular subject, composition, and mode of administration, without being toxic to the subject.

The nucleic acid molecules of the invention can be inserted into vectors and used as gene therapy vectors. Gene therapy vectors can be delivered to a subject by, for example, intravenous injection, local administration (see U.S. Pat. No. 5,328,470) or by stereotactic injection (see e.g., Chen et al. (1994) *Proc. Natl. Acad. Sci. USA* 91:3054 3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

VII. Kits

In addition, the present invention also encompasses kits comprising one or more containers filled with one or more isolated protein complexes selected from the group of protein complexes listed in Table 2 and Table 3, wherein at least one isolated modified protein complex comprises a subunit that is modified. Alternatively, the kit can comprise in one or more containers, all protein subunits, homologs, derivatives, or fragments thereof, of an isolated modified protein complex selected from the group of protein complexes listed in Table 2 and Table 3. The kit encompassed by the present invention can also contain expression vectors encoding the essential components of the complex machinery, which components after being expressed can be reconstituted in order to form a biology active protein complex. Such a kit preferably also contains the required buffers and reagents.

The kit encompassed by the present invention can further contain substrates of the isolated modified protein complexes encompassed by the present invention. The kit may further contain reagents that specifically detect the isolated modified protein complex. For example, the kit can comprise a labeled compound or agent capable of detecting an isolated modified protein complex in a biological sample; means for determining the amount of the isolated modified protein complex in the sample; and means for comparing the amount of the isolated modified protein complex in the sample with a standard. The compound or agent can be packaged in a suitable container. For example, the present invention provides kits comprising at least one antibody that binds to the isolated modified protein complex. Kits of the invention can contain an antibody coupled to a solid support, e.g., a tissue culture plate or beads (e.g., sepharose beads).

A kit can include additional components to facilitate the particular application for which the kit is designed. For example, kits can be provided which contain antibodies for detection and quantification of an isolated modified protein complex in vitro, e.g. in an ELISA or a Western blot. Additional, exemplary agents that kits can contain include means of detecting the label (e.g., enzyme substrates for enzymatic labels, filter sets to detect fluorescent labels, appropriate secondary labels such as a sheep anti-mouse-HRP, etc.) and reagents necessary for controls (e.g., control biological samples or an isolated modified protein standards). A kit may additionally include buffers and other reagents recognized for use in a method of the disclosed invention. Non-limiting examples include agents to reduce non-specific binding, such as a carrier protein or a detergent. A kit encompassed by the present invention can also include instructional materials disclosing or describing the use of the kit or an isolated modified protein complex of the disclosed invention in a method of the disclosed invention as provided herein.

This invention is further illustrated by the following examples which should not be construed as limiting. The contents of all references, patents and published patent applications cited throughout this application, as well as the Figures, are incorporated herein by reference.

EXAMPLES

Example 1: Materials and Methods for Examples 2-8 a. Mammalian Cell Culture

HEK-293T, MIA-Pa-Ca-2 and SW13 cell lines were cultured in standard DMEM (Gibco) media supplemented with 10% FBS (Gibco), 1 mM HEPES pH 7.5 (Gibco), and Pen/Step (Gibco) at 28° C. and 5% $CO_2$. HEK-293T cells used in this study were routinely fingerprinted and tested for *mycoplasma*. Wild-type gene sequences and gene expression for mSWI/SNF complex subunit genes were confirmed using RNA-seq prior to experimentation.

b. *D. melanogaster* Cell Culture

Drosophila S2 cells were cultured in SFX-Insect™ media at 28° C. with constant shaking at 112 rpm. To generate stable cell lines, cells were plated in 6-well plates at $2\times10^6$ and transfected with 2 μg of expression construct using Effectene Transfection Reagent (Quiagen) in accordance with manufacturer's recommendation. Cells were selected using 250 μg/ml of hygromycin or 10 μg/ml of puromycin for 10 days and expanded to 1 liter culture for complex purification.

c. Expression Constructs and Lentiviral Infection

All constructs were PCR-amplified from cDNA using Phusion High-Fidelity DNA Polymerase with GC buffer (NEB) or with Q5 High-Fidelity Polymerase (NEB). Purified PCR products were cloned into a modified pTight vector from Clonetech (EF1-alpha promoter) containing blasticidin resistance using In-Fusion (Clontech) at the NotI cloning site. Recombination products were transformed in to One-Shot Stb13 chemically competent *E. coli* (Invitrogen). For the HA-ARID1A C-term construct corresponding to aa1611-2285, the cloning region was selected based on conservation analysis and CX-MS data. HA-ARID1A C-term was cloned into a modified pTight vector from Clonetech (EF1-alpha promoter) containing blasticidin resistance. For mini ARID2 (mARID2), the cloning region was selected based on CX-MS data corresponding to N-terminal aa1-626 fused to C-terminal aa1592-1835. The N-terminal (aa1-626) and C-terminal (aa1592-1835) fragments were PCR amplified separately, with the primers designed at the 3' end of the aa1-626 and the 5' end of aa1592-1835 containing 27 base pairs of complementarity. N-terminal and C-terminal regions of ARID2 were amplified independently, gel purified as above, fused together in a second PCR reaction, and cloned into a modified pTight vector (EF1-alpha promoter) containing blasticidin resistance. SS18 was cloned into pENTR D-Topo vector and recombined into pMSCV Flag-HA IRES Puro retroviral vector. All constructs were sequence validated.

For lentiviral infection, cells were transduced with lentivirus at 50% confluency, incubated with lentivirus for 48 hours, and selected with blasticidin at 10 μg/ml. Cell cultures were expanded to desired amounts for mSWI/SNF complex purification.

d. Generation of HEK-293T mSWI SNF Subunit Knockout Cell Lines

CRISPR-Cas9 KO constructs were purchased from Santa Cruz Biotechnology (SCBT) and transfected into HEK-293T cells using Lipofectamine 3000 reagent (Invitrogen). Cells were selected with puromycin at 2 μg/ml for 5 days. Single cell clones were isolated and subsequently screened for loss of subunit expression using immunoblot and DNA sequencing.

e. Protein Purification

Stable cell lines were cultured in 150 mm dishes and expanded according to assay requirements and bait expression levels. Complexes were purified as previously described with modifications (Mashtalir et al. (2014) *Molecular Cell* 54:392-406). Cells were scraped from plates and washed with cold PBS. Suspension was centrifuged at 3000 rpm for 5 min at 4° C. and pellets were resuspended in hypotonic buffer (HB) containing 10 mM Tris HCl pH 7.5, 10 mM KCL, 1.5 mM $MgCL_2$, 1 mM DTT, 1 mM PMSF and incubated on ice for 5 min. Suspension was centrifuged at 5000 rpm for 5 min at 4° C., and pellets were resuspended in 5 volumes of fresh HB containing protease inhibitor cocktail and homogenized using a glass Dounce homogenizer. Suspension was layered onto HB sucrose cushion containing 30% sucrose w/v, centrifuged at 5000 rpm for 1 hour at 4° C. and cytosol-containing layer was discarded. Nuclear pellets were resuspended in high salt buffer (HSB) containing 50 mM Tris HCl pH 7.5, 300 mM KCL, 1 mM $MgCL_2$, 1 mM EDTA, 1 mM, 1% NP40, 1 mM DTT, 1 mM PMSF and protease inhibitor cocktail. Homogenate was incubated on rotator for 1H. Homogenates then were centrifuged at 20,000 rpm (30,000×g) for 1 hour at 4° C. using an SW32Ti rotor. Chromatin pellets were discarded and high salt nuclear extract was filtered through a 0.45 μm filter and incubated overnight with HA magnetic resin. HA beads were washed in HSB and eluted with HSB containing 1 mg/ml of HA peptide for 4 times 1.5 hour each. Eluted proteins were then subjected to density gradient centrifugation or dialysis.

f. Density Sedimentation Gradients

Eluted protein complexes or nuclear extracts were loaded on top of linear, 11 ml 10-30% glycerol gradients containing 25 mM HEPES pH 7.9, 0.1 mM EDTA, 12.5 mM MgCl2, 100 mM KCl supplemented with 1 mM DTT and protease inhibitors. Tubes were loaded into SW41 rotor and centrifuged at 40000 rpm for 16 hours at 4° C. 550 μl fractions were manually collected from the top of the gradient. 100 μl of each collected fraction were concentrated using 10 μl of Strataclean beads, loaded onto SDS-PAGE gels and either stained using Silver Quest staining kit, or used for Western blot analysis.

g. Co-Immunoprecipitation

Cells were washed with cold PBS and resuspended in EBO hypotonic buffer containing 50 mM Tris pH 7.5, 0.1% NP-40, 1 mM EDTA, 1 mM $MgCl_2$ supplemented with protease inhibitors. Lysates were pelleted at 5,000 rpm for 5 min at 4° C. Supernatants were discarded and nuclei were resuspended in EB300 high salt buffer containing 50 mM Tris pH 7.5, 300 mM NaCl, 1% NP-40, 1 mM EDTA, 1 mM $MgCl_2$ supplemented with protease inhibitors. Lysates were incubated on ice for 10 min with occasional vortexing. Lysate was pelleted at 21000 g for 10 min at 4° C. Supernatants were quantified and supplemented with 1 mM DTT. 1 mg of protein was used for immunoprecipitation with 2-5 μg of antibodies over night at 4° C. Protein-G Dynabeads were added for 2 hours and washed with EB300. Beads were eluted with loading LDS and loaded onto SDS-PAGE.

h. Immunoprecipitation Under Denaturing Conditions

Cells were grown to 80% confluency and treated with MG132 at 20 uM for 8 hours. Cells were washed with PBS and lysed in buffer containing 25 mM Tris pH 7.5 and 1.5% SDS. Lysates were collected and boiled for 5 minutes. Lysates were sonicated and dissolved in EB300 buffer to dilute SDS concentration to 0.1%. Diluted extracts were incubated with HA beads overnight, washed with EB300 5 times and resuspended in LDS for loading.

i. IRDye680 and Colloidal Blue Labeling

Strataclean concentrated fractions were resuspended in denaturing staining solution containing 1×PBS, 1% SDS, and 1 uM IRDye® 680RD NHS Ester, heated at 70° C. for 5 min and then incubated overnight at 37° C. Reactions were quenched with 4×LDS buffer and loaded onto SDS-PAGE. Upon migrations gels were scanned on Li-Cor Odyssey CLx instrument on 700 channel. Bands were quantified and analyzed as indicated below.

For stoichiometric quantification 1 μg of purified DPF2 cBAF complexes were loaded onto SDS-PAGE, stained with colloidal blue according to manufacturer's recommendations and scanned using Li-Cor Odyssey CLx in 700 channel, bands were quantified and normalized to protein molecular weight and DPF2 signal.

j. Western Blotting

Western blot analysis was performed using standard approaches involving primary antibodies and flurophore-conjugated species-specific secondary antibodies (Li-Cor) and imaged using Li-Cor Odyssey CLx.

k. Mass-Spectrometric Sample Preparation and Experiments i. Sample Preparation.

Equal amounts of selected fractions from glycerol gradient-separated complexes were concentrated using StrataClean beads and loaded onto SDS-PAGE gels. Samples were migrated 2 cm into the gel, stained with colloidal blue stain and excised for MS analysis.

Excised gel bands were cut into approximately 1 $mm^3$ pieces. Gel pieces were then subjected to a modified in-gel trypsin digestion procedure (Shevchenko et al. (1996) *Anal Chem* 68:850-858). Gel pieces were washed and dehydrated with acetonitrile for 10 min. followed by removal of acetonitrile. Pieces were then completely dried in a speed-vac. Rehydration of the gel pieces was with 50 mM ammonium bicarbonate solution containing 12.5 ng/μl modified sequencing-grade trypsin (Promega, Madison, WI) at 4° C. After 45 min., the excess trypsin solution was removed and replaced with 50 mM ammonium bicarbonate solution to just cover the gel pieces. Samples were then placed in a 37° C. room overnight. Peptides were later extracted by removing the ammonium bicarbonate solution, followed by one wash with a solution containing 50% acetonitrile and 1% formic acid. The extracts were then dried in a speed-vac (~1 hr). The samples were then stored at 4° C. until analysis.

On the day of analysis the samples were reconstituted in 5-10 μl of HPLC solvent A (2.5% acetonitrile, 0.1% formic acid). A nano-scale reverse-phase HPLC capillary column was created by packing 2.6 μm C18 spherical silica beads (Accucore, ThermoFisher) into a fused silica capillary (100 μm inner diameter×~30 cm length) with a flame-drawn tip. After equilibrating the column each sample was loaded via a Famos auto sampler (LC Packings, San Francisco CA) onto the column. A gradient was formed and peptides were eluted with increasing concentrations of solvent B (97.5% acetonitrile, 0.1% formic acid).

As peptides eluted they were subjected to electrospray ionization and then entered into an LTQ Orbitrap Elite ion-trap mass spectrometer (ThermoFisher Scientific, Waltham, MA). Peptides were detected, isolated, and fragmented to produce a tandem mass spectrum of specific fragment ions for each peptide. Peptide sequences (and hence protein identity) were determined by matching protein databases with the acquired fragmentation pattern by the software program, Sequest (Thermo Fisher Scientific, Waltham, MA). All databases include a reversed version of all the sequences, and the data were filtered to a 1% false discovery rate based on linear discriminant analysis (Huttlin et al. (2010) *Cell* 143:1174-1189). All raw data from all fractions of gradient mass spectrometry across all experiments are found in Appendix.

ii. Protein Sample Preparation for Cross-Linking Mass-Spectrometry ((X-MS)

Native protein complexes were eluted in detergent free elution buffer and dialyzed over night against amine free buffer containing 25 mM HEPES pH 7.9, 1 mM EDTA, 1 mM MgCl2, 100 mM KCl 10% Glycerol supplemented with 1 mM DTT. Samples were concentrated using Amicon Ultra centrifugal filters with 30K cutoff and subjected to BS3-based crosslinking and mass spectrometry described below.

iii. BS3 Crosslinking and Cross-Linking Mass Spectrometry (CX-MS) Analysis

Purified protein complexes in 25 mM HEPES pH 7.6, 150 mM KCl, 1 mM EDTA, 1 mM MgCl2, 1 mM DTT, 1 mM PMSF and 10% Glycerol, were crosslinked by addition of BS3 (Thermo Scientific; freshly prepared as 100 mM in pure water) to 2 mM for 2 hrs at 25° C. The protein amounts used were HA-DPF2: 70 μg; Flag-HA-SS18: 52 μg; HA-BRD7: 17 μg; HA-PHF10: 15 μg; BAP60-HA: 52 μg; HA-D4: 60 μg. The reactions were quenched by addition of 10 μL of 1M ammonium bicarbonate. For the HA-DPF2, Flag-HA-SS18 and HA-BRD7 samples, an equal volume of trifluoroethanol (TFE) was added and the samples were incubated at 60° C. for 30 minutes to denature the proteins. Tris(2-carboxyethyl) phosphine hydrochloride (TCEP) was added to a final concentration of 5 mM. The samples were alkylated by addition of iodoacetamide (IAA) to 10 mM. After incubating at 37° C. for 2 hrs in the dark, the samples were diluted 10-fold with 0.1 M ammonium bicarbonate and digested with trypsin (Promega, Madison, WI) at a ratio of 20:1 (protein: trypsin) overnight at 37° C. For the HA-PHF10, BAP60-HA and HA-D4 samples, the sample preparation protocol using SP3 beads previously described (Hughes et al. (2014) *Mol Syst Biol* 10:757) was used: 10 μL of SP3 beads (10 μg/uL) and an equal volume of acetonitrile were added to the crosslinked samples and incubated at 60° C. for 30 minutes with shaking. Then the beads were concentrated with a magnet and washed with 70% ethanol and 100% acetonitrile. The beads were then suspended in 100 uL 8M Urea in 1 M ammonium bicarbonate and treated with TECP/IAA for 2 hrs at 37° C. in the dark. Then the samples were diluted 10 times with water and digested by addition of trypsin (20:1, protein:trypsin) overnight at 37° C.

All peptide samples were desalted by passage over C18 cartridges (The Nest group, Southborough, MA), and dried by Speed-Vac. The peptides were resuspended in 50 uL Buffer A (25 mM ammonium formate, 20% acetonitrile, 0.1% formic acid, pH 2.8). 1 μg of each sample was reserved for direct MS analysis and the remaining sample was fractionated using an in-house prepared microcapillary strong cation exchange column (200 mm×20 cm; 5 μm, 200 Å partisphere SCX, Whatman or Proteomix SCX 3 μm, Sepax Technologies). A binary HPLC pump with split flow was used with microcapillary flowrate at 2-3 uL/min. Peptides were loaded onto the microcapillary column equilibrated in Buffer A and washed with Buffer A. Bound peptides were eluted with 20 μl of Buffer A containing 30%, 50%, 70%, and 100% Buffer B (800 mM ammonium formate, 20% acetonitrile, pH 2.8), followed by 50 μl elutions with Buffer B containing 5%, or 10% Buffer D (0.5 M ammonium acetate, 30% acetonitrile), or just 20 μl of Buffer D. All fractions were dried in a Speed-vac, and resuspended in 0.1% trifluoroacetic acid (TFA), 2% acetonitrile.

Peptides were analyzed by electrospray ionization microcapillary reverse phase HPLC on a Thermo Scientific Fusion with HCD fragmentation and serial MS events that included one FTMS1 event at 30,000 resolution followed by FTMS2 events at 15,000 resolution. Other instrument settings included: MS1 scan range (m/z): 400-1500; cycle time 3 sec; Charge states 4-10; Filters MIPS on, relax restriction=true; Dynamic exclusion enabled: repeat count 1, exclusion duration 30 s; Filter Intensity Threshold, signal intensity 50000; Isolation mode, quadrupole; Isolation window 2 Da; HCD normalized collision energy 28%, isolation width 2 Da; AGC target 500,000, Max injection time 200 ms. A 90 min gradient from 5% ACN to 40% ACN was used.

l. CX-MS Database Search and Crosslinked Peptide Identification

The RAW files were converted to mzXML files by Raw-converter (He et al. (2015) *Anal Chem* 87:11361-11367). For crosslinked peptide searches, two different crosslink database searching algorithms were used: pLink (Yang et al. (2012) *Nat Methods* 9:904-906) and an in-house designed Nexus. Crosslinking data were analyzed using pLink (Yang et al. (2012) *Nat Methods* 9:904-906) with default settings (precursor monoisotopic mass tolerance: +10 ppm; fragment mass tolerance: +20 ppm; up to 4 isotopic peaks; max evalue 1; static modification on Cysteines; 57. 0215 Da; differential oxidation modification on Methionines; 15. 9949 Da) against a database containing only BAF or PBAF protein sequences.

For Nexus searches, the same databases were used with the following parameter settings: (a) up to three miscleavages; (b) static modification on Cysteines (+57.0215 Da); (c) differential oxidation modification on Methionines (+15.9949 Da); (d) differential modification on the peptide N-terminal Glutamic acid residues (-18.0106 Da) or N-terminal Glutamine residues (−17.0265 Da); (e) differential mono-BS3 modification on Lysine residue (+156.0806 Da). A 5% of FDR cutoff was used for both pLink and Nexus. After performing the pLink and Nexus analyses, the search results were combined and each spectrum was manually evaluated for the quality of the match to each peptide using the COMET/Lorikeet Spectrum Viewer (TPP). Crosslinked peptides are considered confidently identified if at least 4 consecutive b or y ions for each peptide are observed and the majority of the observed ions are accounted for. Search results that did not meet these criteria were removed. Intralinks involving a crosslink between identical residues were only kept if the spectral evidence strongly supported the identification; that is, the major fragment ions correspond to the intralinked peptide sequence and no/few other fragment ions were observed. The percentage of spectra deleted after manual examination was: for DPF2 (11% for interlinks, 5.1% for intralinks), SS18 (30% for interlinks, 5.6% for intralinks), BRD7 (34.9% for interlinks, 15.7% for intralinks), PHF10 (25.7% for interlinks, 9.7% for intralinks), BAP60 (10.4% for interlinks, 9.4% for intralinks), HAD4 (33.7% for interlinks, 10% for intralinks). Crosslinks that met these criteria were uploaded into ProXL for viewing and data analysis (Riffle et al. (2016) *J Proteome Res* 15:2863-2870). All data including the spectra, linkages and structure analyses can be visualized on the world wide web at yeastrc.org/proxl_public/viewProject.do?project_id=127 m. Analyses of Gradient-Mass Spectrometric Data.

Total spectral counts (peptides) corresponding to each protein subunit within mSWI/SNF complexes in each gradient fraction were assembled into elution profiles and used for downstream analysis. For all panels showing mSWI/SNF complex purification elution profiles, the total peptide counts are min-max normalized separately for each subunit across fractions. Peptide counts are represented both as wave plots and heatmaps. For waveplots, SS18 and SS18L1 peptide counts were combined because individually each yielded low numbers of peptides, owing to the low number of lysines in these proteins. Z-Scores were calculated for heatmaps across rows using the seaborns 'z_score' option with all default settings.

To calculate Pearson correlations across elution profiles, total peptide counts across all gradient fractions for each of the baits (SMARCD1, SMARCB1 and SMARCA4) were used. The profiles for each were appended to create a n×3m matrix where n is the number of mSWI/SNF proteins and m is the number of gradient fractions in each experiment. The correlation across these three appended sample profiles was calculated using numpy. The total peptide counts for paralogs of the baits used were excluded (i.e. SMARCD2/3 in the SMARCD1 purification, SMARCA2 in the SMARCA4 purification, etc.).

In order to generate the heatmap reflecting the impact of subunit loss (FIG. 13B), a normalization ratio was calculated by dividing the total number of mSWI/SNF subunit peptides captured across all fractions in each experiment by the mean peptide total across all experiments. All peptide numbers in a particular experiment were multiplied by this ratio to account for potential differences in peptide abundance between experiments. After normalization, the fraction in each experiment with the most total peptides for a given protein was taken and divided by the number of (normalized) peptides in the WT SMARCC1 pull down condition, yielding the proportion of normalized peptides in the mutant condition over the wild-type condition. This was repeated for all proteins and then clustered using scipy hierarchical clustering (from inside the seaborn clustermap package); correlation between samples was used as the distance metric for the clustering. Paralogs of the bait for the mutant samples (SMARCD2 and SMARCD3), proteins that had low numbers of peptides across samples (BCL7B and SS18), and ACTB were excluded from the heatmap.

n. Computational Analysis

Unless otherwise noted, all data analysis was performed using Python version 2.7.

Plots were generated using matplotlib and the seaborns data visualization packages.

o. Structural Analysis

A complete list of SWI/SNF structures was compiled from the Protein Data Bank (Table 8). If multiple structures existed for a domain or protein, the structure with the highest resolution was selected. If a single domain had structures in multiple organisms, the structure from the organism most similar to humans was selected. For each protein that had an available structure, the canonical FASTA sequence was aligned to the sequence of the structure using EMBOSS needle 6.6.0 in order to create a map from the FASTA sequence numbers and the structure residue numbers. For each internal cross link between two residues that were both in the structure, the distance between carbon alphas was calculated and recorded in angstroms. All structures were represented using PyMOL, crosslinks were displayed on the structure using the PyMol distance function.

p. Network Schematics of SWI SNF Complexes from Crosslinking Data

For each complex, a directed network was built with subunits as nodes. Protein paralogs were collapsed for simplicity and number of crosslinks per region of alignment was used as measure of binding strength. Directed edges were shown between subunits with crosslinks between them. The maximum out-degree of each subunit was fixed to be two, where edges were preserved by taking the top edges ranked by number of crosslinks. Modules were colored by membership in communities as detected by the igraph implementation of Louvain clustering (cluster_louvain), hence, colors were generated as a function of the relationship between the nodes (subunits and subunit groups) within the network. Networks were plotted with igraph in R. For yeast and human networks, any edges with fewer than 10 crosslinks mapping between the subunits were removed, for Drosophila complexes, they were not removed owing to lower relative protein capture.

q. Crosslinking Maps

Figure 4A:
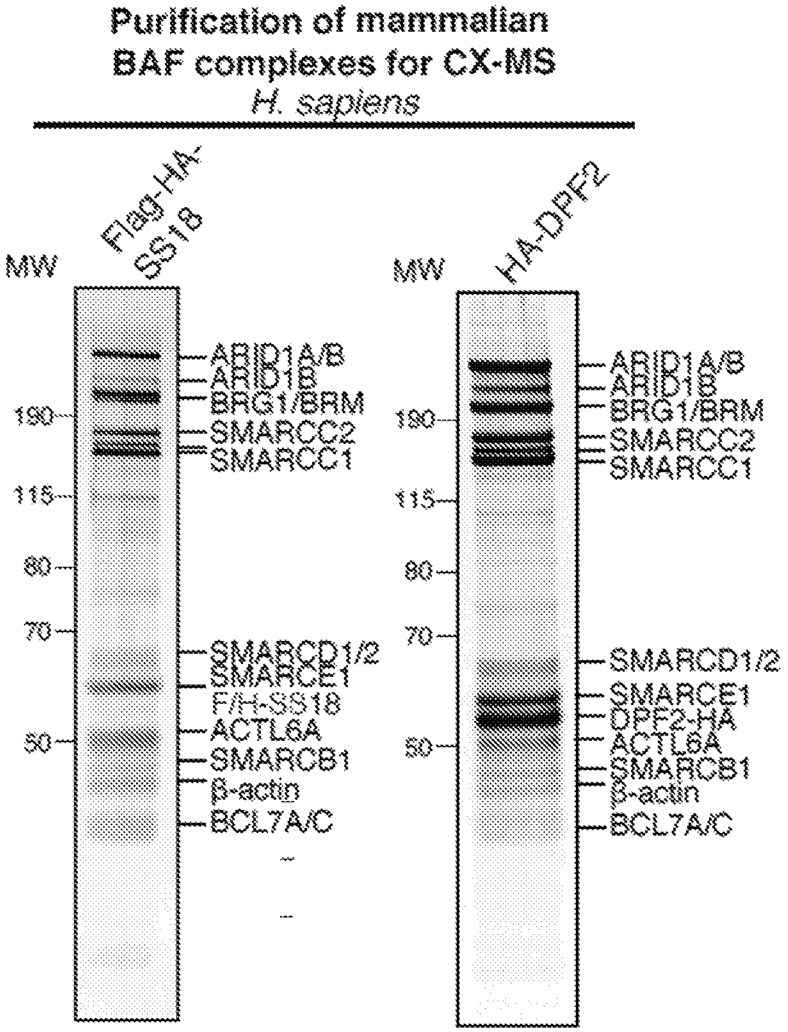
FIG. 4A-FIG. 4N show the purification and cross-linking mass-spectrometry on mammalian, fly, and yeast SWI/SNF complexes.
Figure 4B:
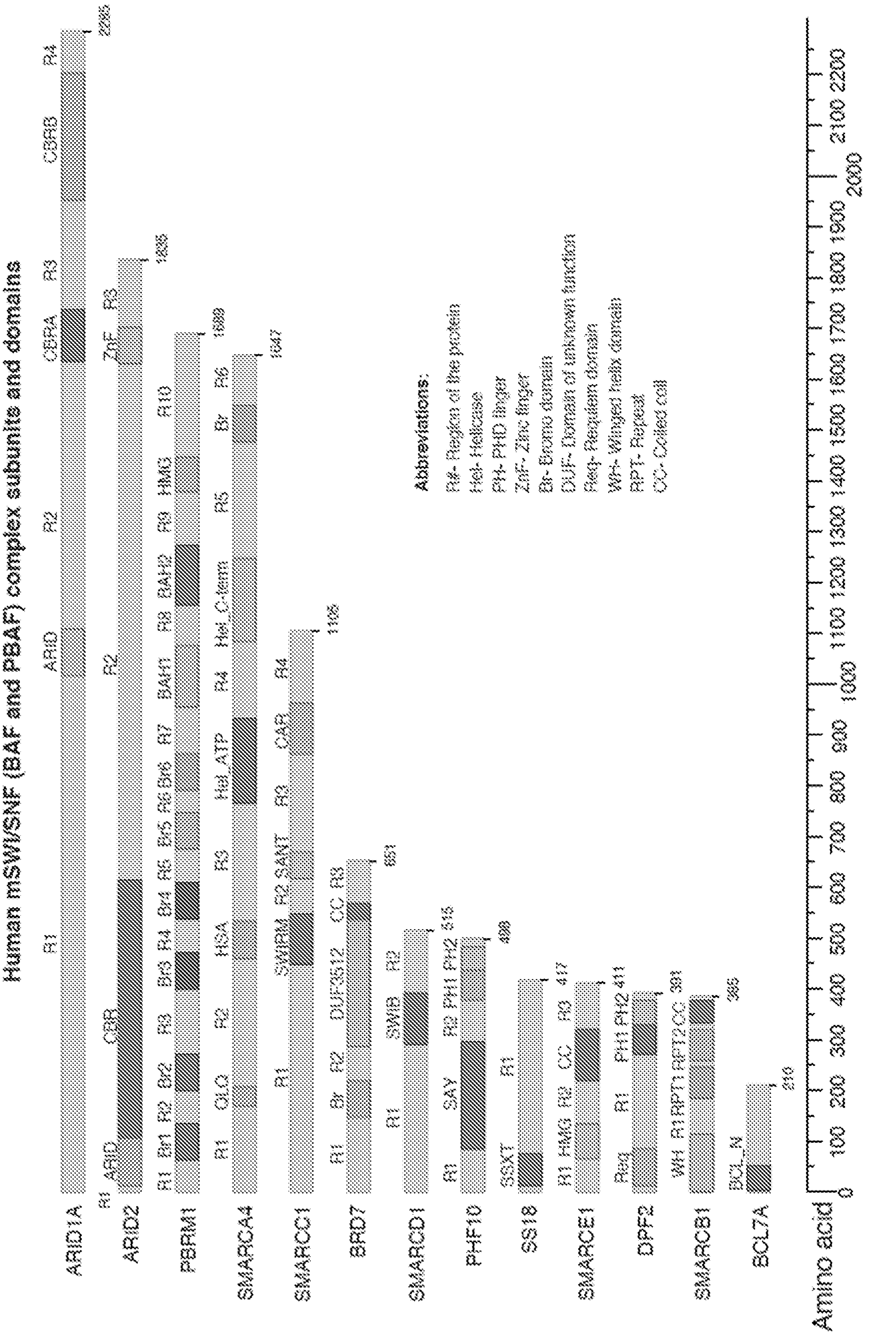
FIG. 4B shows the schematic representation of defined and newly-identified regions in mammalian SWI/SNF subunits used in representing inter-subunit crosslinks. Only one paralog of each subunit family is displayed.

Each protein was divided in to amino acid regions (defined in FIG. 4B). Crosslinks between protein regions were counted, paralog proteins were considered equivalent. A small number of proteins (BRD9, GLTSCR1, DPF1, DPF3, HNRL1) were excluded from this analysis because of their very low peptide counts. When these are clustered (FIGS. 5E, 7B, and 9B) the matrix from above was filtered for a protein family of interest (SMARCC, ARID 1/2 and SMARCA respectively). Only domains that had a total of at least 3 external crosslinks to any domain in this family of interest were included. Any external crosslinks between proteins in the family of interest were excluded (except for the SMARCC). The rows were clustered using the seaborns clustermap function with all clustering options set to default, columns were not clustered.

r. Conservation Analysis

For each comparison of organisms, a matrix of external crosslinks between domains within each organism was created, as described above. For humans, all paralogs were collapsed and considered as single entities. All domains that were not present in both species were removed, leaving n orthologous domains (51 for humans to flies, 38 for humans to yeast, 38 for flies to yeast). The n×n matrices were ordered such that they had the same order of orthologous domains on both axes. The Pearson correlation between each domain di in (1 . . . n) in organism i was correlated with each domain dj (1 . . . n) in organism to get a full set of binding correlations between every domain. A z-score was calculated for each correlation value across this set, and they were then ranked.

s. Mutational Analysis

For every gene and protein included in the TCGA database (available on the world wide web at cancergenome.nih.gov/), the number of non-silent mutations per amino acid was calculated. A z-score value for each protein was calculated from this list. The list was then ranked and plotted.

Tumor mutation data for each protein was downloaded from the CBioPortal available on the world wide web. Cell line data was excluded. For each protein, the number of mutations (nonsense, frame shift in/dels or splice site mutations) that resulted in a truncation/amino acid was calculated.

For each protein p, 5,000 random integers were selected between 1 and the length of p using numpy.random.randint. Each of these integers represents the position of a random mutation. For each of these simulated 'mutations', the proportion of external crosslinking sites (lysines that cross-link to another mSWI/SNF protein) that occur beyond the mutation (and thus would be lost in the random 'truncation') was calculated. A mean fraction of sites lost was calculated over the 5000 runs for each protein.

t. Data and Software Availability

All cross-linking mass-spectrometry data including the spectra, linkages and structure analyses can be visualized on the world wide web at yeastrc.org/proxl_public/viewProject.do?project_id=127. All raw files relating to cross-linking mass-spectrometry are available via deposit at proteome Xchange (Deutsch et al. (2017) *Nucleic Acids Res* 45: D1100-D1106) on the world wide web at proteomexchange.org/under PRIDE access numbers PXD010122, PXD010123, and PXD010124, for mammalian BAF, PBAF and Drosophila BAP, respectively.

The Nexus program can be directly downloaded from the Nexus link on the world wide web at systemsbiology.org/people/labs/ranish-lab/.

Example 2: Affinity Purification of Endogenous mSWI/SNF Reveals Distinct

Complex Types and Their Intermediates

To begin to probe the modular organization and assembly order of mSWI/SNF family complexes, HEK-293T cell nuclear extracts were subjected to density sedimentation analyses using 10-30% glycerol gradients, reasoning that such an approach could reveal the presence of distinct final-form SWI/SNF complexes as well as assembly pathway intermediates (FIG. 1A). A range of migration patterns was identified, with subunits such as SMARCD1 and SMARCC1 exhibiting marked spreading across the gradient, and complex-defining subunits migrating in a restricted set of fractions, such as DPF2 and ARID1A (Fx 13-14) marking canonical BAF (cBAF/BAF) complexes, and ARID2, BRD7 and PBRM1 in higher mass fractions, Fx 16-17, marking PBAF complexes. In addition, BRD9 and GLTSCR1/1L subunits corresponding to a newly-identified class of mSWI/SNF complexes which are termed herein as non-canonical BAF (ncBAF) (Alpsoy et al. (2018) *J Biol Chem* 293:3892-3903; Ho et al. (2009) *Proc Natl Acad Sci USA* 106:5181-5186; Hohmann et al. (2016) *Nat Chem Biol* 12:672-679; Kadoch et al. (2013) *Nature genetics* 45:592-601; Sarnowska et al. (2016) *Trends Plant Sci* 21:594-608), exhibited distinct lower molecular weight migration patterns (Fx 9-10).

Figure 1E:
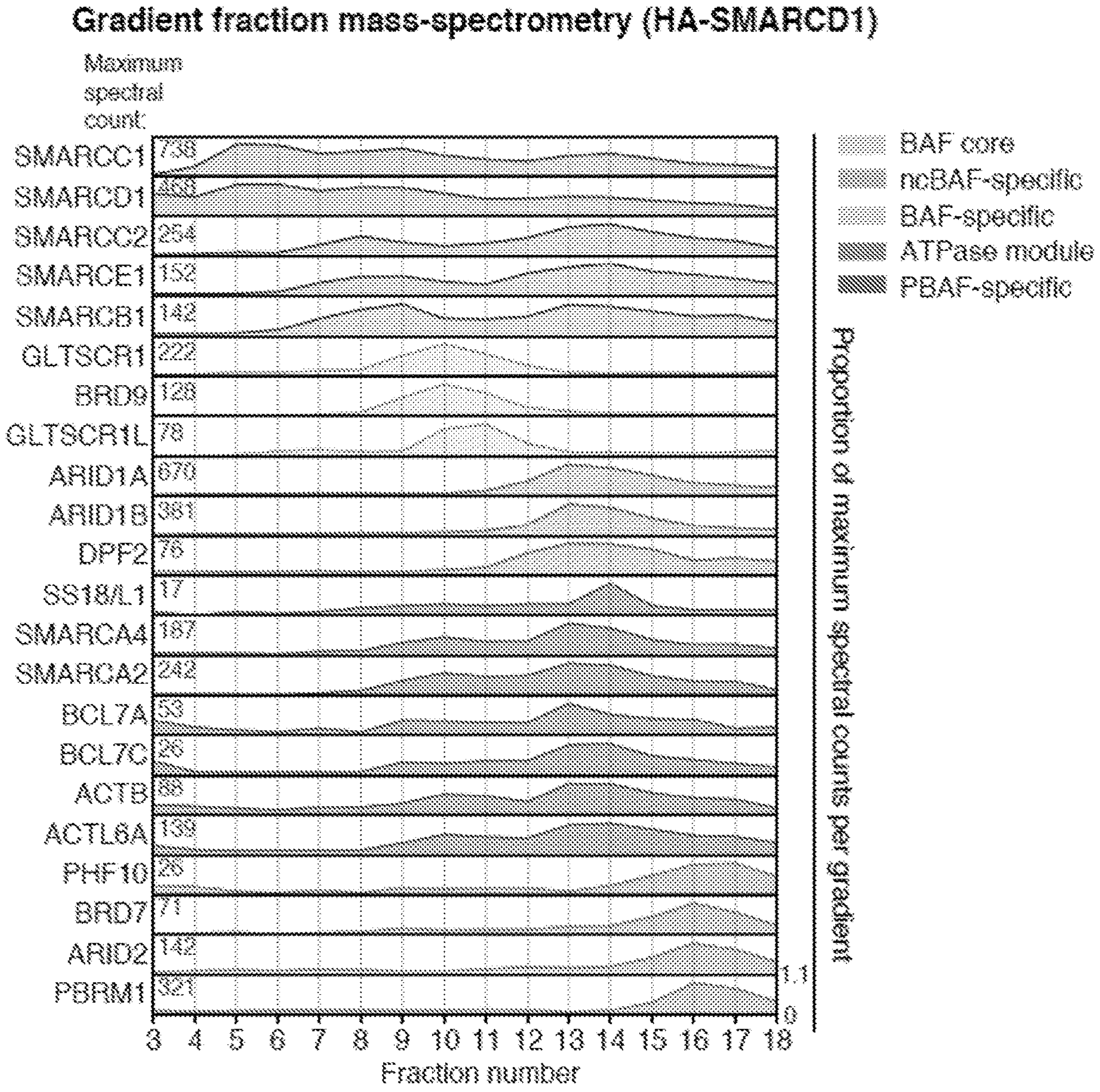
Figure 2A:
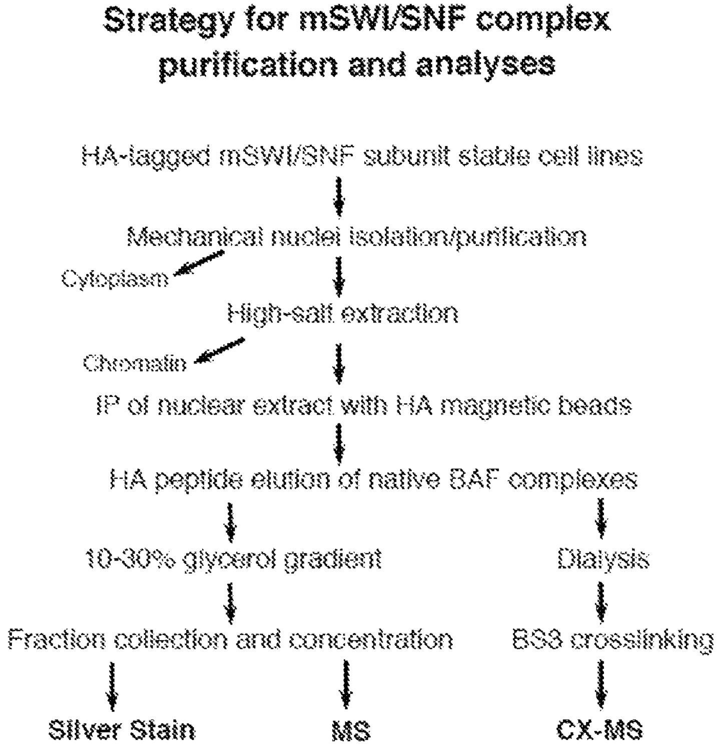
FIG. 2A-FIG. 2F show the purification and gradient mass-spectrometry of mSWI/SNF complexes.
Figure 2B:
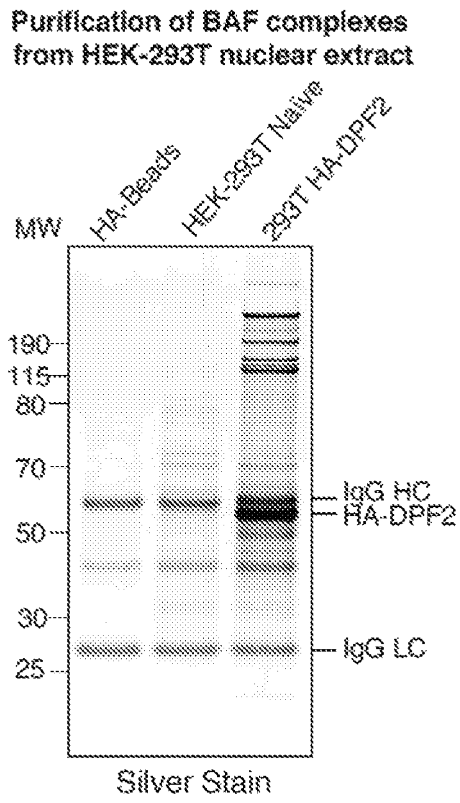
Figure 2C:
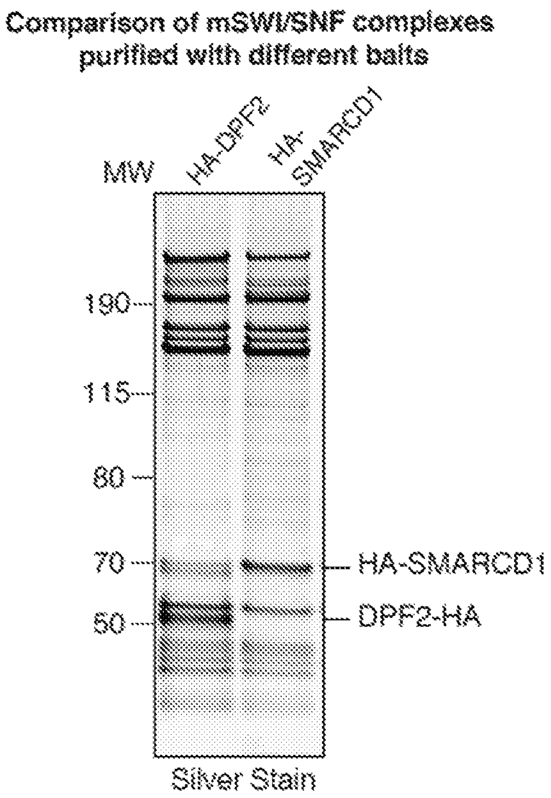
Figure 2D:
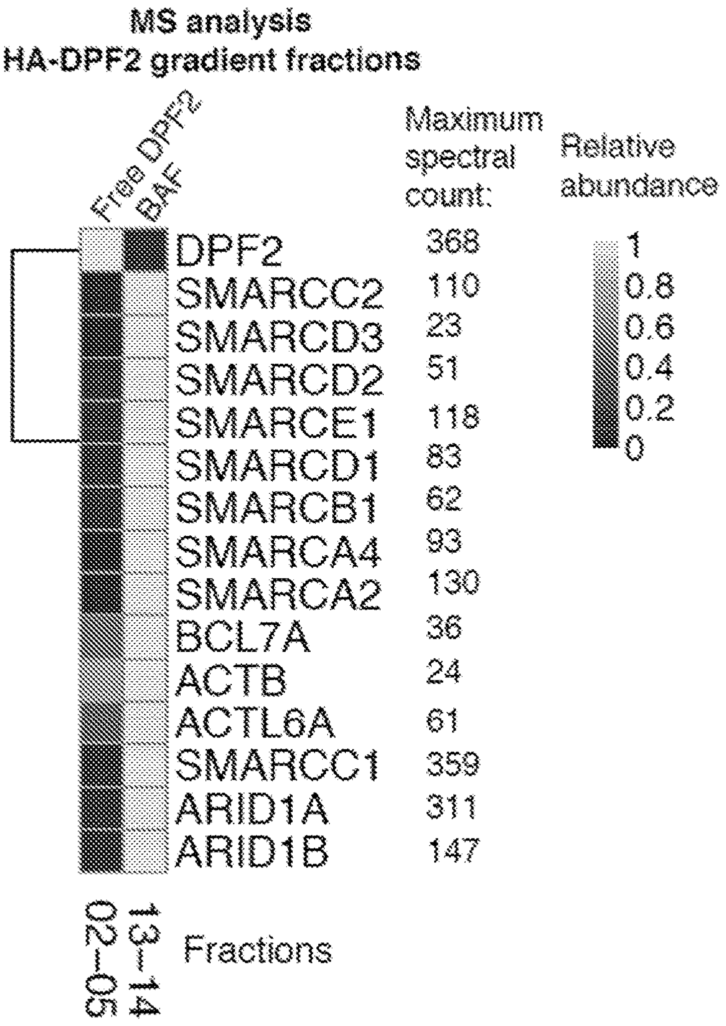
Figure 2E:
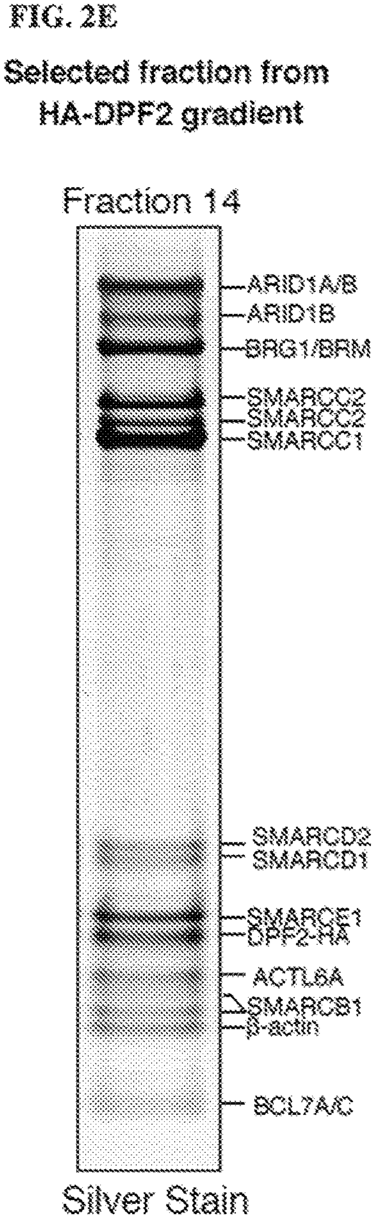
Figure 2F:
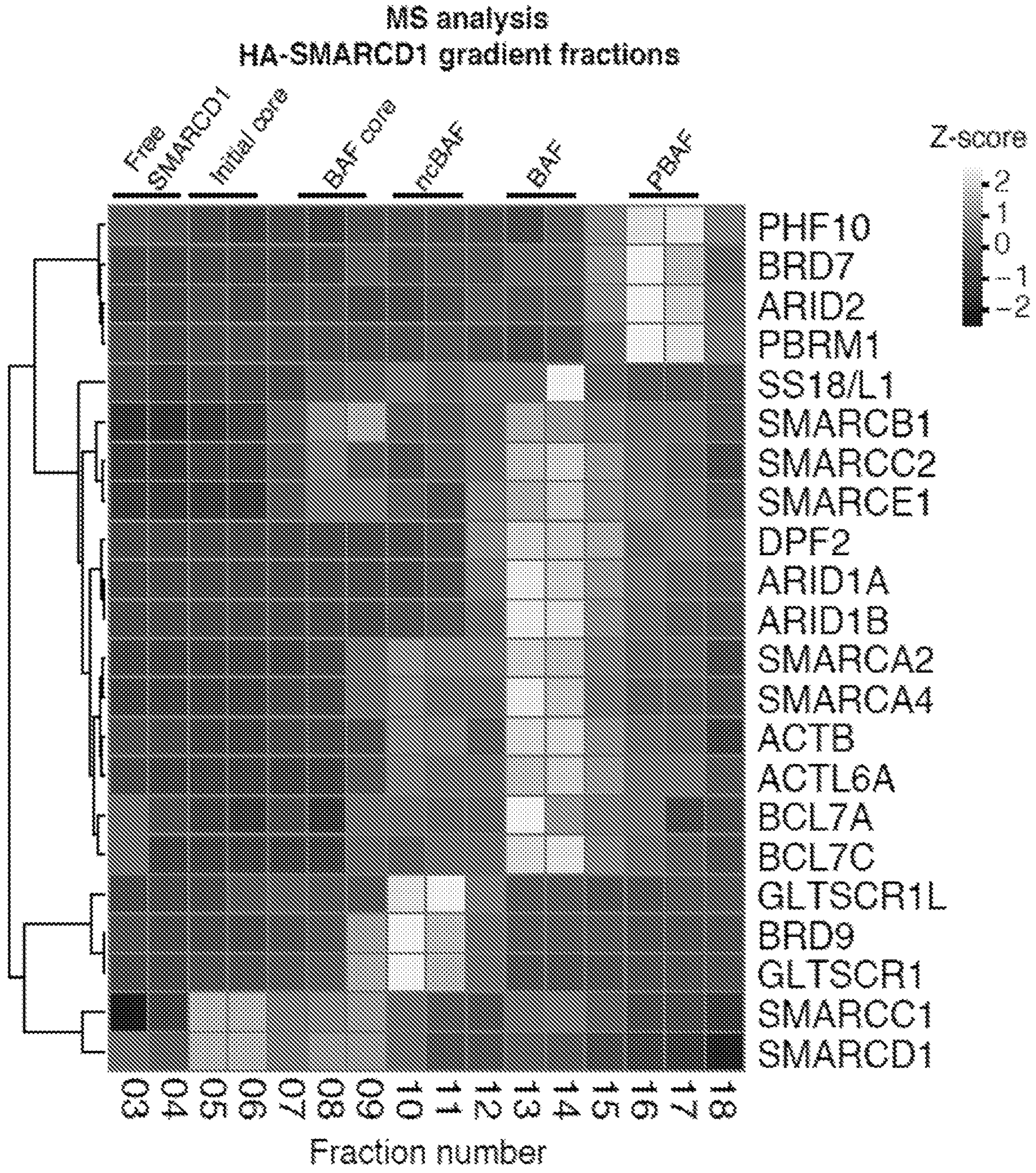

Using these results, a robust purification strategy was developed herein to capture endogenous mammalian complexes at each of these extremes with over 95% purity (FIG. 2A, and Tables 5A-5C). SMARCD1-based purifications were used to capture all forms of mSWI/SNF complexes (as SMARCD1 is present across the full gradient) and HA-DPF2 was used to purify fully-assembled BAF complexes which do not contain PBAF or ncBAF complex components (FIGS. 2B-2C). Remarkably, density sedimentation and silver staining of purified complexes revealed that SMARCD1-captured complexes spread across the gradient, while DPF2 complexes marked only complete BAF complexes with no detectable intermediates (FIGS. 1B-1D, 2D, and 2E, and Tables 6A and 6B), highlighting the utility of this approach to detect specific complexes and intermediate modules. Analysis of spectral counts from mass-spectrometry performed across SMARCD1 gradient fractions confirmed silver stain results, and further identified components with lower abundance such as ncBAF and PBAF subunits (FIGS. 1E and 2F and Table 6A). Taken together, these data demonstrate a step-wise, modular assembly pathway for mSWI/SNF family complexes, resulting in three distinct final complex forms, each with their own combinatorial diversity.

TABLE 5A

Mass-spectrometry performed on HA-DPF2 mSWI/SNF complex purifications
Purification: HA-DPF2, BAF Fraction 14 (F14)

| Non | Uniqu | Tot | reference | Gene | MWT(kDa) | Uniqu | Total | reference | Gene | MW |
|---|---|---|---|---|---|---|---|---|---|---|
| | 7 | 10 | P38646_GRP75_HUMA | HSPA | 73.63 | 114 | 311 | O14497_ARI1A_ | ARID1 | 241.8 |
| | 5 | 6 | P06576_ATPB_HUMA | ATP5 | 56.52 | 87 | 359 | Q92922_SMRC1_ | SMAR | 122.7 |
| | 5 | 5 | P11021_GRP78_HUMA | HSPA | 72.29 | 85 | 147 | Q8NFD5_ARI1B_ | ARID1 | 235.9 |
| | 4 | 4 | P49411_EFTU_HUMA | TUFM | 49.51 | 74 | 130 | P51531_SMCA2_ | SMAR | 181.1 |
| | 3 | 5 | P62081_RS7_HUMAN | RPS7 | 22.11 | 52 | 105 | Q8TAQ2_SMRC2 | SMAR | 132.8 |
| | 3 | 4 | P25705_ATPA_HUMA | ATP5 | 59.71 | 47 | 88 | P51532_SMCA4_ | SMAR | 184.5 |
| | 3 | 3 | Q13885_TBB2A_HUM | TUBB | 49.87 | 40 | 118 | Q969G3_SMCE1_ | SMAR | 46.62 |
| | 3 | 3 | P05141_ADT2_HUMA | SLC25 | 32.83 | 37 | 83 | Q96GM5_SMRD1 | SMAR | 58.2 |
| | 3 | 3 | Q9BYX7_ACTBM_HU | POTE | 41.99 | 32 | 51 | Q92925_SMRD2_ | SMAR | 58.88 |
| | 3 | 3 | P62987_RL40_HUMA | UBA5 | 14.72 | 23 | 61 | O96019_ACL6A_ | ACTL6 | 47.43 |
| | 3 | 3 | Q71U36_TBA1A_HUM | TUBA | 50.1 | 22 | 62 | Q12824_SNF5_H | SMAR | 44.11 |
| | 3 | 3 | Q6P2Q9_PRP8_HUMA | PRPF8 | 273.4 | 20 | 33 | Q92785_REQU_H | DPF2 | 44.13 |
| | 2 | 2 | P31943_HNRH1_HUM | HNRN | 49.2 | 20 | 23 | Q6STE5_SMRD3 | SMAR | 54.98 |
| | 2 | 2 | P08670_VIME_HUMA | VIM | 53.62 | 16 | 49 | P62736_ACTA_H | ACTA2 | 41.98 |
| | 2 | 2 | P52272_HNRPM_HUM | HNRN | 77.46 | 16 | 36 | Q4VC05_BCL7A | BCL7A | 22.8 |
| | 1 | 2 | Q9BXY5_CAYP2_HU | CAPS | 63.8 | 8 | 24 | P60709_ACTB_H | ACTB | 41.71 |
| | 1 | 2 | P46459_NSF_HUMAN | NSF | 82.54 | 7 | 13 | Q8WUZ0_BCL7C | BCL7C | 23.45 |
| | 1 | 1 | Q9Y651_SOX21_HUM | SOX2 | 28.56 | 4 | 5 | F8VXC8_F8VXC | SMAR | 136.1 |
| | 1 | 1 | P04908_H2A1B_HUM | HIST1 | 14.13 | 2 | 4 | A0A0A0MT49_A | SMAR | 188.7 |

TABLE 5A-continued

Mass-spectrometry performed on HA-DPF2 mSWI/SNF complex purifications
Purification: HA-DPF2, BAF Fraction 14 (F14)

| Non | Uniqu | Tot | reference | Gene | MWT(kDa) | | Uniqu | Total | reference | Gene | MW |
|---|---|---|---|---|---|---|---|---|---|---|---|
| | 1 | 1 | P61247_RS3A_HUMA | RPS3 | 29.93 | | 2 | 3 | O75177_CREST_ | SS18L1 | 42.96 |
| | 1 | 1 | P12235_ADT1_HUMA | SLC25 | 33.04 | | 2 | 2 | Q15532_SSXT_H | SS18 | 45.9 |
| | 1 | 1 | P33993_MCM7_HUMA | MCM7 | 81.26 | | 1 | 1 | Q9HBD4_Q9HBD | SMAR | 188.0 |
| | 1 | 1 | P54652_HSP72_HUMA | HSPA | 69.98 | Total | 711 | 1708 | | | |
| | 1 | 1 | Q53H12_AGK_HUMA | AGK | 47.11 | | total | BAF | Non BAF | total | |
| | 1 | 1 | P11142_HSP7C_HUM | HSPA | 70.85 | | | 1708 | 80 | 1788 | |
| | 1 | 1 | P12273_PIP_HUMAN | PIP | 16.56 | | | | purity | 95.525 | |
| | 1 | 1 | P07437_TBB5_HUMA | TUBB | 49.64 | | | | | | |
| | 1 | 1 | P62304_RUXE_HUMA | SNRP | 10.8 | | | | | | |
| | 1 | 1 | Q8N4U5_T11L2_HUM | TCP11 | 58.05 | | | | | | |
| | 1 | 1 | P36542_ATPG_HUMA | ATP5 | 32.98 | | | | | | |
| | 1 | 1 | P52701_MSH6_HUMA | MSH6 | 152.6 | | | | | | |
| | 1 | 1 | F5H3B3_F5H3B3_HU | ANKR | 12.76 | | | | | | |
| | 1 | 1 | Q02978_M2OM_HUM | SLC25 | 34.04 | | | | | | |
| | 1 | 1 | K1C18_HUMAN_conta | KRT1 | 48.03 | | | | | | |
| | 1 | 1 | Q15063_POSTN_HUM | POST | 93.26 | | | | | | |
| Total | 71 | 80 | | | | | | | | | |

TABLE 5B

Mass-spectrometry performed on HA-SMARCD1 mSWI/SNF complex purifications
Purification: HA-SMARCD1, mSWI/SNF-Fraction 15

| Non | Uniq | Tot | reference | Gene | MWT(kDa) | | Uni | Total | reference | Gene | MW |
|---|---|---|---|---|---|---|---|---|---|---|---|
| | 10 | 10 | P52292_IMA1_HU | KPN | 57.8 | | 100 | 321 | O14497_ARI1A | ARID | 241. |
| | 8 | 8 | P25705_ATPA_HU | ATP5 | 59.7 | | 88 | 403 | Q92922_SMRC | SMA | 122. |
| | 7 | 8 | P06576_ATPB_HU | ATP5 | 56.5 | | 79 | 115 | Q86U86_PB1_ | PBR | 192. |
| | 7 | 7 | Q6P2Q9_PRP8_HU | PRPF | 273. | | 75 | 189 | Q8NFD5_ARI1 | ARID | 235. |
| | 6 | 7 | O75643_U520_HU | SNR | 244. | | 74 | 206 | P51531_SMCA | SMA | 181. |
| | 6 | 6 | P38646_GRP75_H | HSPA | 73.6 | | 55 | 172 | Q8TAQ2_SMR | SMA | 132. |
| | 5 | 5 | P11021_GRP78_H | HSPA | 72.2 | | 53 | 153 | P51532_SMCA | SMA | 184. |
| | 5 | 5 | Q15029_U5S1_HU | EFTU | 109. | | 44 | 175 | Q96GM5_SMR | SMA | 58.2 |
| | 4 | 4 | P49411_EFTU_HU | TUF | 49.5 | | 41 | 55 | Q68CP9_ARID | ARID | 197. |
| | 3 | 5 | Q9BYX7_ACTBM_ | POTE | 41.9 | | 33 | 114 | Q969G3_SMCE | SMA | 46.6 |
| | 3 | 3 | Q71U36_TBA1A_H | TUB | 50.1 | | 22 | 75 | Q12824_SNF5_ | SMA | 44.1 |
| | 3 | 3 | P05141_ADT2_HU | SLC2 | 32.8 | | 22 | 58 | O96019_ACL6 | ACT | 47.4 |
| | 3 | 3 | P62987_RL40_HU | UBA | 14.7 | | 19 | 41 | Q92785_REQU | DPF2 | 44.1 |
| | 3 | 3 | P34931_HS71L_HU | HSPA | 70.3 | | 19 | 29 | Q9NPI1_BRD7 | BRD7 | 74.0 |
| | 3 | 3 | P12235_ADT1_HU | SLC2 | 33.0 | | 16 | 68 | P62736_ACTA | ACT | 41.9 |
| | 2 | 2 | P07437_TBB5_HU | TUB | 49.6 | | 14 | 14 | Q8WUB8_PHF | PHF1 | 56.0 |
| | 2 | 2 | Q13885_TBB2A_H | TUB | 49.8 | | 12 | 33 | Q4VC05_BCL7 | BCL7 | 22.8 |
| | 2 | 2 | P54652_HSP72_HU | HSPA | 69.9 | | 10 | 12 | Q92784_DPF3_ | DPF3 | 43.0 |
| | 1 | 3 | Q15063_POSTN_H | POST | 93.2 | | 10 | 11 | Q9NZM4_GSC | GLTS | 158. |
| | 1 | 2 | Q9BXY5_CAYP2_ | CAPS | 63.8 | | 8 | 19 | Q8WUZ0_BCL | BCL7 | 23.4 |
| | 1 | 2 | Q9H4K7_MTG2_H | MTG | 43.9 | | 8 | 8 | Q9H8M2_BRD | BRD9 | 66.9 |
| | 1 | 1 | P07477_TRY1_HU | PRSS | 26.5 | | 7 | 22 | P60709_ACTB_ | ACT | 41.7 |
| | 1 | 1 | P31943_HNRH1_H | HNR | 49.2 | | 6 | 7 | Q92782_DPF1_ | DPF1 | 42.4 |
| | 1 | 1 | P35030_TRY3_HU | PRSS | 32.5 | | 2 | 8 | A0A0A0MT49_ | SMA | 188. |
| | 1 | 1 | P04083_ANXA1_H | ANX | 38.6 | | 2 | 3 | G5E975_G5E97 | SMA | 45.0 |
| | 1 | 1 | Q9Y651_SOX21_H | SOX2 | 28.5 | | 2 | 3 | Q15532_SSXT_ | SS18 | 45.9 |
| | 1 | 1 | K7EM38_K7EM38 | ACT | 14.5 | | 2 | 2 | O75177_CRES | SS18 | 42.9 |
| | 1 | 1 | Q15758_AAAT_H | SLC1 | 56.5 | | 1 | 1 | H0Y3S9_H0Y3 | ARID | 29.4 |
| | 1 | 1 | Q00325_MPCP_HU | SLC2 | 40.0 | | 1 | 2 | F8W7T1_F8W7 | DPF3 | 46.4 |
| | 1 | 1 | P22695_QCR2_HU | UQC | 48.4 | | 1 | 1 | C8C3P2_C8C3 | DPF1 | 45.0 |
| | 1 | 1 | P05023_AT1A1_H | ATP1 | 112. | | 1 | 1 | Q6AI39_GSC1 | GLTS | 115. |
| | 1 | 1 | P04350_TBB4A_H | TUB | 49.5 | | 1 | 1 | C9J053_C9J053 | PBR | 13.6 |
| | 1 | 1 | P68104_EF1A1_HU | EEF1 | 50.1 | | 1 | 1 | Q9HBD4_Q9H | SMA | 188. |
| | 1 | 1 | A1E5M1_A1E5M1 | PDE7 | 57.6 | | 1 | 1 | E9PDV3_E9PD | DPF1 | 45.2 |
| | 1 | 1 | P01857_IGHG1_H | IGHG | 36.0 | Total | 830 | 2324 | | | |
| | 1 | 1 | Q9Y265_RUVB1_ | RUV | 50.2 | | | | BAF | Non | total |
| | 1 | 1 | Q9UKS7_IKZF2_H | IKZF | 59.5 | | | Total | 2324 | 112 | 2436 |
| | 1 | 1 | P82970_HMGN5_H | HMG | 31.5 | | | | | purity | 95.4 |
| | 1 | 1 | P68363_TBA1B_H | TUB | 50.1 | | | | | | |
| | 1 | 1 | Q86UP9_LHPL3_H | LHFP | 25.7 | | | | | | |
| Total | 104 | 112 | | | | | | | | | |

TABLE 5C

Mass-spectrometry performed on MOCK control mSWI/SNF complex purifications
MOCK purification Fractions 12-14 (F12-14)

| Unique | Total | reference | Gene Symbol | MWT(kDa) |
|---|---|---|---|---|
| 18 | 20 | Q10570_CPSF1_HUMAN | CPSF1 | 160.78 |
| 11 | 14 | P06576_ATPB_HUMAN | ATP5B | 56.52 |
| 11 | 11 | P25705_ATPA_HUMAN | ATP5A1 | 59.71 |
| 10 | 19 | Q9H2S9_IKZF4_HUMAN | IKZF4 | 64.07 |
| 10 | 12 | Q71U36_TBA1A_HUMAN | TUBA1A | 50.1 |
| 9 | 10 | P11021_GRP78_HUMAN | HSPA5 | 72.29 |
| 9 | 9 | Q13885_TBB2A_HUMAN | TUBB2A | 49.87 |
| 9 | 9 | Q9UKS7_IKZF2_HUMAN | IKZF2 | 59.54 |
| 9 | 9 | P52272_HNRPM_HUMAN | HNRNPM | 77.46 |
| 9 | 9 | Q6UN15_FIP1_HUMAN | FIP1L1 | 66.49 |
| 9 | 9 | Q9Y265_RUVB1_HUMAN | RUVBL1 | 50.2 |
| 8 | 10 | P38646_GRP75_HUMAN | HSPA9 | 73.63 |
| 8 | 9 | P78527_PRKDC_HUMAN | PRKDC | 468.79 |
| 8 | 8 | P05023_AT1A1_HUMAN | ATP1A1 | 112.82 |
| 7 | 8 | P07355_ANXA2_HUMAN | ANXA2 | 38.58 |
| 7 | 8 | O95831_AIFM1_HUMAN | AIFM1 | 66.86 |
| 7 | 7 | Q9Y230_RUVB2_HUMAN | RUVBL2 | 51.12 |
| 7 | 7 | Q9P2I0_CPSF2_HUMAN | CPSF2 | 88.43 |
| 6 | 7 | P11142_HSP7C_HUMAN | HSPA8 | 70.85 |
| 6 | 6 | P20700_LMNB1_HUMAN | LMNB1 | 66.37 |
| 6 | 6 | Q9UJV9_DDX41_HUMAN | DDX41 | 69.79 |
| 5 | 6 | P68104_EF1A1_HUMAN | EEF1A1 | 50.11 |
| 5 | 5 | P10809_CH60_HUMAN | HSPD1 | 61.02 |
| 5 | 5 | P56945_BCAR1_HUMAN | BCAR1 | 93.31 |
| 5 | 5 | P04843_RPN1_HUMAN | RPN1 | 68.53 |
| 5 | 5 | P62736_ACTA_HUMAN | ACTA2 | 41.98 |
| 5 | 5 | P39656_OST48_HUMAN | DDOST | 50.77 |
| 5 | 5 | Q9C0J8_WDR33_HUMAN | WDR33 | 145.8 |
| 4 | 6 | IGH1M_MOUSE | Ighg1 | 43.36 |
| 4 | 5 | P60709_ACTB_HUMAN | ACTB | 41.71 |
| 4 | 5 | P33993_MCM7_HUMAN | MCM7 | 81.26 |
| 4 | 5 | Q16891_MIC60_HUMAN | IMMT | 83.63 |
| 4 | 4 | O43175_SERA_HUMAN | PHGDH | 56.61 |
| 4 | 4 | P22695_QCR2_HUMAN | UQCRC2 | 48.41 |
| 4 | 4 | P04040_CATA_HUMAN | CAT | 59.72 |
| 4 | 4 | P08107_HSP71_HUMAN | HSPA1A | 70.01 |
| 4 | 4 | P31943_HNRH1_HUMAN | HNRNPH1 | 49.2 |
| 4 | 4 | Q15517_CDSN_HUMAN | CDSN | 51.49 |
| 4 | 4 | P12235_ADT1_HUMAN | SLC25A4 | 33.04 |
| 3 | 4 | Q07021_C1QBP_HUMAN | C1QBP | 31.34 |
| 3 | 4 | Q8TEM1_PO210_HUMAN | NUP210 | 204.98 |
| 3 | 4 | P52701_MSH6_HUMAN | MSH6 | 152.69 |
| 3 | 4 | P34931_HS71L_HUMAN | HSPA1L | 70.33 |
| 3 | 4 | P04844_RPN2_HUMAN | RPN2 | 69.24 |
| 3 | 3 | P06733_ENOA_HUMAN | ENO1 | 47.14 |
| 3 | 3 | O75223_GGCT_HUMAN | GGCT | 20.99 |
| 3 | 3 | P52597_HNRPF_HUMAN | HNRNPF | 45.64 |
| 3 | 3 | P01876_IGHA1_HUMAN | IGHA1 | 37.63 |
| 3 | 3 | P49411_EFTU_HUMAN | TUFM | 49.51 |
| 3 | 3 | P16615_AT2A2_HUMAN | ATP2A2 | 114.68 |
| 3 | 3 | P62987_RL40_HUMAN | UBA52 | 14.72 |
| 3 | 3 | P54652_HSP72_HUMAN | HSPA2 | 69.98 |
| 3 | 3 | Q15029_U5S1_HUMAN | EFTUD2 | 109.37 |
| 2 | 3 | Q9H4B7_TBB1_HUMAN | TUBB1 | 50.29 |
| 2 | 3 | Q13509_TBB3_HUMAN | TUBB3 | 50.4 |
| 2 | 3 | O75489_NDUS3_HUMAN | NDUFS3 | 30.22 |
| 2 | 3 | Q96I99_SUCB2_HUMAN | SUCLG2 | 46.48 |
| 2 | 3 | Q8N1F7_NUP93_HUMAN | NUP93 | 93.43 |
| 2 | 3 | P12004_PCNA_HUMAN | PCNA | 28.75 |
| 2 | 2 | P10599_THIO_HUMAN | TXN | 11.73 |
| 2 | 2 | P04350_TBB4A_HUMAN | TUBB4A | 49.55 |
| 2 | 2 | P05141_ADT2_HUMAN | SLC25A5 | 32.83 |
| 2 | 2 | P07437_TBB5_HUMAN | TUBB | 49.64 |
| 2 | 2 | Q9UJS0_CMC2_HUMAN | SLC25A13 | 74.13 |
| 2 | 2 | P42357_HUTH_HUMAN | HAL | 72.65 |
| 2 | 2 | P36542_ATPG_HUMAN | ATP5C1 | 32.98 |
| 2 | 2 | O95639_CPSF4_HUMAN | CPSF4 | 30.23 |
| 2 | 2 | Q15393_SF3B3_HUMAN | SF3B3 | 135.49 |
| 2 | 2 | O14983_AT2A1_HUMAN | ATP2A1 | 110.18 |
| 2 | 2 | P04792_HSPB1_HUMAN | HSPB1 | 22.77 |
| 2 | 2 | Q14204_DYHC1_HUMAN | DYNC1H1 | 532.07 |
| 2 | 2 | IGKC_MOUSE | | 11.77 |
| 2 | 2 | Q15758_AAAT_HUMAN | SLC1A5 | 56.56 |
| 2 | 2 | P13674_P4HA1_HUMAN | P4HA1 | 61.01 |
| 2 | 2 | P04406_G3P_HUMAN | GAPDH | 36.03 |

TABLE 5C-continued

Mass-spectrometry performed on MOCK control mSWI/SNF complex purifications
MOCK purification Fractions 12-14 (F12-14)

| Unique | Total | reference | Gene Symbol | MWT(kDa) |
|---|---|---|---|---|
| 2 | 2 | Q13867_BLMH_HUMAN | BLMH | 52.53 |
| 2 | 2 | P45880_VDAC2_HUMAN | VDAC2 | 31.55 |
| 2 | 2 | Q92841_DDX17_HUMAN | DDX17 | 80.22 |
| 2 | 2 | O00165_HAX1_HUMAN | HAX1 | 31.6 |
| 2 | 2 | Q02978_M20M_HUMAN | SLC25A11 | 34.04 |
| 2 | 2 | P50402_EMD_HUMAN | EMD | 28.98 |
| 2 | 2 | P02545_LMNA_HUMAN | LMNA | 74.09 |
| 2 | 2 | Q5UIP0_RIF1_HUMAN | RIF1 | 274.29 |
| 2 | 2 | Q08211_DHX9_HUMAN | DHX9 | 140.87 |
| 2 | 2 | Q09666_AHNK_HUMAN | AHNAK | 628.7 |
| 1 | 2 | Q9UGM3_DMBT1_HUMAN | DMBT1 | 260.57 |
| 1 | 2 | Q96EY1_DNJA3_HUMAN | DNAJA3 | 52.46 |
| 1 | 2 | P53621_COPA_HUMAN | COPA | 138.26 |
| 1 | 2 | P62304_RUXE_HUMAN | SNRPE | 10.8 |
| 1 | 2 | Q15155_NOMO1_HUMAN | NOMO1 | 134.24 |
| 1 | 2 | Q16610_ECM1_HUMAN | ECM1 | 60.64 |
| 1 | 2 | Q86Y07_VRK2_HUMAN | VRK2 | 58.1 |
| 1 | 2 | P11177_ODPB_HUMAN | PDHB | 39.21 |
| 1 | 2 | P13804_ETFA_HUMAN | ETFA | 35.06 |
| 1 | 2 | P00403_COX2_HUMAN | MT-CO2 | 25.55 |
| 1 | 1 | P07477_TRY1_HUMAN | PRSS1 | 26.54 |
| 1 | 1 | IGHM_MOUSE | Igh-6 | 49.94 |
| 1 | 1 | Q5T280_CI114_HUMAN | C9orf114 | 41.98 |
| 1 | 1 | Q6UWP8_SBSN_HUMAN | SBSN | 60.5 |
| 1 | 1 | O15269_SPTC1_HUMAN | SPTLC1 | 52.71 |
| 1 | 1 | P08865_RSSA_HUMAN | RPSA | 32.83 |
| 1 | 1 | P51571_SSRD_HUMAN | SSR4 | 18.99 |
| 1 | 1 | Q9HCY8_S10AE_HUMAN | S100A14 | 11.65 |
| 1 | 1 | P62805_H4_HUMAN | HIST1H4A | 11.36 |
| 1 | 1 | Q9UHX1_PUF60_HUMAN | PUF60 | 59.84 |
| 1 | 1 | P12273_PIP_HUMAN | PIP | 16.56 |
| 1 | 1 | Q8TAA3_PSA7L_HUMAN | PSMA8 | 28.51 |
| 1 | 1 | P07910_HNRPC_HUMAN | HNRNPC | 33.65 |
| 1 | 1 | P20618_PSB1_HUMAN | PSMB1 | 26.47 |
| 1 | 1 | P14649_MYL6B_HUMAN | MYL6B | 22.75 |
| 1 | 1 | P31689_DNJA1_HUMAN | DNAJA1 | 44.84 |
| 1 | 1 | Q15365_PCBP1_HUMAN | PCBP1 | 37.47 |
| 1 | 1 | Q58FF8_H90B2_HUMAN | HSP90AB2P | 44.32 |
| 1 | 1 | Q06830_PRDX1_HUMAN | PRDX1 | 22.1 |
| 1 | 1 | Q3ZCQ8_TIM50_HUMAN | TIMM50 | 39.62 |
| 1 | 1 | P28072_PSB6_HUMAN | PSMB6 | 25.34 |
| 1 | 1 | O14828_SCAM3_HUMAN | SCAMP3 | 38.26 |
| 1 | 1 | Q12873_CHD3_HUMAN | CHD3 | 226.45 |
| 1 | 1 | P07237_PDIA1_HUMAN | P4HB | 57.08 |
| 1 | 1 | P37837_TALDO_HUMAN | TALDO1 | 37.52 |
| 1 | 1 | Q01650_LAT1_HUMAN | SLC7A5 | 54.97 |
| 1 | 1 | P01591_IGJ_HUMAN | IGJ | 18.09 |
| 1 | 1 | P14618_KPYM_HUMAN | PKM | 57.9 |
| 1 | 1 | P68371_TBB4B_HUMAN | TUBB4B | 49.8 |
| 1 | 1 | O75528_TADA3_HUMAN | TAD A3 | 48.87 |
| 1 | 1 | Q16563_SYPL1_HUMAN | SYPL1 | 28.55 |
| 1 | 1 | P05161_ISG15_HUMAN | ISG15 | 17.88 |
| 1 | 1 | P08559_ODPA_HUMAN | PDHA1 | 43.27 |
| 1 | 1 | KV2A7_MOUSE | | 12.27 |
| 1 | 1 | Q15007_FL2D_HUMAN | WTAP | 44.22 |
| 1 | 1 | P25789_PSA4_HUMAN | PSMA4 | 29.47 |
| 1 | 1 | P56537_IF6_HUMAN | EIF6 | 26.58 |
| 1 | 1 | P62258_1433E_HUMAN | YWHAE | 29.16 |
| 1 | 1 | Q9H936_GHC1_HUMAN | SLC25A22 | 34.45 |
| 1 | 1 | Q6P4A8_PLBL1_HUMAN | PLBD1 | 63.21 |
| 1 | 1 | P60174_TPIS_HUMAN | TPI1 | 30.77 |
| 1 | 1 | P35250_RFC2_HUMAN | RFC2 | 39.13 |
| 1 | 1 | Q14498_RBM39_HUMAN | RBM39 | 59.34 |
| 1 | 1 | P62913_RL11_HUMAN | RPL11 | 20.24 |
| 1 | 1 | P49720_PSB3_HUMAN | PSMB3 | 22.93 |
| 1 | 1 | P02788_TRFL_HUMAN | LTF | 78.13 |
| 1 | 1 | P06493_CDK1_HUMAN | CDK1 | 34.07 |
| 1 | 1 | Q13422_IKZF1_HUMAN | IKZF1 | 57.49 |
| 1 | 1 | Q96QV6_H2A1A_HUMAN | HIST1H2AA | 14.22 |
| 1 | 1 | Q9UBM7_DHCR7_HUMAN | DHCR7 | 54.45 |
| 1 | 1 | Q9BXF6_RFIP5_HUMAN | RAB11FIP5 | 70.37 |
| 1 | 1 | Q9Y6J9_TAF6L_HUMAN | TAF6L | 67.77 |
| 1 | 1 | O95400_CD2B2_HUMAN | CD2BP2 | 37.62 |
| 1 | 1 | Q8IY92_SLX4_HUMAN | SLX4 | 199.89 |
| 1 | 1 | P51572_BAP31_HUMAN | BCAP31 | 27.97 |

TABLE 5C-continued

| Mass-spectrometry performed on MOCK control mSWI/SNF complex purifications MOCK purification Fractions 12-14 (F12-14) | | | | |
|---|---|---|---|---|
| Unique | Total | reference | Gene Symbol | MWT(kDa) |
| 1 | 1 | Q86Y39_NDUAB_HUMAN | NDUFA11 | 14.84 |
| 1 | 1 | P04083_ANXA1_HUMAN | ANXA1 | 38.69 |
| 1 | 1 | Q96A08_H2B1A_HUMAN | HIST1H2BA | 14.16 |
| 1 | 1 | G3V542_G3V542_HUMAN | TUBB3 | 4.97 |
| 1 | 1 | P01857_IGHG1_HUMAN | IGHG1 | 36.08 |
| 1 | 1 | Q9P035_HACD3_HUMAN | PTPLAD1 | 43.13 |
| 1 | 1 | Q16695_H31T_HUMAN | HIST3H3 | 15.5 |
| 1 | 1 | P32119_PRDX2_HUMAN | PRDX2 | 21.88 |
| 1 | 1 | Q86VP6_CAND1_HUMAN | CAND1 | 136.29 |
| 1 | 1 | P49327_FAS_HUMAN | FASN | 273.25 |
| 1 | 1 | Q15828_CYTM_HUMAN | CST6 | 16.5 |
| 1 | 1 | P26641_EFIG_HUMAN | EEF1G | 50.09 |
| 1 | 1 | Q96HS1_PGAM5_HUMAN | PGAM5 | 31.98 |
| 1 | 1 | Q9BUQ8_DDX23_HUMAN | DDX23 | 95.52 |
| 1 | 1 | Q9BUF5_TBB6_HUMAN | TUBB6 | 49.82 |
| 1 | 1 | Q76M96_CCD80_HUMAN | CCDC80 | 108.11 |
| 1 | 1 | P27482_CALL3_HUMAN | CALML3 | 16.88 |
| 1 | 1 | Q12769_NU160_HUMAN | NUP160 | 162.02 |
| 1 | 1 | Q96ES7_SGF29_HUMAN | CCDC101 | 33.22 |
| 1 | 1 | P11310_ACADM_HUMAN | ACADM | 46.56 |
| 1 | 1 | P12532_KCRU_HUMAN | CKMT1A | 47.01 |

TABLE 6A

| Gradient/mass-spectrometry results in WT HEK-293T cells with HA-SMARCD1 as a bait | | | | | | | | | | | | | | | | |
|---|---|---|---|---|---|---|---|---|---|---|---|---|---|---|---|---|
| | Gradient | | | | | | | | | | | | | | | |
| | 3 | 4 | 5 | 6 | 7 | 8 | 9 | 10 | 11 | 12 | 13 | 14 | 15 | 16 | 17 | 18 |
| Subu | | | | | | | | | | | | | | | | |
| ACT | 29 | 24 | 19 | 15 | 21 | 22 | 32 | 59 | 54 | 37 | 88 | 87 | 63 | 48 | 43 | 20 |
| ACT | 40 | 24 | 19 | 22 | 22 | 21 | 53 | 90 | 80 | 74 | 131 | 139 | 112 | 86 | 81 | 54 |
| ARI | 27 | 41 | 38 | 51 | 67 | 65 | 56 | 58 | 108 | 319 | 670 | 592 | 442 | 282 | 218 | 184 |
| ARI | 8 | 13 | 16 | 17 | 27 | 30 | 29 | 38 | 58 | 129 | 381 | 339 | 212 | 122 | 88 | 76 |
| ARI | 12 | 20 | 23 | 19 | 27 | 23 | 18 | 18 | 26 | 37 | 31 | 38 | 79 | 142 | 114 | 60 |
| BCL | 25 | 14 | 9 | 6 | 12 | 6 | 25 | 24 | 22 | 21 | 53 | 35 | 28 | 27 | 12 | 14 |
| BCL | 12 | 3 | 3 | 3 | 3 | 3 | 11 | 10 | 12 | 12 | 25 | 26 | 16 | 13 | 10 | 7 |
| BRD | 5 | 5 | 7 | 3 | 6 | 8 | 16 | 11 | 13 | 13 | 20 | 21 | 41 | 71 | 51 | 22 |
| BRD | 6 | 3 | 0 | 0 | 8 | 15 | 76 | 128 | 93 | 35 | 20 | 14 | 14 | 11 | 12 | 6 |
| DPF | 11 | 10 | 9 | 10 | 11 | 9 | 9 | 13 | 19 | 54 | 76 | 74 | 62 | 36 | 41 | 33 |
| GLT | 11 | 15 | 29 | 26 | 38 | 46 | 144 | 222 | 154 | 75 | 26 | 22 | 26 | 23 | 23 | 25 |
| PBR | 41 | 35 | 39 | 48 | 47 | 46 | 44 | 47 | 58 | 49 | 31 | 46 | 124 | 321 | 266 | 136 |
| PHF | 8 | 7 | 3 | 2 | 4 | 2 | 6 | 5 | 6 | 6 | 3 | 8 | 16 | 25 | 26 | 15 |
| SMA | 8 | 9 | 8 | 5 | 17 | 37 | 112 | 170 | 144 | 152 | 242 | 228 | 148 | 109 | 105 | 45 |
| SMA | 14 | 14 | 12 | 8 | 23 | 26 | 75 | 107 | 81 | 83 | 187 | 159 | 92 | 63 | 64 | 41 |
| SMA | 12 | 11 | 13 | 27 | 76 | 118 | 142 | 78 | 75 | 87 | 139 | 131 | 110 | 87 | 91 | 64 |
| SMA | 38 | 228 | 738 | 715 | 530 | 575 | 636 | 480 | 387 | 353 | 473 | 525 | 410 | 290 | 265 | 188 |
| SMA | 15 | 20 | 31 | 29 | 93 | 159 | 112 | 84 | 105 | 147 | 233 | 254 | 195 | 146 | 123 | 66 |
| SMA | 326 | 286 | 463 | 468 | 371 | 425 | 418 | 333 | 257 | 262 | 286 | 276 | 233 | 194 | 167 | 110 |
| SMA | 13 | 4 | 2 | 2 | 0 | 14 | 10 | 4 | 6 | 0 | 0 | 0 | 0 | 0 | 0 | 0 |
| SMA | 3 | 2 | 3 | 3 | 2 | 3 | 2 | 4 | 3 | 1 | 0 | 0 | 0 | 2 | 1 | 1 |
| SMA | 13 | 11 | 13 | 19 | 62 | 93 | 94 | 67 | 55 | 108 | 136 | 152 | 116 | 102 | 82 | 58 |
| SS18 | 2 | 0 | 2 | 1 | 2 | 2 | 2 | 3 | 2 | 3 | 2 | 2 | 2 | 0 | 0 | 0 |
| SS18 | 0 | 0 | 0 | 0 | 0 | 2 | 3 | 3 | 3 | 3 | 4 | 15 | 3 | 3 | 3 | 3 |
| BCL | 0 | 0 | 0 | 0 | 0 | 0 | 0 | 0 | 1 | 0 | 3 | 2 | 0 | 3 | 1 | 0 |
| GLT | 0 | 0 | 3 | 13 | 17 | 11 | 13 | 67 | 78 | 32 | 11 | 11 | 10 | 9 | 11 | 13 |

TABLE 6B

Gradient/mass-spectrometry results in WT HEK-293T cells with DPF2-HA as a bait

| Subunit | Gradient Fraction 2-5 | Gradient Fraction 13-14 |
|---|---|---|
| ACTB | 16 | 24 |
| ACTL6A | 22 | 61 |
| ARID1A | 14 | 311 |
| ARID1B | 9 | 147 |
| BCL7A | 16 | 36 |
| BCL7C | 13 | 13 |
| DPF2 | 368 | 33 |
| SMARCA2 | 2 | 130 |
| SMARCA4 | 1 | 93 |
| SMARCB1 | 4 | 62 |
| SMARCC1 | 21 | 359 |
| SMARCC2 | 3 | 110 |
| SMARCD1 | 5 | 83 |
| SMARCD2 | 3 | 51 |
| SMARCE1 | 5 | 118 |
| SS18 | 1 | 2 |
| SS18L1 | 0 | 3 |
| SMARCD3 | 0 | 23 |

TABLE 6C

Gradient/mass-spectrometry results in WT HEK-293T cells with HA-SMARCC1 as a bait

| Subunit | Gradient Fraction 7-8 | 9-10 | 13-14 | 16-17 |
|---|---|---|---|---|
| ACTB | 11 | 18 | 33 | 13 |
| ACTL6A | 13 | 28 | 90 | 40 |
| ARID1A | 22 | 6 | 409 | 107 |
| ARID1B | 5 | 1 | 257 | 45 |
| DPF2 | 13 | 8 | 97 | 17 |
| GLTSCR1 | 9 | 71 | 33 | 8 |
| PBRM1 | 10 | 4 | 34 | 92 |
| SMARCA2 | 6 | 28 | 197 | 41 |
| SMARCA4 | 7 | 20 | 131 | 36 |
| SMARCB1 | 200 | 67 | 116 | 35 |
| SMARCC1 | 831 | 227 | 330 | 146 |
| SMARCC2 | 103 | 30 | 90 | 17 |
| SMARCD1 | 120 | 70 | 119 | 42 |
| SMARCD2 | 115 | 69 | 126 | 27 |
| SMARCD3 | 24 | 11 | 46 | 6 |
| SMARCE1 | 166 | 61 | 120 | 64 |
| ARID2 | 0 | 1 | 35 | 47 |
| BCL7A | 0 | 5 | 52 | 16 |
| BCL7C | 0 | 9 | 48 | 7 |
| BRD9 | 0 | 31 | 24 | 0 |
| BCL7B | 0 | 0 | 3 | 0 |
| SS18L1 | 0 | 0 | 14 | 0 |
| GLTSCR1L | 0 | 1 | 11 | 0 |
| PHF10 | 0 | 0 | 7 | 12 |
| BRD7 | 0 | 0 | 18 | 17 |

TABLE 6D

Gradient/mass-spectrometry results in WT HEK-293T cells with HA-SMARCB1 as a bait

| | Gradient | | | | | | | | | | | | | | | |
|---|---|---|---|---|---|---|---|---|---|---|---|---|---|---|---|---|
| Subu | 3 | 4 | 5 | 6 | 7 | 8 | 9 | 10 | 11 | 12 | 13 | 14 | 15 | 16 | 17 | 18 |
| ACT | 301 | 174 | 131 | 80 | 53 | 25 | 55 | 53 | 39 | 71 | 144 | 115 | 100 | 23 | 23 | 19 |
| ACT | 62 | 46 | 40 | 40 | 33 | 16 | 29 | 40 | 48 | 65 | 115 | 128 | 100 | 44 | 44 | 31 |
| ARI | 9 | 17 | 23 | 63 | 39 | 83 | 40 | 94 | 113 | 284 | 531 | 413 | 376 | 129 | 129 | 110 |
| ARI | 6 | 17 | 12 | 50 | 38 | 45 | 36 | 61 | 80 | 125 | 227 | 265 | 219 | 75 | 75 | 41 |
| BCL | 39 | 19 | 10 | 10 | 5 | 20 | 26 | 20 | 23 | 41 | 61 | 94 | 90 | 22 | 22 | 14 |
| BCL | 2 | 0 | 0 | 0 | 0 | 1 | 0 | 0 | 0 | 1 | 0 | 4 | 3 | 1 | 1 | 0 |
| BCL | 5 | 4 | 3 | 7 | 4 | 7 | 6 | 6 | 5 | 17 | 28 | 23 | 14 | 7 | 7 | 6 |
| DPF | 15 | 9 | 13 | 14 | 16 | 17 | 17 | 15 | 24 | 136 | 161 | 160 | 139 | 22 | 22 | 39 |
| PBR | 8 | 12 | 18 | 23 | 19 | 22 | 21 | 27 | 22 | 22 | 15 | 33 | 77 | 142 | 142 | 93 |
| PHF | 4 | 3 | 3 | 1 | 1 | 2 | 1 | 1 | 1 | 1 | 1 | 4 | 7 | 6 | 6 | 5 |
| SM | 4 | 4 | 6 | 4 | 4 | 16 | 6 | 18 | 29 | 63 | 305 | 83 | 180 | 26 | 26 | 37 |
| SM | 4 | 6 | 4 | 8 | 5 | 19 | 6 | 18 | 27 | 65 | 259 | 70 | 141 | 17 | 17 | 40 |
| SM | 393 | 231 | 163 | 261 | 407 | 368 | 283 | 265 | 204 | 195 | 207 | 209 | 171 | 66 | 66 | 90 |
| SM | 18 | 31 | 54 | 261 | 710 | 1291 | 402 | 602 | 331 | 348 | 595 | 472 | 531 | 87 | 87 | 108 |
| SM | 10 | 15 | 49 | 70 | 53 | 343 | 38 | 84 | 73 | 103 | 271 | 58 | 206 | 36 | 36 | 40 |
| SM | 9 | 14 | 32 | 46 | 106 | 259 | 195 | 105 | 96 | 163 | 184 | 247 | 122 | 53 | 53 | 47 |
| SM | 10 | 11 | 17 | 15 | 89 | 168 | 126 | 70 | 63 | 95 | 115 | 144 | 91 | 33 | 33 | 30 |
| SM | 3 | 2 | 5 | 13 | 29 | 35 | 35 | 26 | 32 | 40 | 42 | 38 | 28 | 16 | 16 | 13 |
| SM | 10 | 9 | 21 | 104 | 365 | 329 | 283 | 219 | 147 | 164 | 224 | 242 | 205 | 71 | 71 | 95 |
| ARI | 0 | 4 | 14 | 9 | 6 | 8 | 5 | 9 | 9 | 28 | 34 | 33 | 42 | 68 | 68 | 45 |
| SS18 | 0 | 0 | 0 | 0 | 0 | 1 | 0 | 1 | 2 | 4 | 4 | 3 | 5 | 0 | 0 | 3 |
| BRD | 0 | 3 | 3 | 3 | 3 | 4 | 0 | 5 | 8 | 16 | 12 | 18 | 22 | 22 | 22 | 20 |
| SS18 | 0 | 0 | 1 | 1 | 1 | 1 | 2 | 1 | 1 | 1 | 5 | 9 | 6 | 1 | 1 | 1 |

TABLE 6E

Gradient/mass-spectrometry results in WT HEK-293T cells with HA-SMARCE1 as a bait

| | Gradient Fraction | | | |
|---|---|---|---|---|
| Subunit | 7-8 | 9-10 | 13-14 | 16-17 |
| ACTB | 11 | 10 | 21 | 7 |
| ACTL6A | 19 | 27 | 61 | 30 |
| ARID1A | 64 | 91 | 273 | 67 |
| ARID1B | 16 | 36 | 176 | 25 |
| BCL7C | 1 | 2 | 31 | 2 |
| DPF2 | 20 | 24 | 78 | 10 |
| PBRM1 | 11 | 15 | 16 | 89 |
| SMARCA2 | 17 | 31 | 127 | 17 |
| SMARCA4 | 19 | 24 | 73 | 13 |
| SMARCB1 | 138 | 79 | 79 | 25 |
| SMARCC1 | 523 | 272 | 196 | 90 |
| SMARCC2 | 168 | 117 | 117 | 30 |
| SMARCD1 | 74 | 66 | 96 | 30 |
| SMARCD2 | 61 | 48 | 74 | 15 |
| SMARCD3 | 18 | 15 | 31 | 7 |
| SMARCE1 | 163 | 106 | 94 | 58 |
| SS18 | 1 | 3 | 0 | 1 |
| BCL7A | 0 | 11 | 39 | 12 |
| SS18L1 | 0 | 0 | 19 | 0 |
| ARID2 | 0 | 0 | 19 | 41 |
| PHF10 | 0 | 0 | 8 | 11 |
| BRD7 | 0 | 0 | 8 | 18 |

TABLE 6F

Gradient/mass-spectrometry results in WT HEK-293T cells with HA-SMARCD2 as a bait

| | Gradient Fraction | | | | | |
|---|---|---|---|---|---|---|
| Subunit | 3-4 | 5-6 | 7-8 | 10-11 | 13-14 | 16-17 |
| ACTL6A | 17 | 13 | 16 | 18 | 44 | 16 |
| ARID1A | 10 | 12 | 20 | 39 | 170 | 25 |
| ARID1B | 1 | 3 | 8 | 21 | 120 | 11 |
| ARID2 | 3 | 1 | 5 | 0 | 27 | 25 |
| BCL7A | 8 | 3 | 0 | 3 | 18 | 0 |
| BCL7B | 2 | 0 | 0 | 0 | 21 | 0 |
| BCL7C | 5 | 1 | 1 | 1 | 10 | 0 |
| BRD7 | 1 | 0 | 1 | 0 | 13 | 6 |
| DPF2 | 10 | 6 | 7 | 11 | 71 | 8 |
| PBRM1 | 9 | 8 | 10 | 6 | 43 | 31 |
| PHF10 | 7 | 0 | 1 | 0 | 9 | 3 |
| SMARCA2 | 1 | 2 | 5 | 12 | 64 | 12 |
| SMARCA4 | 4 | 2 | 5 | 7 | 52 | 13 |
| SMARCB1 | 7 | 6 | 53 | 19 | 54 | 16 |
| SMARCC1 | 23 | 30 | 76 | 37 | 97 | 23 |
| SMARCC2 | 18 | 24 | 94 | 39 | 140 | 20 |
| SMARCD1 | 2 | 0 | 4 | 0 | 0 | 0 |
| SMARCD2 | 172 | 41 | 88 | 41 | 76 | 22 |
| SMARCD3 | 60 | 8 | 19 | 4 | 16 | 4 |
| SMARCE1 | 7 | 8 | 54 | 31 | 68 | 16 |
| SS18 | 0 | 0 | 0 | 0 | 2 | 0 |
| SS18L1 | 0 | 0 | 0 | 0 | 7 | 0 |

TABLE 6G

Gradient/mass-spectrometry results in delSMARCD1 HEK-293T cells with HA-SMARCE1 as a bait

| | Gradient Fraction | | | | |
|---|---|---|---|---|---|
| Subunit | 3-4 | 7-8 | 10-11 | 13-14 | 15-16 |
| DPF2 | 6 | 13 | 6 | 4 | 2 |
| SMARCB1 | 11 | 748 | 158 | 56 | 13 |
| SMARCC1 | 66 | 2839 | 661 | 167 | 52 |
| SMARCC2 | 43 | 1683 | 345 | 120 | 29 |
| SMARCE1 | 640 | 1019 | 494 | 257 | 82 |
| SMARCA4 | 0 | 0 | 2 | 0 | 0 |

TABLE 6H

Gradient/mass-spectrometry results in delSMARCE1 HEK-293T cells with HA-SMARCD1 as a bait

| | Gradient Fraction | | | | |
|---|---|---|---|---|---|
| Subunit | 5-6 | 8-9 | 10-11 | 13-14 | 16-17 |
| ACTL6A | 8 | 10 | 34 | 58 | 40 |
| ARID1A | 108 | 22 | 25 | 47 | 8 |
| ARID1B | 26 | 2 | 9 | 27 | 0 |
| ARID2 | 29 | 6 | 2 | 17 | 20 |
| BCL7A | 2 | 1 | 34 | 7 | 2 |
| GLTSCR1 | 1 | 11 | 15 | 2 | 0 |
| BRD7 | 2 | 1 | 2 | 6 | 9 |
| DPF2 | 5 | 14 | 9 | 7 | 2 |
| PBRM1 | 13 | 0 | 9 | 13 | 41 |
| PHF10 | 3 | 3 | 2 | 0 | 2 |
| SMARCA2 | 3 | 8 | 25 | 17 | 3 |
| SMARCA4 | 4 | 11 | 52 | 22 | 7 |
| SMARCB1 | 5 | 485 | 154 | 37 | 19 |
| SMARCC1 | 1117 | 1522 | 498 | 94 | 27 |
| SMARCC2 | 269 | 1449 | 524 | 112 | 38 |
| SMARCD1 | 735 | 1391 | 582 | 120 | 58 |
| SMARCD3 | 151 | 391 | 85 | 23 | 8 |
| SMARCE1 | 2 | 1 | 3 | 18 | 4 |
| BRD9 | 0 | 3 | 9 | 0 | 0 |
| BCL7C | 0 | 2 | 7 | 3 | 4 |
| SS18 | 0 | 0 | 1 | 2 | 0 |
| SS18L1 | 0 | 0 | 0 | 2 | 0 |
| GLTSCR1L | 0 | 0 | 4 | 0 | 0 |
| SMARCD2 | 0 | 11 | 3 | 0 | 0 |
| BCL7B | 0 | 0 | 2 | 0 | 0 |

TABLE 6I

Gradient/mass-spectrometry results in delSMARCB1 HEK-293T cells with HA-SMARCD1 as a bait

| | Gradient Fraction | | | | |
|---|---|---|---|---|---|
| Subunit | 5-6 | 7-8 | 10-11 | 13-14 | 15-16 |
| ACTL6A | 14 | 22 | 57 | 221 | 50 |
| ARID1A | 163 | 142 | 105 | 734 | 201 |
| ARID1B | 34 | 35 | 25 | 134 | 26 |
| ARID2 | 9 | 14 | 30 | 151 | 71 |
| BCL7C | 3 | 2 | 8 | 20 | 6 |
| GLTSCR1 | 3 | 10 | 77 | 8 | 5 |
| BRD7 | 3 | 4 | 16 | 66 | 19 |
| PBRM1 | 11 | 15 | 8 | 58 | 46 |
| SMARCA2 | 3 | 14 | 84 | 302 | 49 |
| SMARCA4 | 5 | 9 | 87 | 188 | 38 |
| SMARCC1 | 1337 | 659 | 186 | 362 | 56 |

TABLE 6I-continued

Gradient/mass-spectrometry results in delSMARCB1 HEK-293T cells with HA-SMARCD1 as a bait

| | Gradient Fraction | | | | |
|---|---|---|---|---|---|
| | 5-6 | 7-8 | 10-11 | 13-14 | 15-16 |
| SMARCC2 | 623 | 583 | 210 | 871 | 137 |
| SMARCD1 | 1230 | 908 | 310 | 540 | 142 |
| SMARCD3 | 191 | 94 | 46 | 109 | 19 |
| SMARCE1 | 14 | 306 | 93 | 309 | 95 |
| BCL7A | 0 | 10 | 66 | 97 | 36 |
| SS18L1 | 0 | 1 | 1 | 4 | 1 |
| SMARCD2 | 0 | 1 | 2 | 0 | 0 |
| BCL7B | 0 | 0 | 13 | 9 | 10 |
| BRD9 | 0 | 0 | 30 | 4 | 1 |
| SS18 | 0 | 0 | 6 | 11 | 6 |
| GLTSCR1L | 0 | 0 | 18 | 5 | 2 |
| SMARCB1 | 0 | 0 | 0 | 1 | 1 |
| DPF2 | 0 | 0 | 0 | 3 | 1 |

TABLE 6J

Gradient/mass-spectrometry results in WT HEK-293T cells with HA-ARID1A C-terminus as a bait

| | Gradient Fraction | | | |
|---|---|---|---|---|
| Subunit | 3-4 | 9-10 | 13-14 | 16-17 |
| ACTB | 30 | 6 | 60 | 22 |
| ACTL6A | 30 | 19 | 130 | 55 |
| ARID1A | 599 | 261 | 398 | 150 |
| BCL7A | 26 | 4 | 91 | 34 |
| BCL7C | 7 | 5 | 22 | 10 |
| DPF2 | 34 | 84 | 128 | 36 |
| SMARCA2 | 3 | 33 | 321 | 54 |
| SMARCA4 | 2 | 32 | 268 | 31 |
| SMARCB1 | 7 | 125 | 151 | 51 |
| SMARCC1 | 22 | 407 | 837 | 209 |
| SMARCC2 | 5 | 95 | 124 | 34 |
| SMARCD1 | 9 | 61 | 167 | 67 |
| SMARCD2 | 2 | 75 | 64 | 35 |
| SMARCD3 | 2 | 31 | 33 | 19 |
| SMARCE1 | 12 | 138 | 238 | 95 |
| SS18 | 1 | 1 | 5 | 2 |
| SS18L1 | 0 | 0 | 4 | 0 |
| BCL7B | 0 | 0 | 0 | 1 |

TABLE 6K

Gradient/mass-spectrometry results in delARID1A, 1B HEK-293T cells with HA-SMARCD1 as a bait

| | Gradient Fraction | | | | |
|---|---|---|---|---|---|
| Subunit | 3-4 | 8-9 | 10-11 | 13-14 | 16-17 |
| ACTB | 12 | 3 | 18 | 6 | 10 |
| ACTL6A | 16 | 13 | 58 | 16 | 42 |
| ARID2 | 2 | 9 | 10 | 14 | 71 |
| BCL7A | 3 | 0 | 15 | 0 | 8 |
| BCL7C | 2 | 0 | 4 | 1 | 0 |
| BRD7 | 5 | 2 | 4 | 5 | 31 |
| DPF2 | 2 | 0 | 0 | 2 | 1 |
| GLTSCR1 | 6 | 25 | 146 | 23 | 8 |
| PBRM1 | 17 | 26 | 21 | 6 | 194 |
| PHF10 | 3 | 0 | 0 | 3 | 23 |
| SMARCA2 | 2 | 8 | 62 | 9 | 22 |
| SMARCA4 | 3 | 7 | 33 | 10 | 18 |
| SMARCB1 | 7 | 182 | 93 | 17 | 37 |

TABLE 6K-continued

Gradient/mass-spectrometry results in delARID1A, 1B HEK-293T cells with HA-SMARCD1 as a bait

| | Gradient Fraction | | | | |
|---|---|---|---|---|---|
| | 3-4 | 8-9 | 10-11 | 13-14 | 16-17 |
| SMARCC1 | 97 | 718 | 457 | 65 | 103 |
| SMARCC2 | 12 | 243 | 104 | 24 | 100 |
| SMARCD1 | 666 | 631 | 343 | 67 | 90 |
| SMARCD3 | 2 | 0 | 1 | 1 | 0 |
| SMARCE1 | 11 | 142 | 71 | 33 | 61 |
| BRD9 | 0 | 8 | 51 | 5 | 2 |
| SS18L1 | 0 | 0 | 1 | 0 | 0 |
| GLTSCR1L | 0 | 4 | 15 | 4 | 1 |
| SMARCD2 | 0 | 5 | 4 | 0 | 0 |
| SS18 | 0 | 0 | 2 | 1 | 1 |
| BCL7B | 0 | 0 | 1 | 0 | 0 |

TABLE 6L

Gradient/mass-spectrometry results in delARID1A, 1B, 2 HEK-293T cells with HA-SMARCD1 as a bait

| | Gradient Fraction | | | | | |
|---|---|---|---|---|---|---|
| Subunit | 2-3 | 5-6 | 7-8 | 9-10 | 13-14 | 16-17 |
| ACTB | 25 | 12 | 8 | 16 | 7 | 4 |
| ACTL6A | 8 | 8 | 18 | 40 | 19 | 11 |
| BCL7A | 6 | 0 | 6 | 24 | 8 | 1 |
| BRD9 | 5 | 7 | 17 | 50 | 4 | 5 |
| DPF2 | 5 | 0 | 1 | 1 | 6 | 1 |
| GLTSCR1 | 4 | 33 | 43 | 100 | 29 | 16 |
| GLTSCR1L | 1 | 5 | 8 | 23 | 10 | 3 |
| SMARCA4 | 1 | 5 | 15 | 47 | 10 | 7 |
| SMARCB1 | 5 | 14 | 183 | 90 | 26 | 14 |
| SMARCC1 | 43 | 1270 | 987 | 452 | 75 | 65 |
| SMARCC2 | 12 | 73 | 347 | 177 | 43 | 27 |
| SMARCD1 | 1886 | 1400 | 834 | 447 | 115 | 74 |
| SMARCD2 | 1 | 0 | 4 | 3 | 0 | 0 |
| SMARCD3 | 6 | 6 | 1 | 2 | 2 | 1 |
| SMARCE1 | 17 | 13 | 134 | 80 | 22 | 14 |
| PHF10 | 1 | 0 | 0 | 0 | 0 | 0 |
| BCL7C | 0 | 0 | 1 | 8 | 0 | 0 |
| SMARCA2 | 0 | 7 | 26 | 71 | 15 | 10 |
| SS18 | 0 | 0 | 0 | 3 | 0 | 0 |
| SS18L1 | 0 | 0 | 0 | 6 | 0 | 0 |
| ARID1B | 0 | 0 | 0 | 0 | 4 | 0 |
| ARID1A | 0 | 0 | 0 | 0 | 14 | 0 |

TABLE 6M

Gradient/mass-spectrometry results in delSMARCA HEK-293T cells with HA-SMARCD1 as a bait

| | Gradient Fraction | | |
|---|---|---|---|
| Subunit | 7 | 9 | 11 |
| ARID1A | 100 | 69 | 241 |
| ARID1B | 48 | 51 | 111 |
| ARID2 | 23 | 35 | 103 |
| GLTSCR1 | 62 | 27 | 11 |
| GLTSCR1L | 41 | 13 | 11 |
| BRD7 | 10 | 15 | 44 |
| BRD9 | 37 | 13 | 6 |

TABLE 6M-continued

Gradient/mass-spectrometry results in delSMARCA HEK-293T cells with HA-SMARCD1 as a bait

| | Gradient Fraction | | |
|---|---|---|---|
| | 7 | 9 | 11 |
| DPF2 | 8 | 16 | 26 |
| SMARCB1 | 92 | 259 | 125 |
| SMARCC1 | 327 | 927 | 430 |
| SMARCC2 | 222 | 663 | 376 |
| SMARCD1 | 367 | 519 | 211 |
| SMARCD3 | 70 | 175 | 56 |
| SMARCE1 | 186 | 632 | 238 |
| PHF10 | 0 | 1 | 7 |
| SMARCA4 | 0 | 3 | 3 |

TABLE 6O-continued

Gradient/mass-spectrometry results in WT HEK-293T cells with Flag-HA-SS18 as a bait

| | Gradient Fraction | | | |
|---|---|---|---|---|
| | 7-8 | 9-10 | 13-14 | 16-17 |
| GLTSCR1L | 9 | 20 | 13 | 9 |
| SMARCA2 | 195 | 201 | 198 | 46 |
| SMARCA4 | 214 | 160 | 156 | 40 |
| SMARCB1 | 26 | 27 | 89 | 31 |
| SMARCC1 | 80 | 232 | 435 | 126 |
| SMARCC2 | 30 | 42 | 185 | 62 |
| SMARCD1 | 38 | 92 | 142 | 43 |
| SMARCD2 | 25 | 38 | 103 | 19 |
| SMARCD3 | 8 | 15 | 32 | 16 |
| SMARCE1 | 25 | 20 | 127 | 75 |

TABLE 6N

Gradient/mass-spectrometry results in WT HEK-293T cells with HA-SMARCA4 as a bait

| | Gradient | | | | | | | | | | | | | | | |
|---|---|---|---|---|---|---|---|---|---|---|---|---|---|---|---|---|
| | 3 | 4 | 5 | 6 | 7 | 8 | 9 | 10 | 11 | 12 | 13 | 14 | 15 | 16 | 17 | 18 |
| Subu | | | | | | | | | | | | | | | | |
| ACT | 26 | 11 | 15 | 41 | 76 | 37 | 23 | 25 | 13 | 20 | 29 | 23 | 18 | 13 | 10 | 5 |
| ACT | 43 | 26 | 24 | 96 | 165 | 103 | 82 | 85 | 57 | 97 | 93 | 65 | 46 | 51 | 30 | 27 |
| ARI | 4 | 11 | 25 | 21 | 19 | 19 | 22 | 37 | 88 | 331 | 434 | 241 | 128 | 93 | 65 | 55 |
| BCL | 4 | 1 | 6 | 22 | 45 | 37 | 21 | 21 | 14 | 11 | 20 | 16 | 12 | 0 | 5 | 0 |
| DPF | 6 | 3 | 5 | 5 | 6 | 7 | 5 | 6 | 17 | 44 | 60 | 35 | 17 | 14 | 15 | 10 |
| GLT | 5 | 5 | 6 | 3 | 7 | 46 | 90 | 85 | 46 | 15 | 11 | 13 | 9 | 8 | 5 | 5 |
| PBR | 6 | 5 | 17 | 19 | 13 | 13 | 11 | 19 | 19 | 6 | 13 | 45 | 129 | 104 | 51 | 38 |
| SM | 22 | 23 | 124 | 183 | 381 | 221 | 87 | 91 | 86 | 139 | 184 | 74 | 56 | 30 | 19 | 11 |
| SM | 41 | 30 | 178 | 283 | 518 | 292 | 107 | 128 | 106 | 160 | 188 | 87 | 61 | 38 | 25 | 15 |
| SM | 6 | 2 | 4 | 5 | 3 | 5 | 13 | 42 | 46 | 82 | 89 | 63 | 56 | 39 | 18 | 17 |
| SM | 11 | 12 | 18 | 17 | 21 | 61 | 75 | 166 | 168 | 380 | 479 | 231 | 144 | 104 | 95 | 42 |
| SM | 5 | 6 | 9 | 9 | 15 | 33 | 64 | 82 | 61 | 91 | 110 | 64 | 55 | 47 | 41 | 33 |
| SM | 1 | 1 | 3 | 6 | 6 | 7 | 11 | 13 | 19 | 51 | 59 | 39 | 20 | 18 | 11 | 9 |
| SM | 4 | 5 | 7 | 9 | 7 | 10 | 19 | 58 | 76 | 116 | 129 | 106 | 81 | 62 | 61 | 41 |
| SS18 | 2 | 2 | 4 | 5 | 9 | 6 | 3 | 3 | 4 | 2 | 4 | 2 | 3 | 2 | 2 | 0 |
| GLT | 0 | 0 | 1 | 0 | 0 | 0 | 7 | 17 | 9 | 4 | 0 | 1 | 1 | 1 | 2 | 1 |
| BCL | 0 | 1 | 1 | 10 | 31 | 18 | 16 | 8 | 6 | 13 | 16 | 8 | 4 | 4 | 1 | 1 |
| BRD | 0 | 0 | 0 | 0 | 2 | 11 | 21 | 22 | 12 | 7 | 4 | 4 | 4 | 3 | 0 | 0 |
| ARI | 0 | 1 | 4 | 9 | 4 | 8 | 3 | 8 | 8 | 8 | 14 | 22 | 44 | 45 | 21 | 17 |
| BRD | 0 | 0 | 2 | 2 | 4 | 3 | 1 | 2 | 3 | 6 | 6 | 9 | 17 | 16 | 10 | 5 |
| SM | 0 | 3 | 9 | 9 | 9 | 16 | 18 | 54 | 73 | 175 | 168 | 85 | 80 | 53 | 38 | 25 |
| PHF | 0 | 0 | 0 | 0 | 0 | 0 | 0 | 0 | 0 | 1 | 0 | 1 | 9 | 9 | 5 | 0 |
| BCL | 0 | 0 | 0 | 0 | 4 | 3 | 1 | 0 | 0 | 2 | 2 | 1 | 0 | 0 | 0 | 0 |
| ARI | 0 | 0 | 3 | 5 | 3 | 2 | 5 | 13 | 31 | 80 | 149 | 73 | 43 | 35 | 22 | 18 |
| SS18 | 0 | 0 | 0 | 2 | 1 | 1 | 0 | 0 | 0 | 1 | 1 | 0 | 0 | 0 | 0 | 0 |
| SM | 0 | 0 | 0 | 2 | 1 | 4 | 5 | 21 | 19 | 19 | 18 | 17 | 11 | 8 | 5 | 4 |

TABLE 6O

Gradient/mass-spectrometry results in WT HEK-293T cells with Flag-HA-SS18 as a bait

| | Gradient Fraction | | | |
|---|---|---|---|---|
| | 7-8 | 9-10 | 13-14 | 16-17 |
| Subunit | | | | |
| ACTB | 43 | 32 | 41 | 21 |
| ACTL6A | 127 | 102 | 104 | 48 |
| ARID1A | 90 | 102 | 364 | 138 |
| ARID1B | 47 | 55 | 200 | 68 |
| BCL7A | 89 | 73 | 75 | 28 |
| BCL7B | 2 | 3 | 4 | 0 |
| BCL7C | 39 | 32 | 31 | 8 |
| BRD9 | 17 | 78 | 14 | 9 |
| DPF2 | 21 | 20 | 82 | 21 |
| GLTSCR1 | 23 | 155 | 29 | 20 |

TABLE 6O-continued

Gradient/mass-spectrometry results in WT HEK-293T cells with Flag-HA-SS18 as a bait

| | Gradient Fraction | | | |
|---|---|---|---|---|
| | 7-8 | 9-10 | 13-14 | 16-17 |
| SS18 | 4 | 2 | 3 | 2 |
| ARID2 | 0 | 0 | 5 | 0 |
| BRD7 | 0 | 0 | 1 | 0 |

TABLE 6P

Gradient/mass-spectrometry results in WT HEK-293T cells with HA-BCL7A as a bait

| Subunit | Gradient Fraction 2-3 | 5-6 | 7-8 | 10-11 | 13-14 | 16-17 |
|---|---|---|---|---|---|---|
| ACTL6A | 7 | 18 | 41 | 42 | 52 | 23 |
| ARID1A | 1 | 3 | 18 | 18 | 200 | 30 |
| BCL7A | 178 | 43 | 19 | 12 | 4 | 2 |
| BCL7B | 92 | 40 | 28 | 7 | 20 | 0 |
| BCL7C | 93 | 10 | 10 | 7 | 1 | 1 |
| GLTSCR1 | 15 | 4 | 10 | 53 | 14 | 1 |
| BRD7 | 1 | 1 | 1 | 0 | 2 | 4 |
| DPF2 | 6 | 5 | 8 | 8 | 37 | 7 |
| PBRM1 | 9 | 11 | 17 | 7 | 17 | 33 |
| PHF10 | 8 | 1 | 0 | 0 | 2 | 5 |
| SMARCA2 | 3 | 8 | 45 | 34 | 59 | 10 |
| SMARCA4 | 6 | 7 | 37 | 23 | 51 | 20 |
| SMARCB1 | 2 | 8 | 7 | 8 | 60 | 8 |
| SMARCC1 | 9 | 16 | 15 | 40 | 58 | 23 |
| SMARCC2 | 6 | 12 | 14 | 22 | 125 | 24 |
| SMARCD1 | 4 | 13 | 10 | 29 | 29 | 10 |
| SMARCE1 | 5 | 13 | 10 | 16 | 64 | 19 |
| SS18 | 0 | 1 | 3 | 2 | 3 | 1 |
| SS18L1 | 0 | 1 | 1 | 1 | 9 | 0 |
| ARID2 | 0 | 2 | 5 | 0 | 18 | 22 |
| GLTSCR1L | 0 | 1 | 2 | 13 | 11 | 0 |
| SMARCD2 | 0 | 0 | 4 | 1 | 49 | 4 |
| SMARCD3 | 0 | 4 | 4 | 13 | 54 | 7 |
| BRD9 | 0 | 0 | 0 | 11 | 6 | 0 |
| ARID1B | 0 | 0 | 11 | 0 | 147 | 12 |

TABLE 6Q

Gradient/mass-spectrometry results in WT HEK-293T cells with HA-miniARID2 as a bait

| Subunit | Gradient Fraction 03-04 | 07-08 | 09-10 | 12-13 | 15-16 |
|---|---|---|---|---|---|
| ACTL6A | 24 | 22 | 19 | 39 | 66 |
| ARID2 | 92 | 66 | 34 | 44 | 90 |
| BCL7A | 37 | 7 | 2 | 17 | 25 |
| BCL7B | 4 | 0 | 0 | 0 | 7 |
| BCL7C | 7 | 7 | 5 | 6 | 9 |
| BRD7 | 12 | 11 | 6 | 20 | 64 |
| PBRM1 | 18 | 35 | 16 | 23 | 236 |
| PHF10 | 26 | 5 | 4 | 15 | 22 |
| SMARCA2 | 1 | 21 | 9 | 61 | 18 |
| SMARCA4 | 2 | 19 | 12 | 49 | 13 |
| SMARCB1 | 10 | 12 | 9 | 33 | 69 |
| SMARCC1 | 9 | 27 | 18 | 43 | 28 |
| SMARCC2 | 11 | 45 | 31 | 96 | 38 |
| SMARCD1 | 12 | 21 | 16 | 28 | 49 |
| SMARCD2 | 4 | 17 | 15 | 24 | 51 |
| SMARCE1 | 15 | 19 | 23 | 58 | 71 |
| DPF2 | 1 | 0 | 0 | 0 | 0 |
| SS18 | 0 | 4 | 2 | 4 | 0 |
| SS18L1 | 0 | 0 | 0 | 1 | 0 |
| SMARCD3 | 0 | 10 | 4 | 16 | 30 |

TABLE 6R

Gradient/mass-spectrometry results in WT HEK-293T cells with HA-PBRM1 as a bait

| Subunit | Gradient Fraction 2-3 | 5-6 | 7-8 | 9-10 | 13-14 | 16-17 |
|---|---|---|---|---|---|---|
| ACTB | 88 | 60 | 28 | 24 | 15 | 16 |
| ACTL6A | 5 | 8 | 5 | 11 | 16 | 40 |
| ARID2 | 1 | 12 | 9 | 15 | 36 | 112 |
| BCL7A | 7 | 3 | 1 | 3 | 4 | 0 |
| BCL7C | 4 | 2 | 0 | 1 | 1 | 2 |
| BRD7 | 2 | 4 | 2 | 5 | 9 | 59 |
| PBRM1 | 78 | 219 | 85 | 90 | 99 | 302 |
| PHF10 | 3 | 1 | 0 | 0 | 7 | 20 |
| SMARCB1 | 2 | 6 | 4 | 5 | 10 | 44 |
| SMARCC1 | 2 | 12 | 7 | 16 | 39 | 127 |
| SMARCE1 | 3 | 5 | 5 | 6 | 15 | 73 |
| BCL7B | 1 | 0 | 0 | 0 | 0 | 0 |
| SMARCA2 | 0 | 4 | 4 | 4 | 9 | 56 |
| SMARCA4 | 0 | 5 | 4 | 5 | 9 | 41 |
| SMARCD2 | 0 | 3 | 1 | 4 | 11 | 31 |
| SMARCD3 | 0 | 1 | 0 | 2 | 4 | 13 |
| SMARCC2 | 0 | 9 | 5 | 8 | 20 | 83 |
| SMARCD1 | 0 | 5 | 3 | 8 | 16 | 43 |
| ARID1A | 0 | 0 | 0 | 1 | 0 | 0 |
| DPF2 | 0 | 0 | 0 | 1 | 1 | 0 |

TABLE 6S

Gradient/mass-spectrometry results in WT HEK-293T cells with HA-GLTSCR1L as a bait

| Subunit | Gradient Fraction 7-8 | 10-11 | 14-15 |
|---|---|---|---|
| ACTB | 47 | 126 | 44 |
| ACTL6A | 49 | 167 | 95 |
| BCL7A | 17 | 96 | 55 |
| BCL7C | 9 | 42 | 15 |
| BRD9 | 31 | 279 | 94 |
| GLTSCR1L | 497 | 436 | 249 |
| SMARCA2 | 30 | 157 | 29 |
| SMARCA4 | 18 | 102 | 19 |
| SMARCB1 | 1 | 2 | 9 |
| SMARCC1 | 361 | 474 | 155 |
| SMARCC2 | 6 | 9 | 4 |
| SMARCD1 | 335 | 442 | 183 |
| SMARCD3 | 2 | 2 | 2 |
| SS18 | 4 | 5 | 6 |
| SS18L1 | 1 | 3 | 1 |
| BCL7B | 0 | 3 | 0 |
| SMARCE1 | 0 | 2 | 6 |
| ARID1B | 0 | 0 | 5 |
| DPF2 | 0 | 0 | 6 |
| SMARCD2 | 0 | 0 | 6 |
| ARID1A | 0 | 0 | 10 |

TABLE 6T

| Gradient/mass-spectrometry results in WT HEK-293T cells with HA-BRD9 as a bait | Gradient Fraction | | | |
|---|---|---|---|---|
| | 5-6 | 7-8 | 10-11 | 14-15 |
| Subunit | | | | |
| ACTB | 13 | 7 | 4 | 7 |
| ACTL6A | 20 | 22 | 26 | 5 |
| BCL7A | 2 | 0 | 7 | 0 |
| BRD9 | 172 | 18 | 16 | 5 |
| GLTSCR1 | 27 | 20 | 56 | 10 |
| GLTSCR1L | 6 | 5 | 9 | 0 |
| SMARCA4 | 6 | 5 | 15 | 1 |
| SMARCC1 | 14 | 14 | 36 | 4 |
| SMARCD1 | 20 | 8 | 20 | 3 |
| SS18 | 2 | 0 | 0 | 0 |
| SMARCA2 | 0 | 2 | 21 | 1 |
| BCL7C | 0 | 0 | 6 | 0 |

Figure 3A:
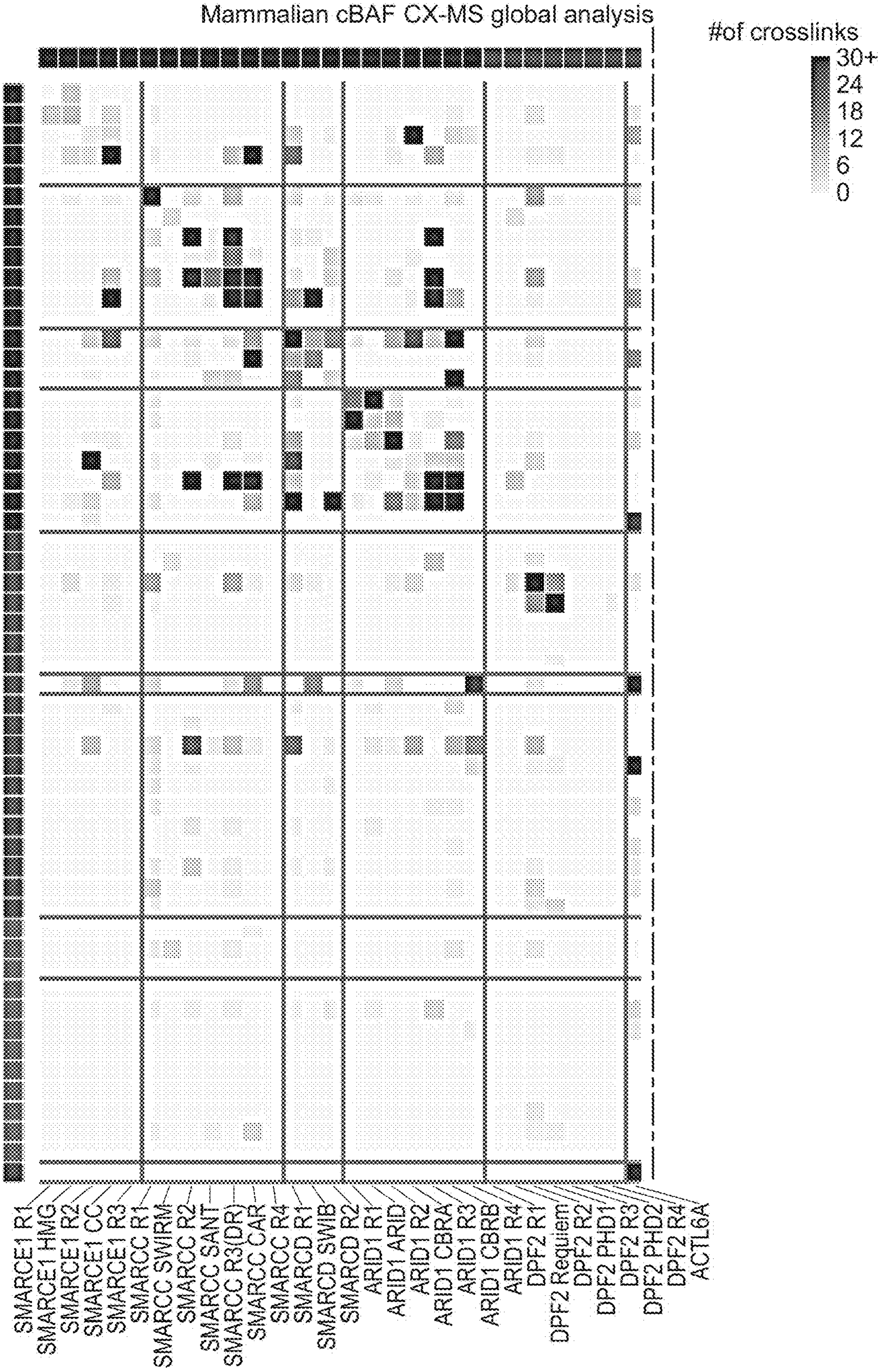
FIG. 3A-FIG. 3F show that cross-linking mass-spectrometry (CX-MS) of SWI/SNF complexes reveals conserved connectivity of interacting modules.
Figure 3A:
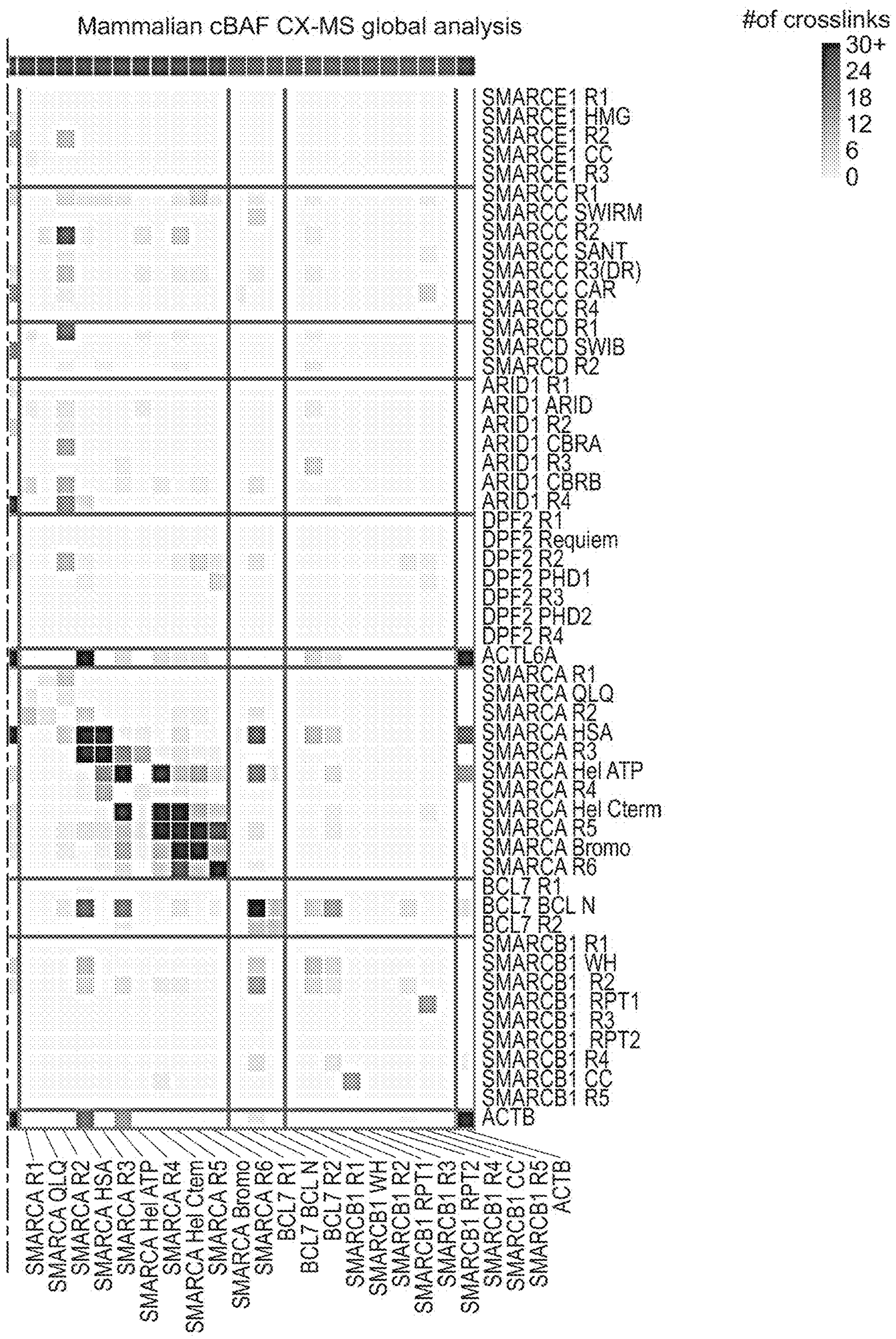
Figure 3B:
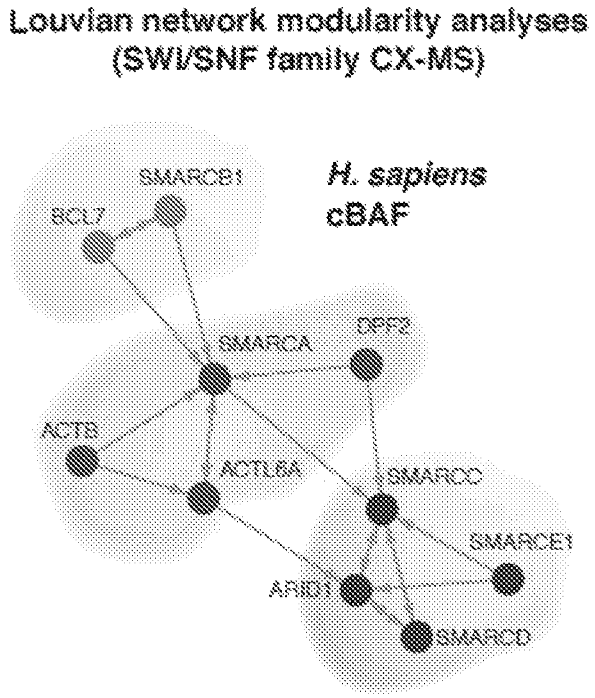
Figure 4C:
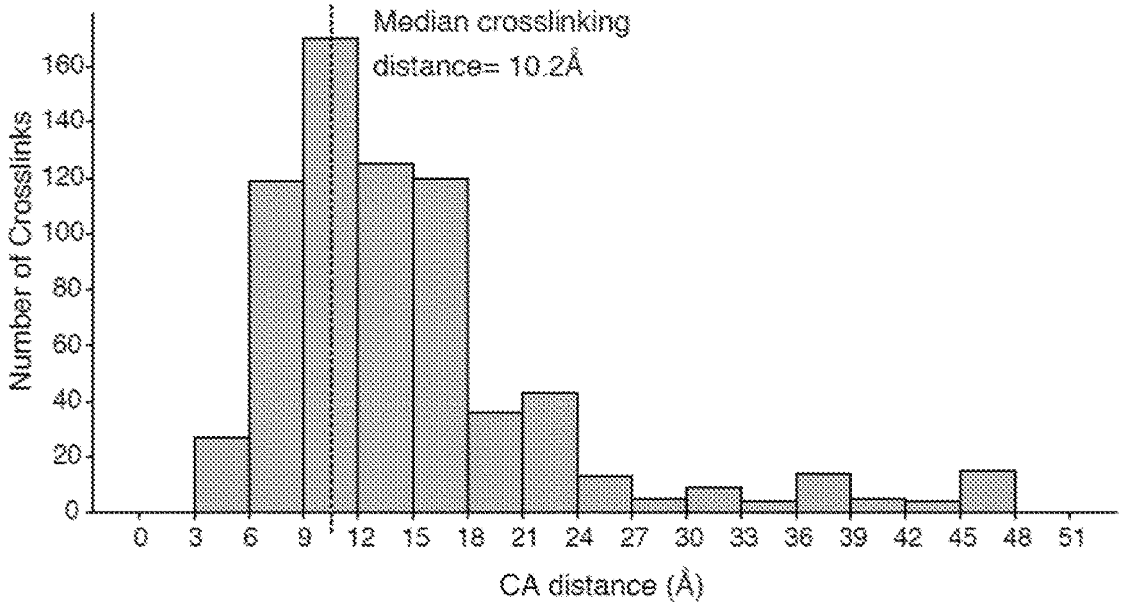
FIG. 4C shows the analysis of the distance between crosslinked residues in known structures of BAF complex subunit domains. Dashed line indicates the median distance calculated. Length of the BS3 crosslinker spacer is 11.4 Å.
Figure 4D:
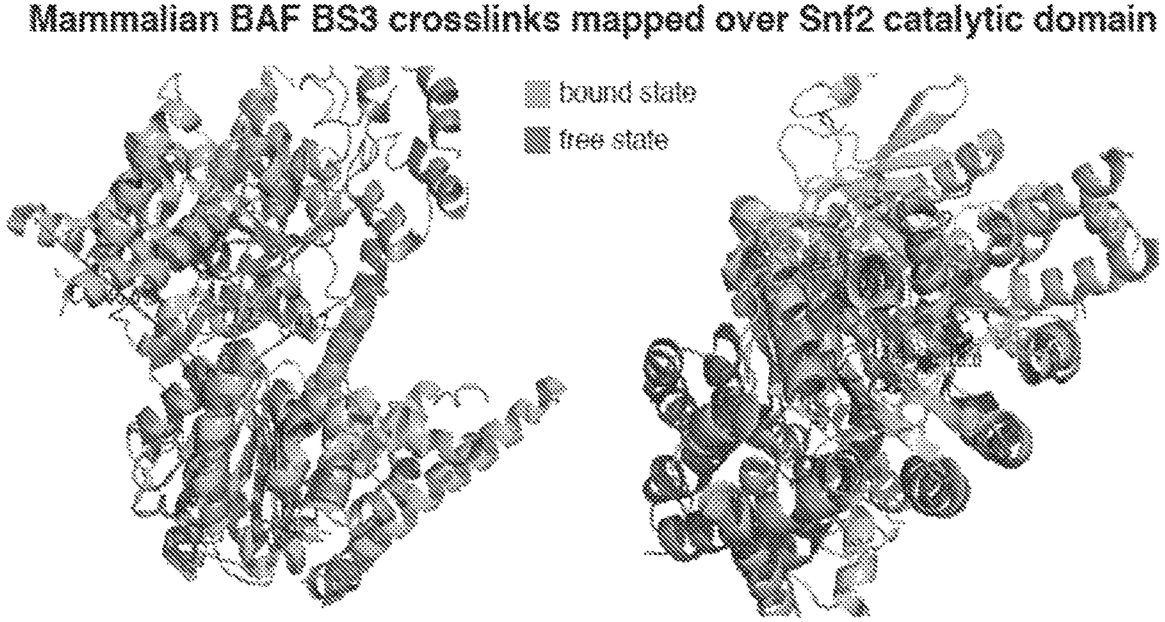
FIG. 4D shows the structures of the Snf2 ATPase domain in nucleosome-bound (blue) and nucleosome-free (green) states. Crosslinks in dynamic regions are colored in purple and orange. Crosslinks in constant regions are colored in yellow.

Example 3: Cross-linking Mass-spectrometry of Canonical BAF Complexes Globally Defines Modular Architecture Next performed was bis(sulfosuccinimidyl) suberate (BS3)-based cross-linking mass-spectrometry (CX-MS) using DPF2 and SS18 as baits to identify BAF subunit architecture and linkages. It was generated herein high-density subunit crosslinking maps containing 1,560 inter-protein crosslinks and 2,373 non-redundant intra protein crosslinks with coverage across all BAF complex subunits with the exception of SS18 (owing to limited lysine residues) (FIGS. 3A and 4A, Tables 7A-7D, and Star Methods). To comprehensively define regions of crosslinking between BAF complex subunits, each subunit family (collapsed, i.e., SMARCD=SMARCD1/2/3) was divided into regions based on existing domain annotation, conservation, and newly-defined domains stemming from this CX-MS work (FIGS. 2A and 4B). Median distance between crosslinked residues within domains of known structure was 10.2 Å, close to the expected 11.4-30 Å distance for the BS3 crosslinking agent (FIG. 4C and Table 8). In addition, C-alpha distances between crosslinked residues mapped on to the Snf2 helicase structure were within expected distances for the nucleosome-bound and free conformations (Liu et al. (2017) *Nature* 544:440-445; Xia et al. (2016) *Nat Struct Mol Biol* 23:722-729) (FIG. 4D).

Lengthy table referenced here

US12473334-20251118-T00001

Please refer to the end of the specification for access instructions.

Lengthy table referenced here

US12473334-20251118-T00002

Please refer to the end of the specification for access instructions.

Lengthy table referenced here

US12473334-20251118-T00003

Please refer to the end of the specification for access instructions.

Lengthy table referenced here

US12473334-20251118-T00004

Please refer to the end of the specification for access instructions.

Lengthy table referenced here

US12473334-20251118-T00005

Please refer to the end of the specification for access instructions.

Lengthy table referenced here

US12473334-20251118-T00006

Please refer to the end of the specification for access instructions.

Lengthy table referenced here

US12473334-20251118-T00007

Please refer to the end of the specification for access instructions.

Lengthy table referenced here

US12473334-20251118-T00008

Please refer to the end of the specification for access instructions.

Lengthy table referenced here

US12473334-20251118-T00009

Please refer to the end of the specification for access instructions.

Lengthy table referenced here

US12473334-20251118-T00010

Please refer to the end of the specification for access instructions.

Lengthy table referenced here

US12473334-20251118-T00011

Please refer to the end of the specification for access instructions.

Lengthy table referenced here

US12473334-20251118-T00012

Please refer to the end of the specification for access instructions.

Lengthy table referenced here

US12473334-20251118-T00013

Please refer to the end of the specification for access instructions.

Figure 4E:
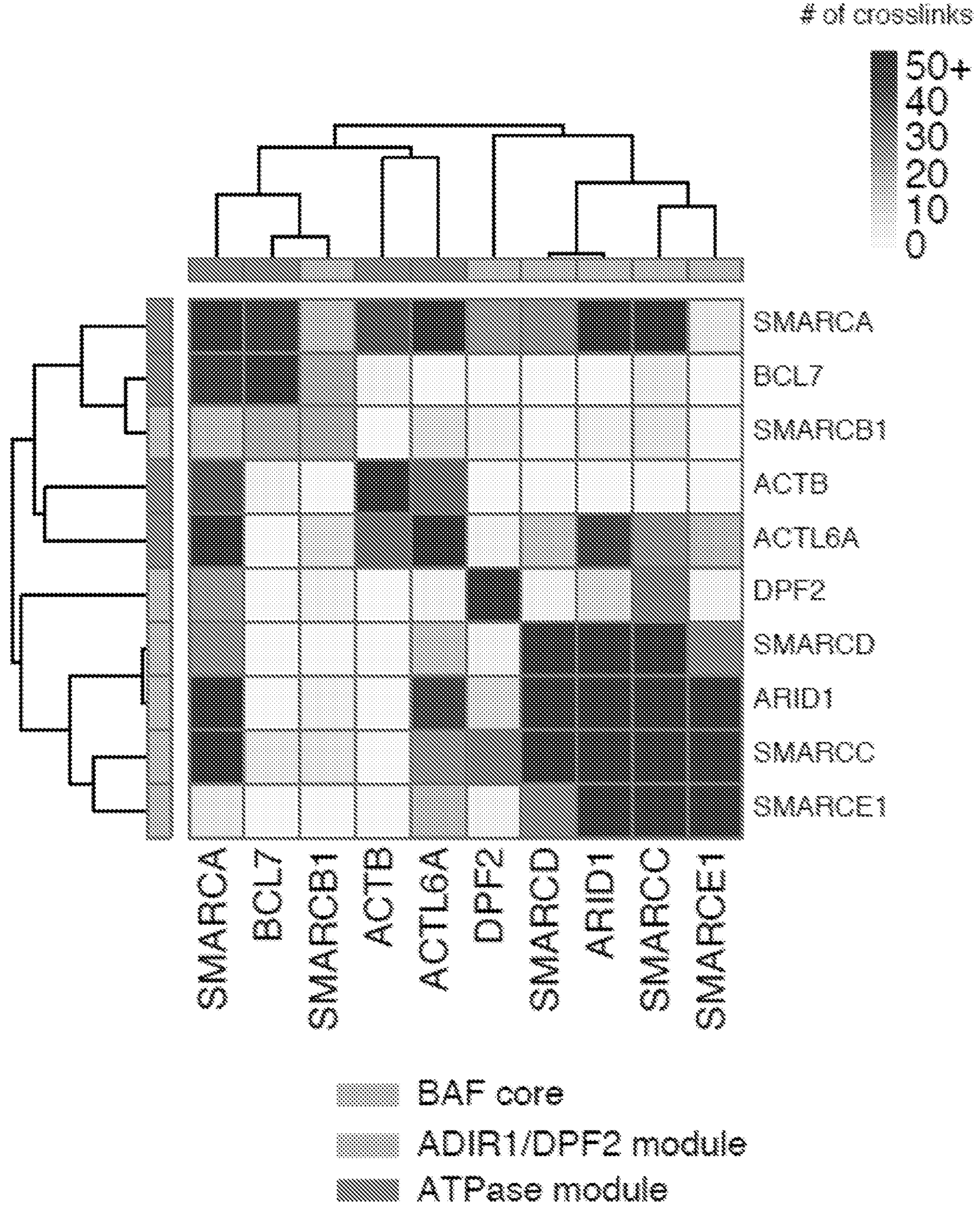
FIG. 4E shows the clustered distribution of the total crosslinks from mammalian BAF complex CX-MS. Clustering indicates similarly strong correlations between SMARCC, SMARCD, and SMARCE subunits with ARID1, which bridges this module to the ATPases and their associated subunits (See also FIG. 3B).

In order to elucidate potential crosslinking preferences between subunits, Louvian two-nearest-neighbor analysis was performed herein where nodes are subunits (or paralog families) and edges are drawn between the top two crosslinking partners for each subunit, based on the number of BAF crosslinks. This clustering revealed three distinct network modules: a catalytic module containing the SMARCA ATPase subunit, β-actin, and ACTL6A, an associated module containing SMARCB1 and BCL7, and a module containing SMARCC, SMARCD, SMARCE1 and ARID1 (FIG. 3B), recapitulating the inferred assembly of components. In addition, correlation analyses of total inter-subunit crosslinks for each subunit revealed similar results (FIG. 4E).

Figure 3C:
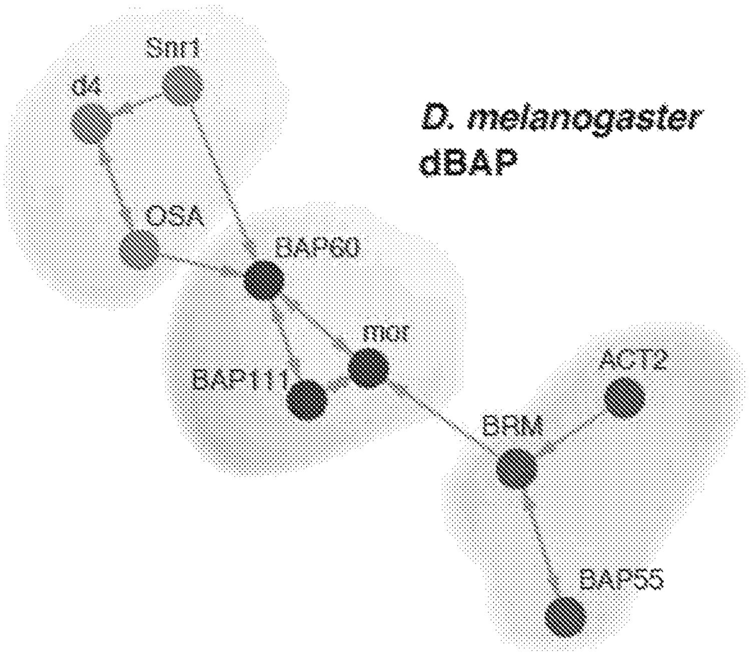
Figure 3D:
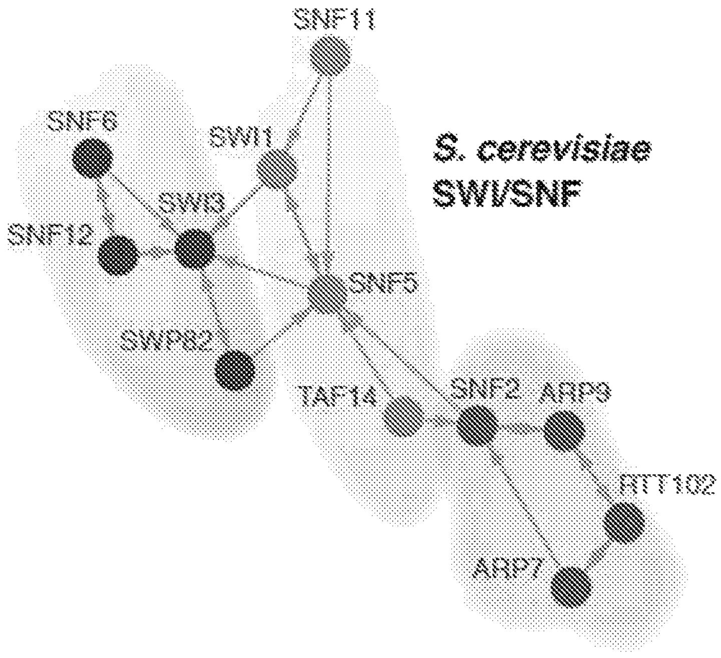
Figure 3E:
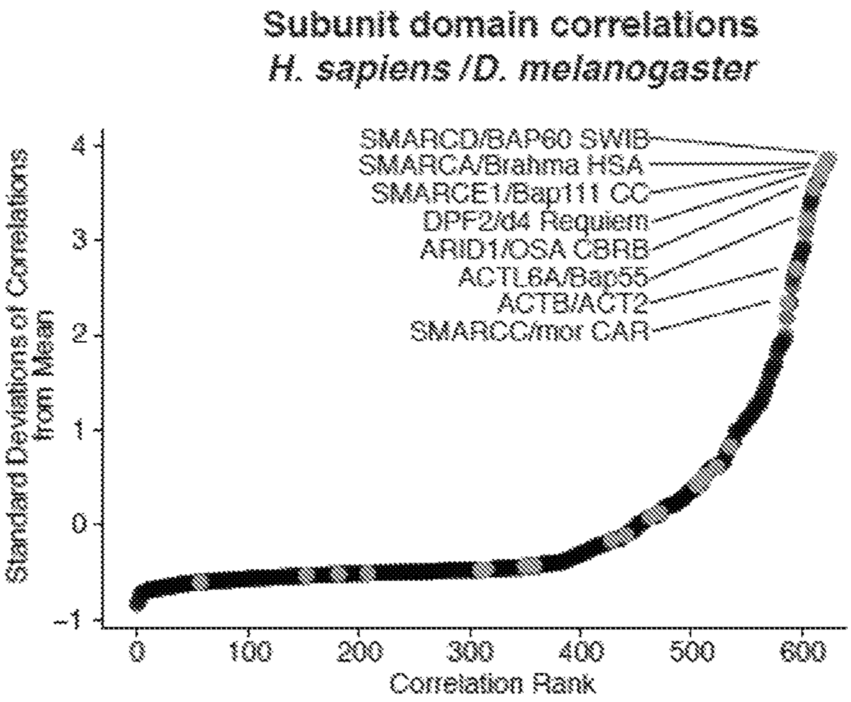
Figure 3F:
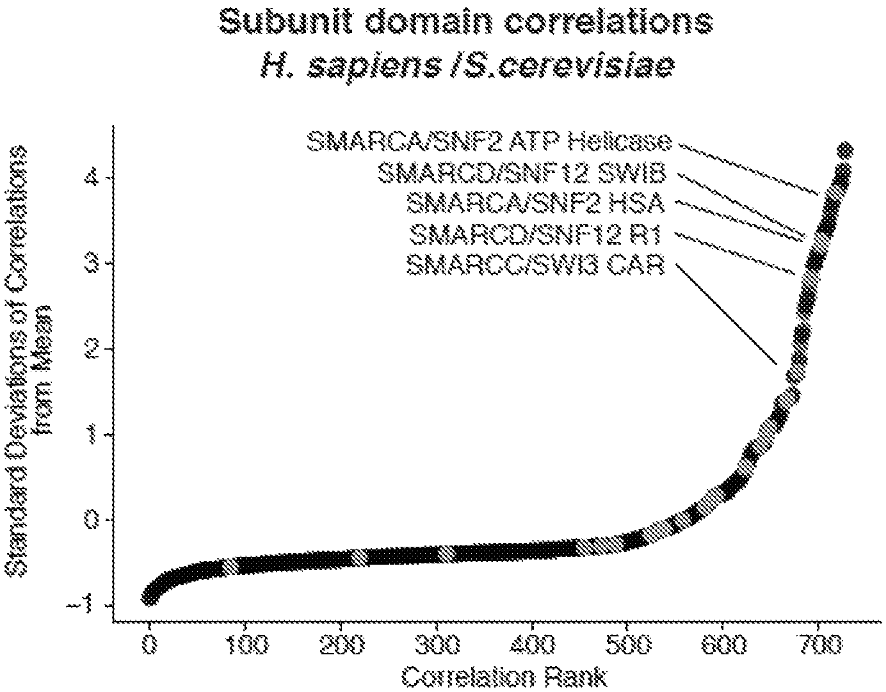
Figure 4F:
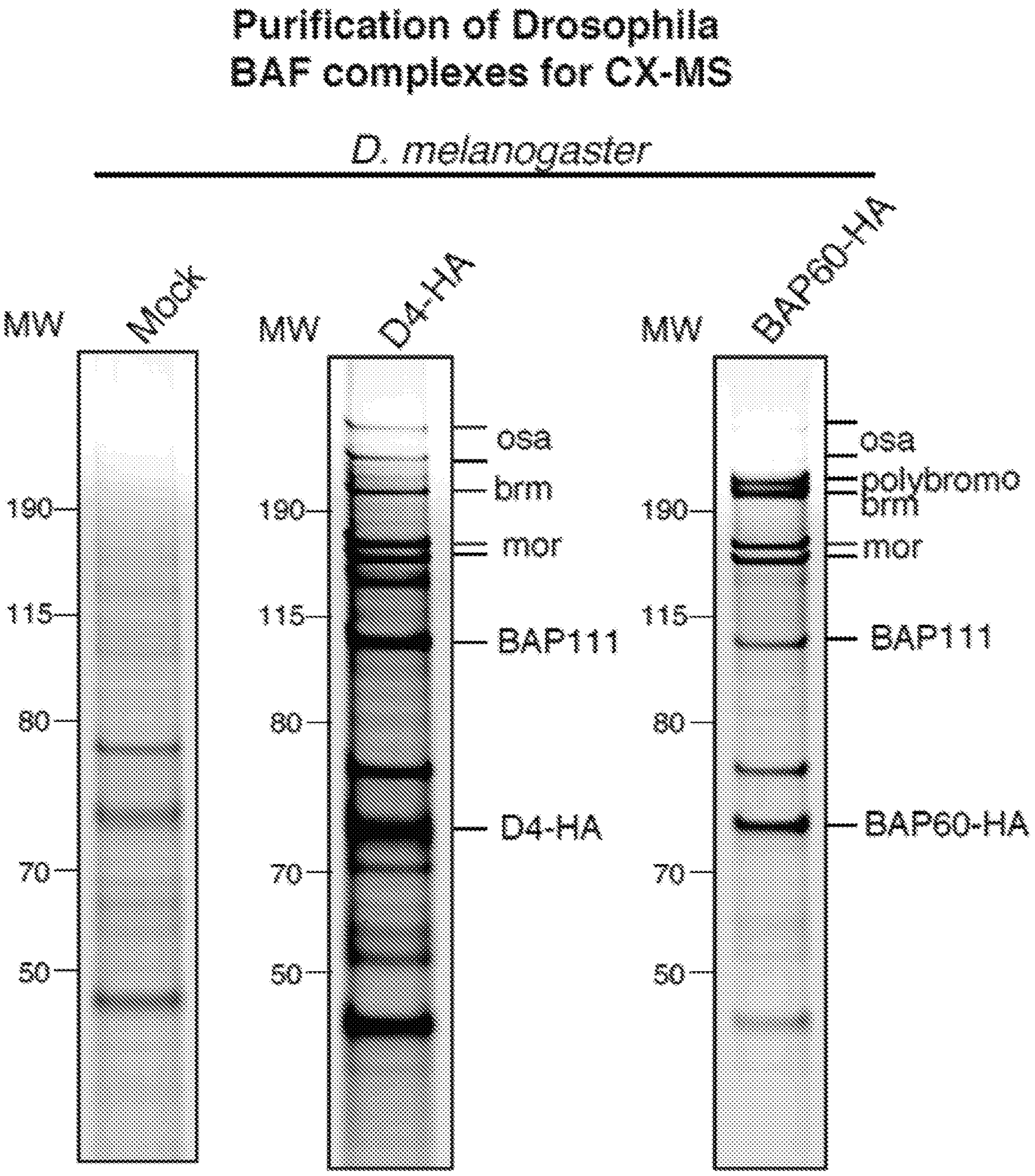
FIG. 4F shows the silver stains of affinity-purified complexes from *D. melanogaster* S2 cells expressing D4-HA, BAP60-HA or mock control.
Figure 4H:
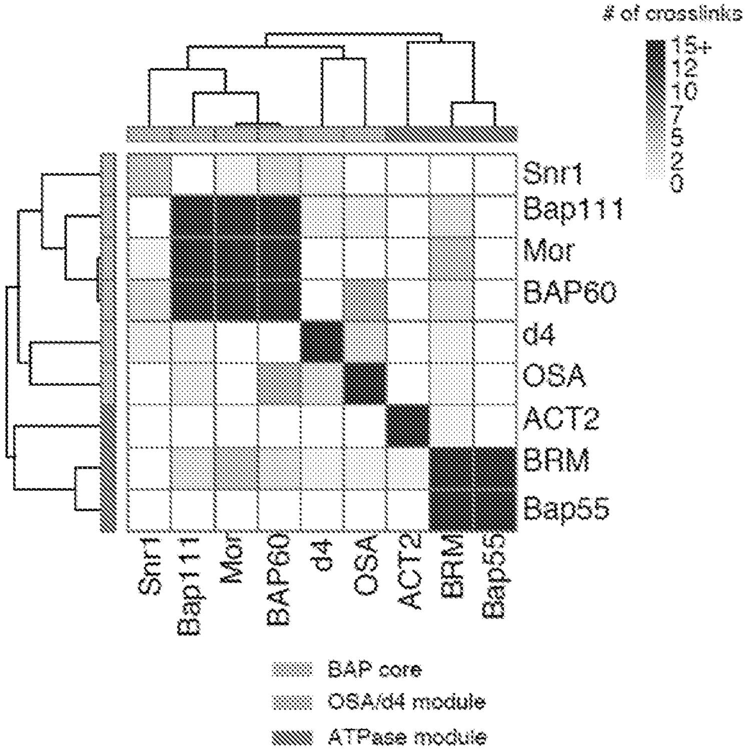
FIG. 4H shows the clustered distribution of the total crosslinks from CX-MS performed on *D. melanogaster* complexes.
Figure 4I:
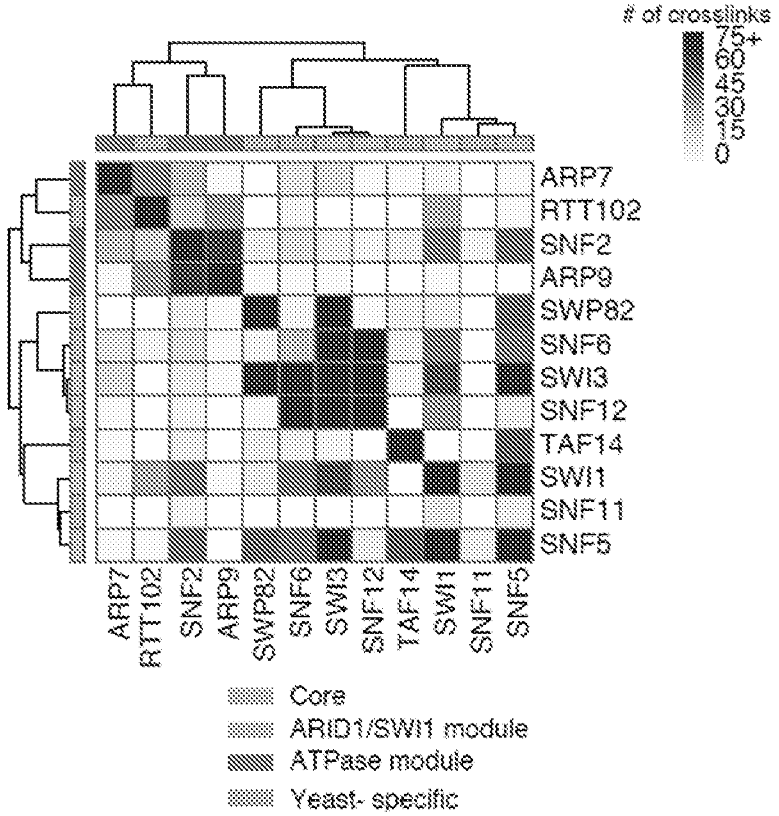
FIG. 4I shows the clustered distribution of the total crosslinks from CX-MS performed on *S. cerevisiae* complexes.
Figure 4J:
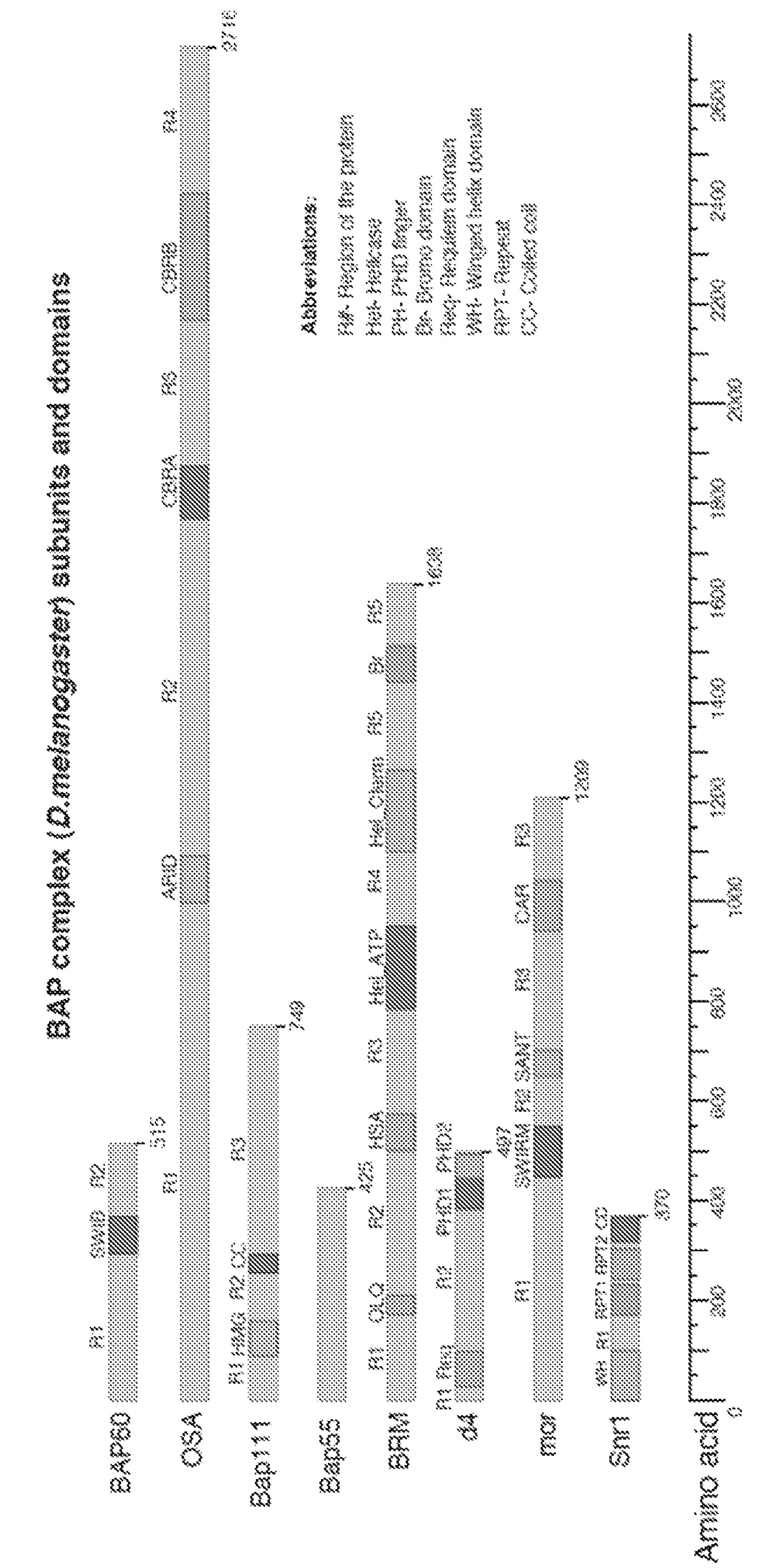
FIG. 4J shows the schematic representation of defined and newly-identified regions in *D. melanogaster* BAP subunits used in representing inter-subunit crosslinks.
Figure 4K:
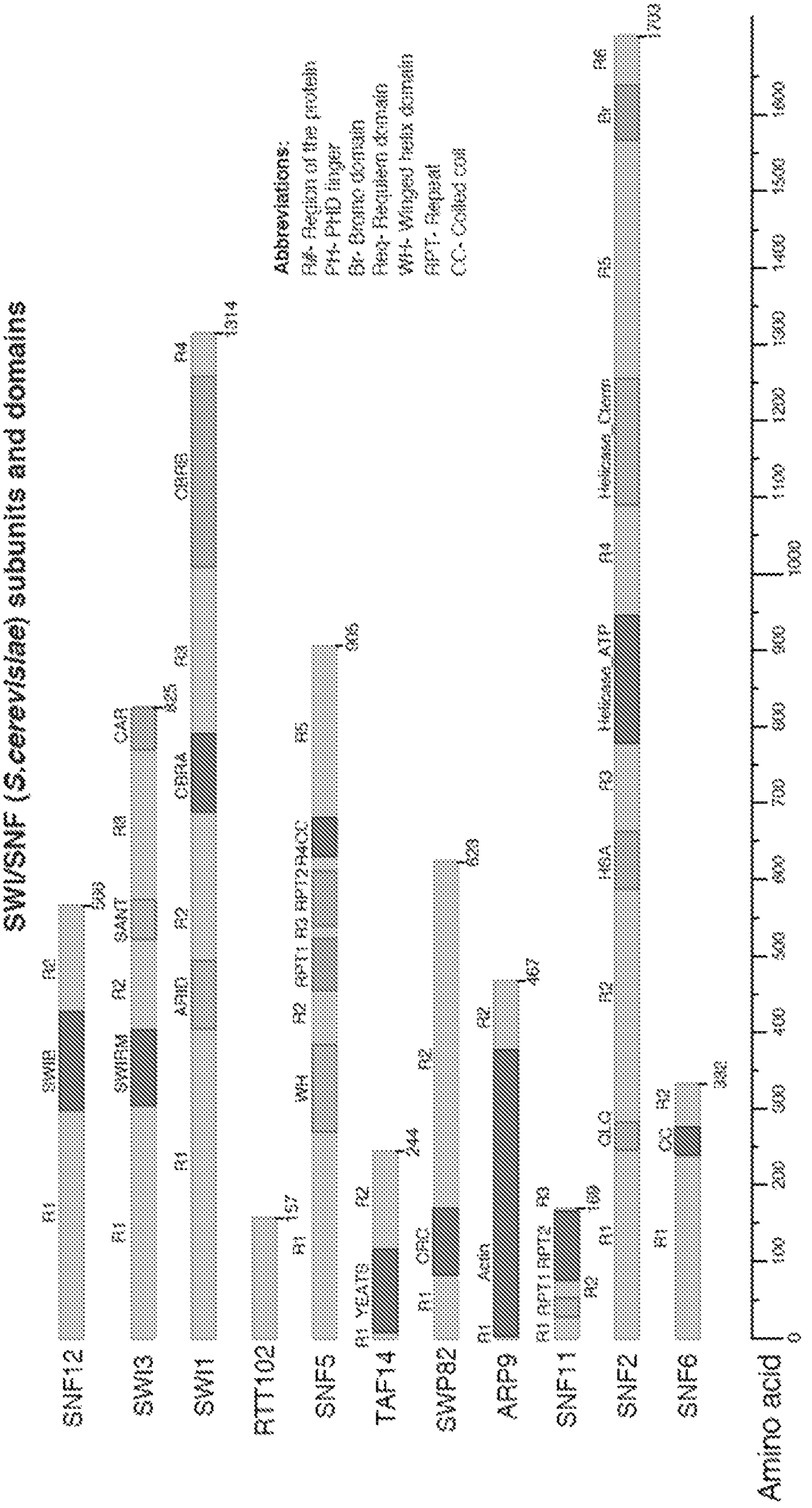
FIG. 4K shows the schematic representation of defined and newly-identified regions in *S. cerevisiae* SWI/SNF subunits used in representing inter-subunit crosslinks.
Figure 4L:
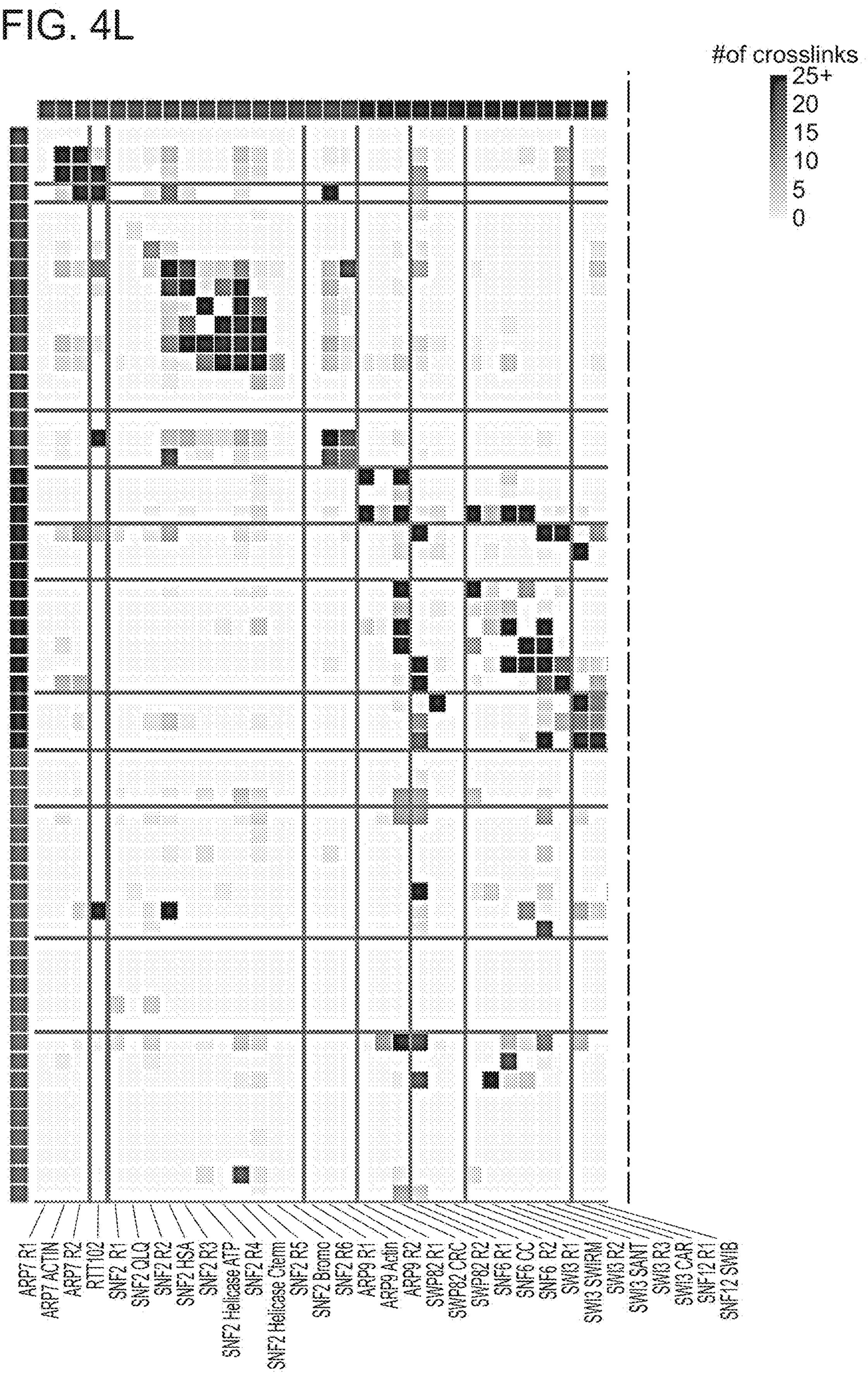
FIG. 4L shows the matrix heatmap of the total crosslinks from *S. cerevisiae* SWI/SNF complex CX-MS (Sen et al. (2017) *Cell Rep* 18:2135-2147). Individual subunits are divided into domains (per FIG. 4K) and ordered according to FIG. 3D.
Figure 4L:
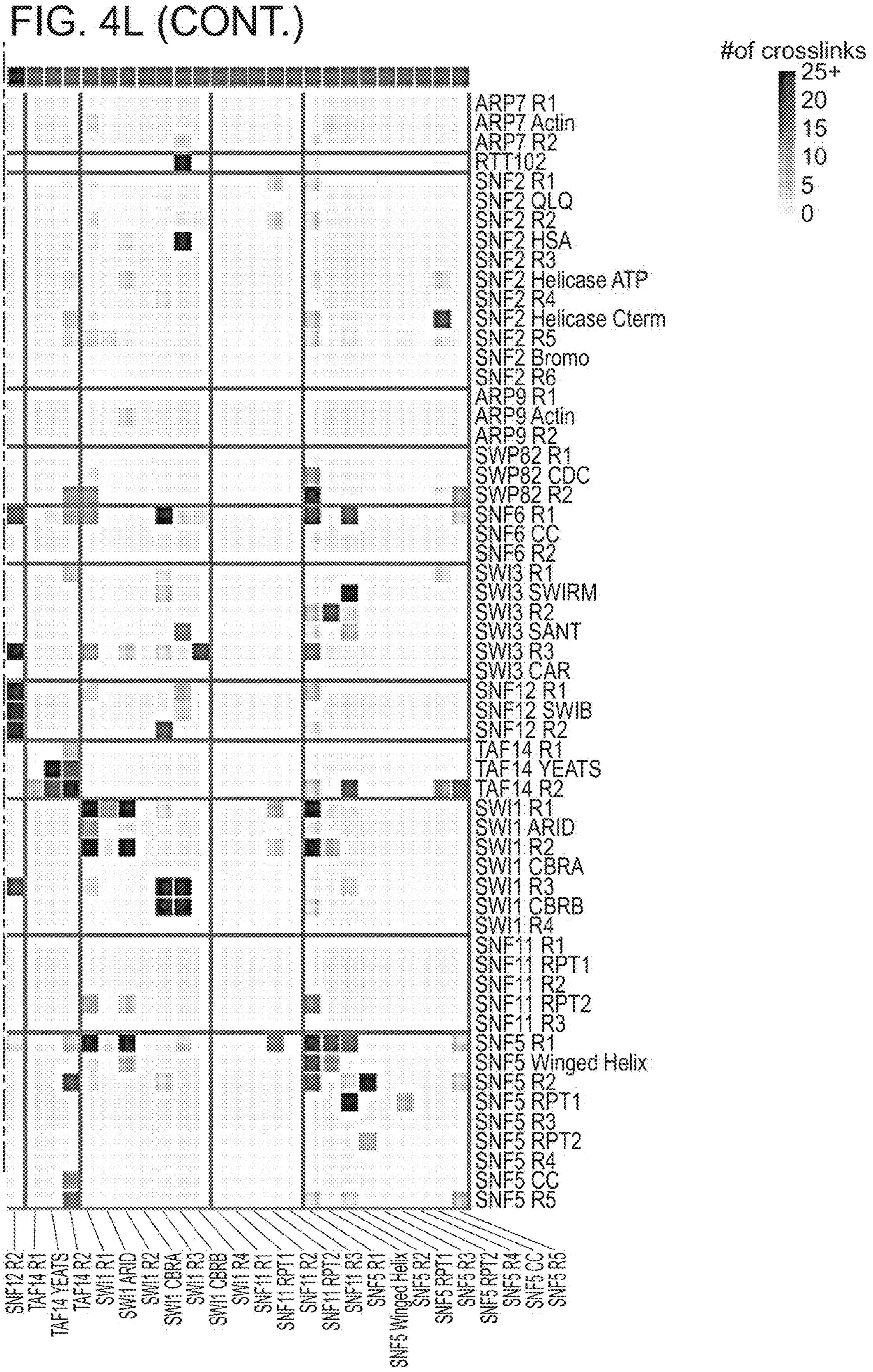
Figure 4M:
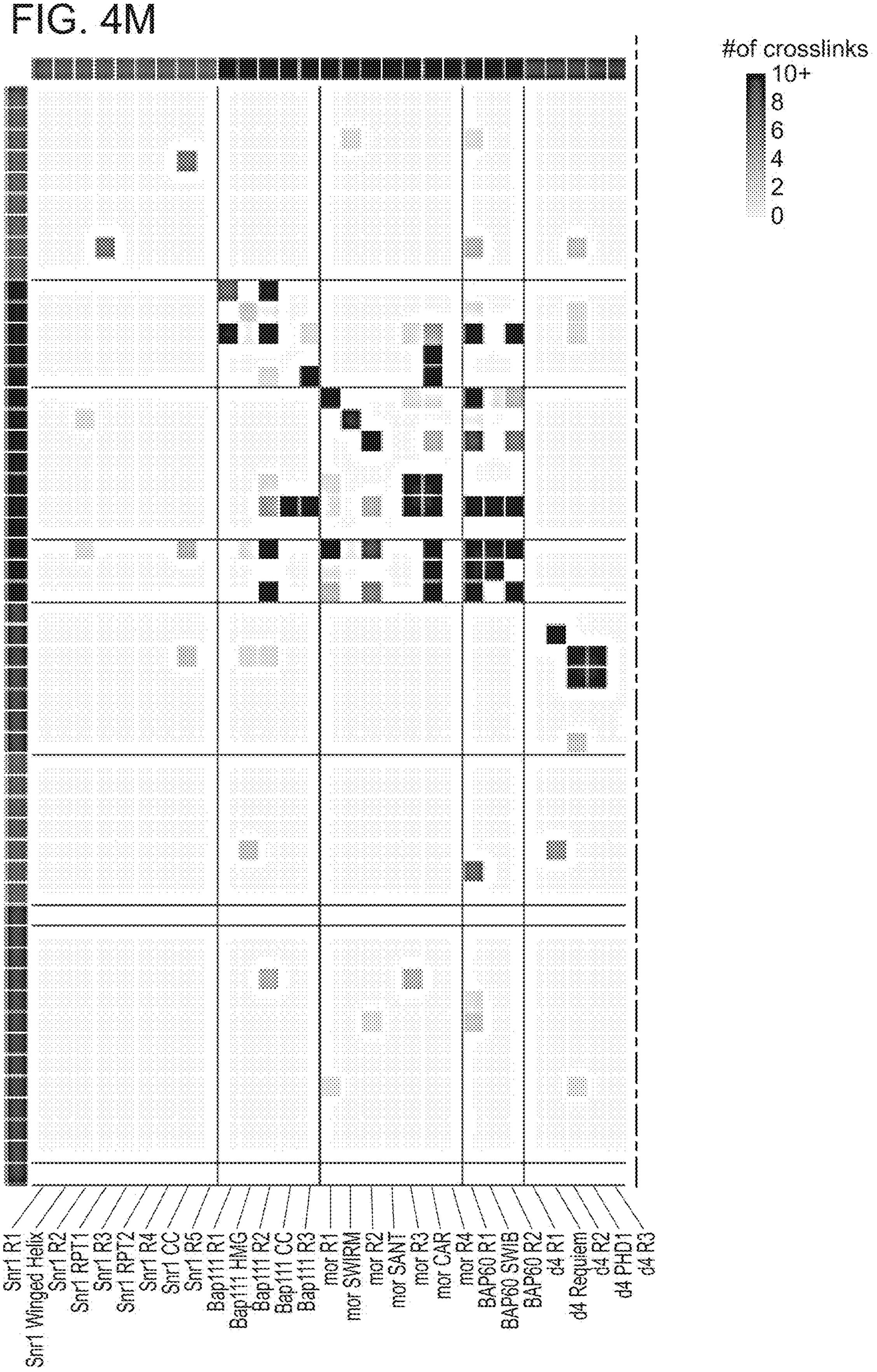
FIG. 4M shows the matrix heatmap of the total crosslinks from *D. melanogaster* BAP complex CX-MS performed as part of this study. Individual subunits are divided into domains (per FIG. 4K) and ordered according to FIG. 3C.
Figure 4M:
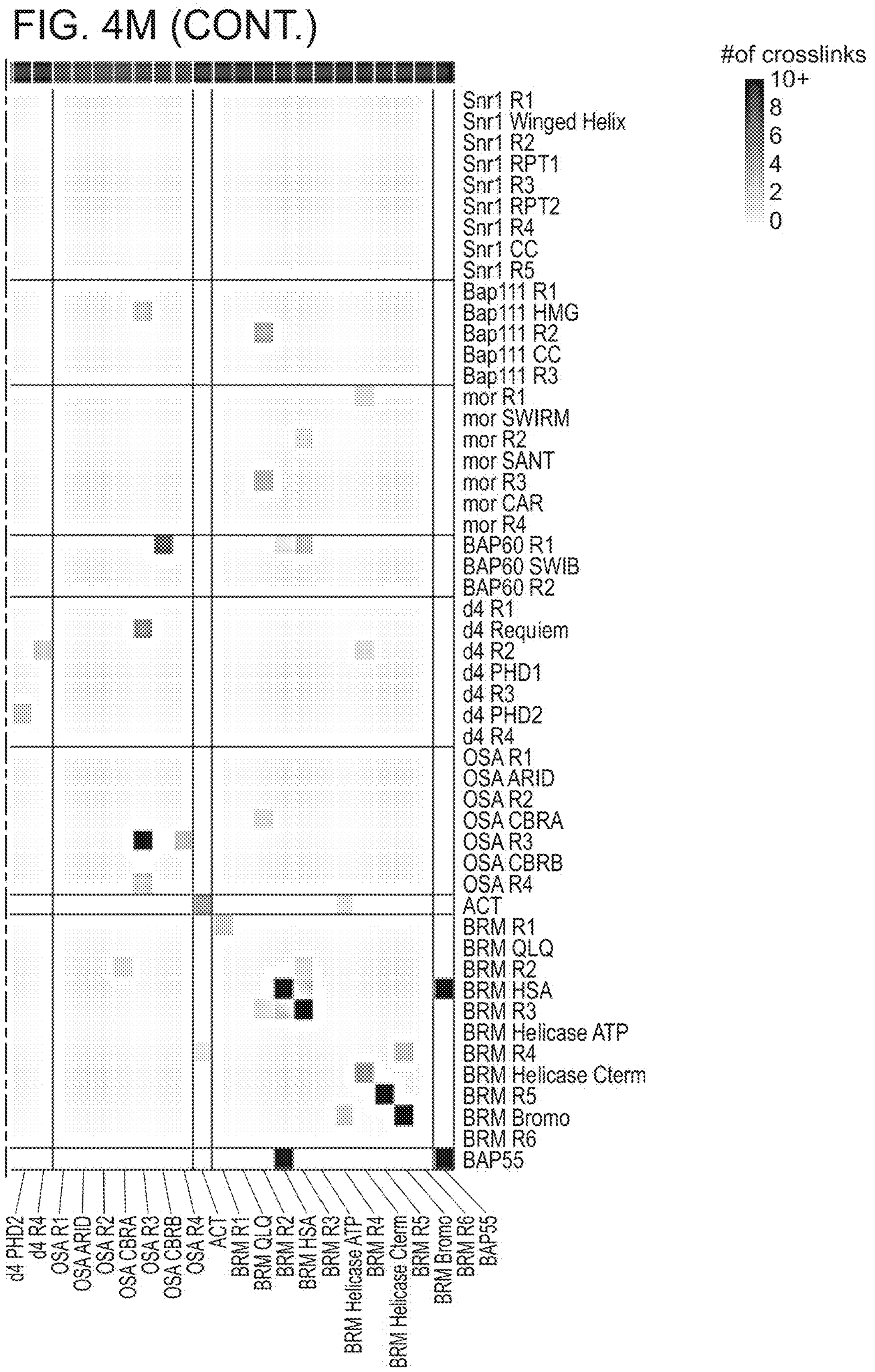
Figure 4N:
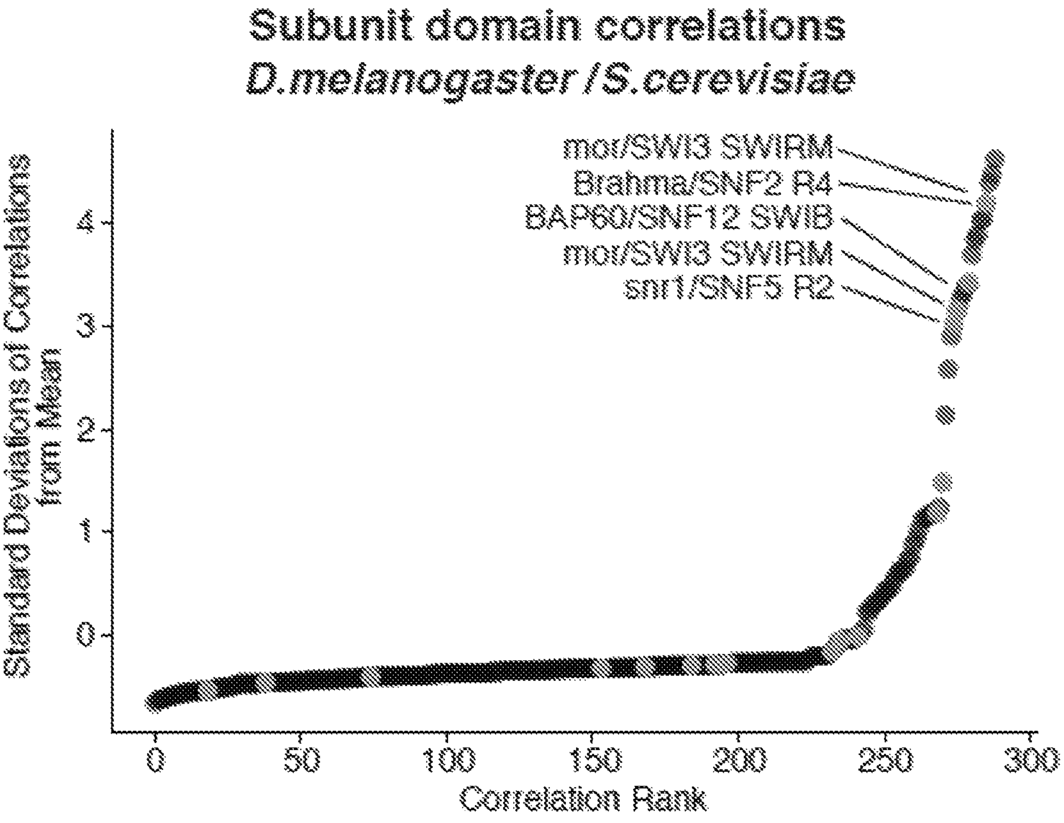

Arthropods represent a parallel evolutionary branch to metazoans that retain at least two classes of SWI/SNF complexes, namely BAP (BAF in mammals) and PBAP (PBAF in mammals). Hence, BAP complexes were isolated herein from *D. melanogaster* S2 cells using insect orthologs of DPF2 (D4) and SMARCD1 (BAP60) as baits and performed CX-MS (FIGS. 4F and 4G). Similar to mammalian complexes, the ATPase module clustered with BAP55 (ACTL6A ortholog) and ACT2 (β-actin ortholog), and the moira (mor) (SMARCC ortholog) formed a tight network with BAP60, BAP111 (SMARCE1 ortholog), and Osa (ARID1 ortholog), while Snr1 (SMARCB1 ortholog) and D4 separated as a distinct module (FIGS. 3C and 4H and Tables 9A-9D). These CX-MS results demonstrate conserved modularity for at least two complex modules: the BAF ATPase module and the ‘core module’ that forms around SMARCC/mor subunits. Finally, using a recently-published *S. cerevisiae* SWI/SNF CX-MS dataset (Sen et al. (2017) *Cell Rep* 18:2135-2147), it is found and presented herein similar clustering of the majority of both core and ATPase subunits, with the SNF2-centered ATPase module containing ARP7, ARP9 (potential orthologs of ACTL6A) and RTT102. SWI3 (SMARCC ortholog) and SNF12 (SMARCD ortholog) along with yeast-specific SNF6 and SWP82 form the core module, and SWI1 (ARID1 ortholog) and SNF5 (SMARCB1 ortholog) subunits cluster and bridge the core and ATPase modules (FIGS. 3D and 4I-4L). Using correlation analyses of crosslinks within individual subunit regions and domains across mammalian, fly and yeast complexes, it was discovered herein that the most highly conserved interactions were between regions of the BAF core, OSA/ARID1, and ATPase modules (FIGS. 2E, 2F, 4M, and 4N). Taken together, it is discovered herein that SWI/SNF complexes retain surprisingly specific modular organization across evolutionarily distant branches of life, indicating functional conservation of subunit architecture.

Figure 5A:
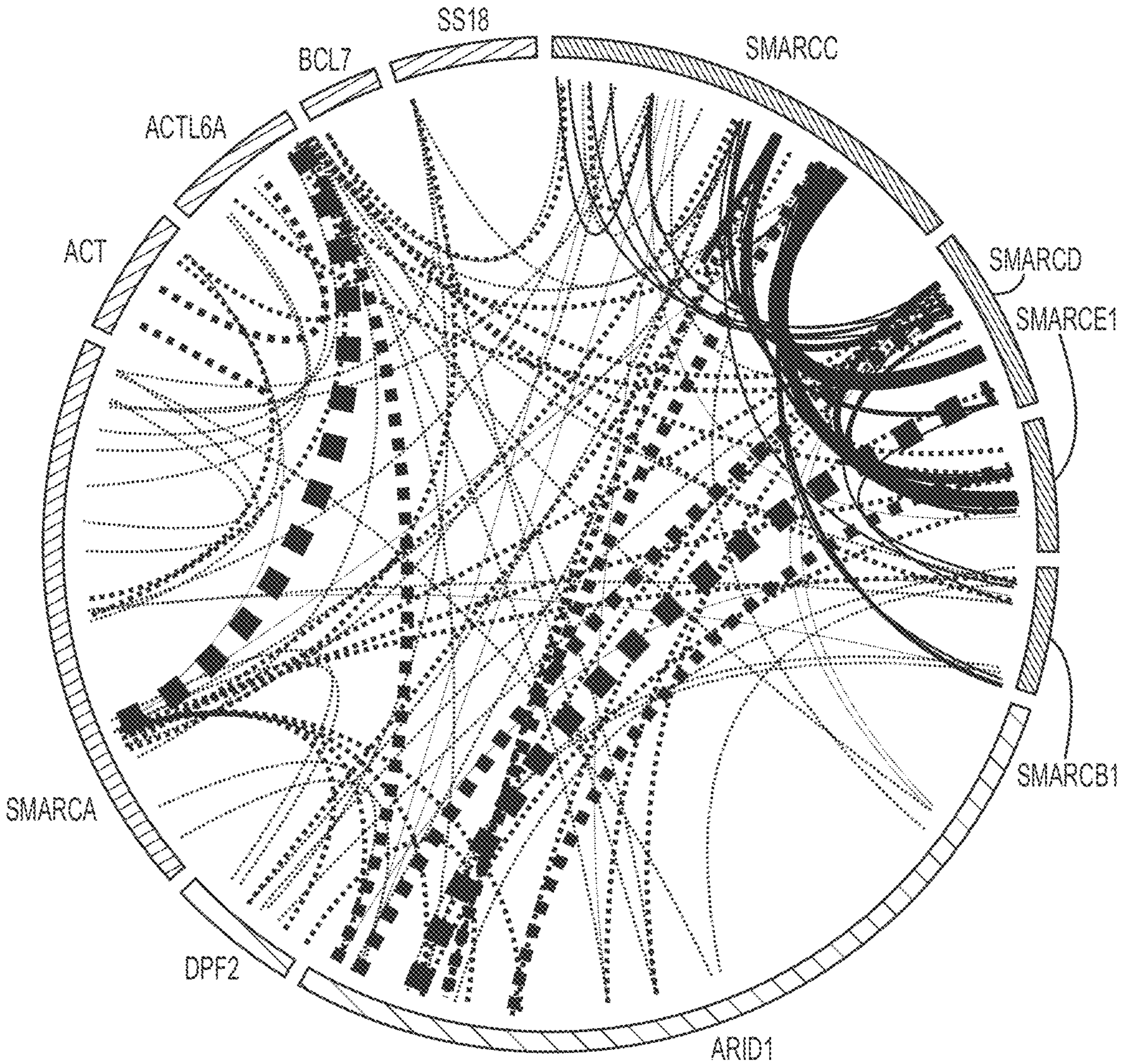
FIG. 5A-FIG. 5H show the identification and characterization of the BAF core module: SMARCC, SMARCD, SMARCB1, and SMARCE1 subunits.
Figure 5B:
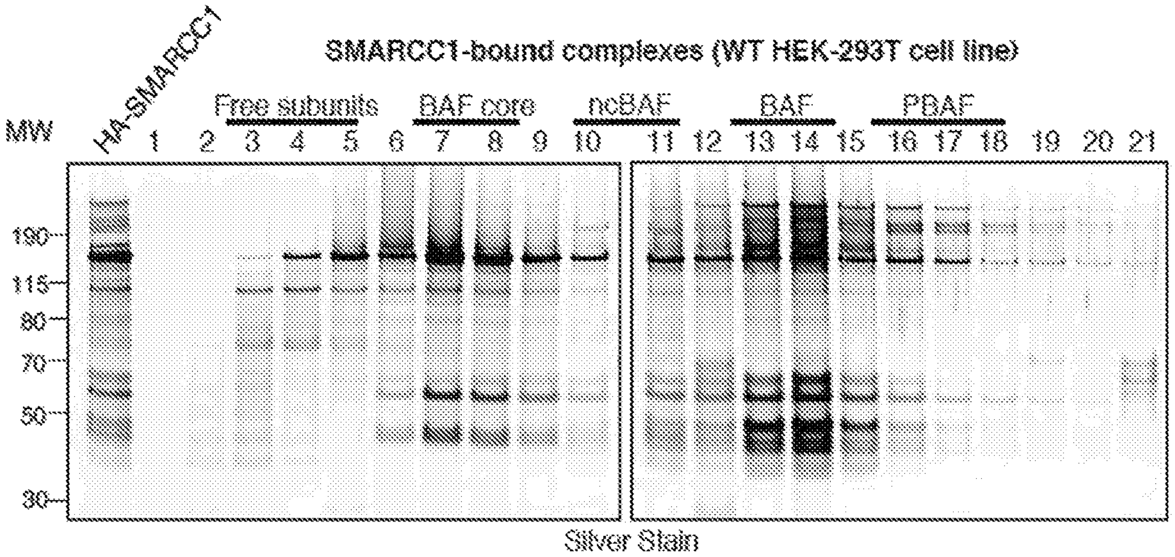
Figure 5B:
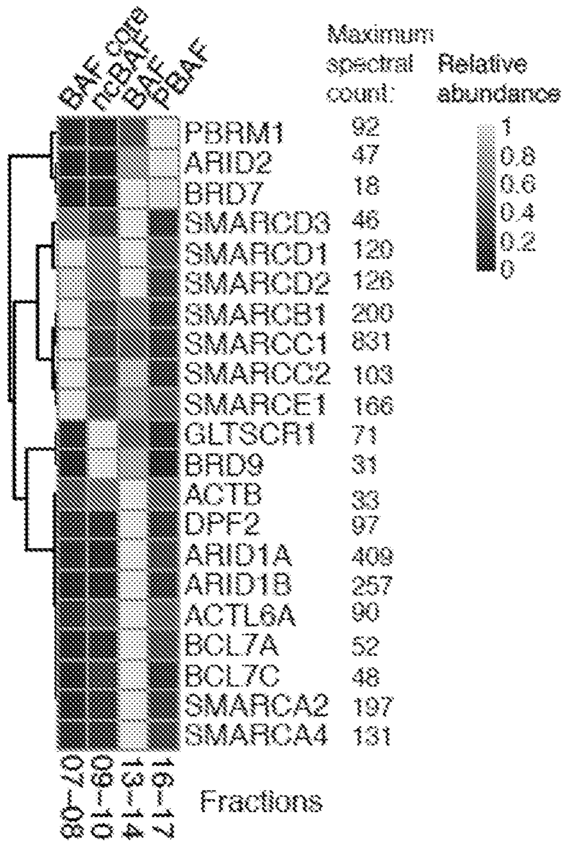
Figure 6A:
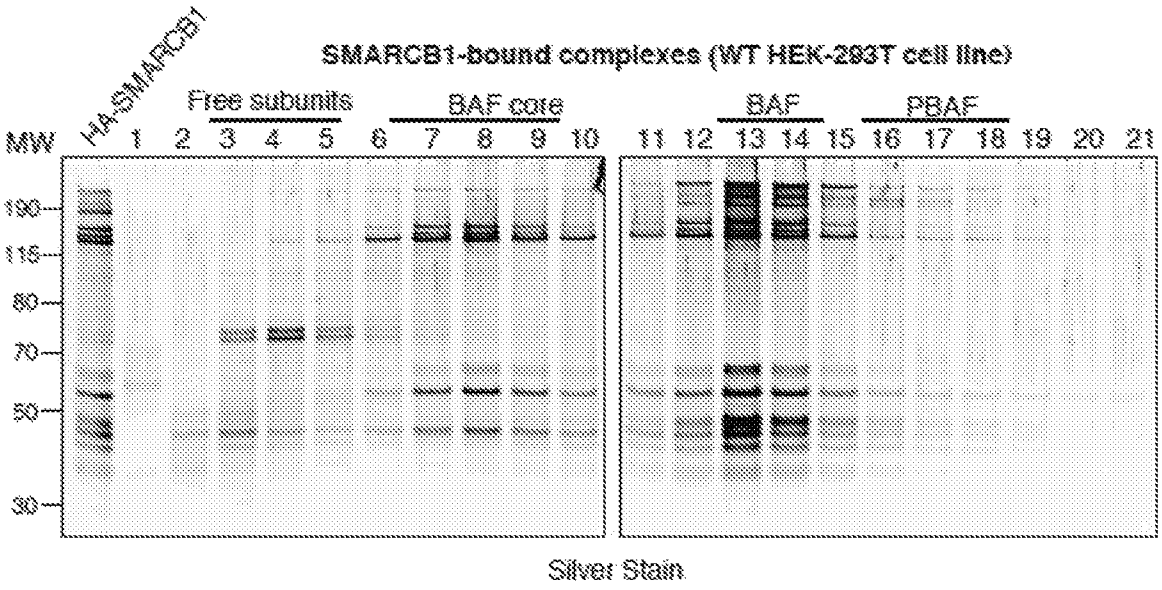
FIG. 6A-FIG. 6Q show the purification and mass-spectrometry analyses of the BAF core module.
Figure 6B:
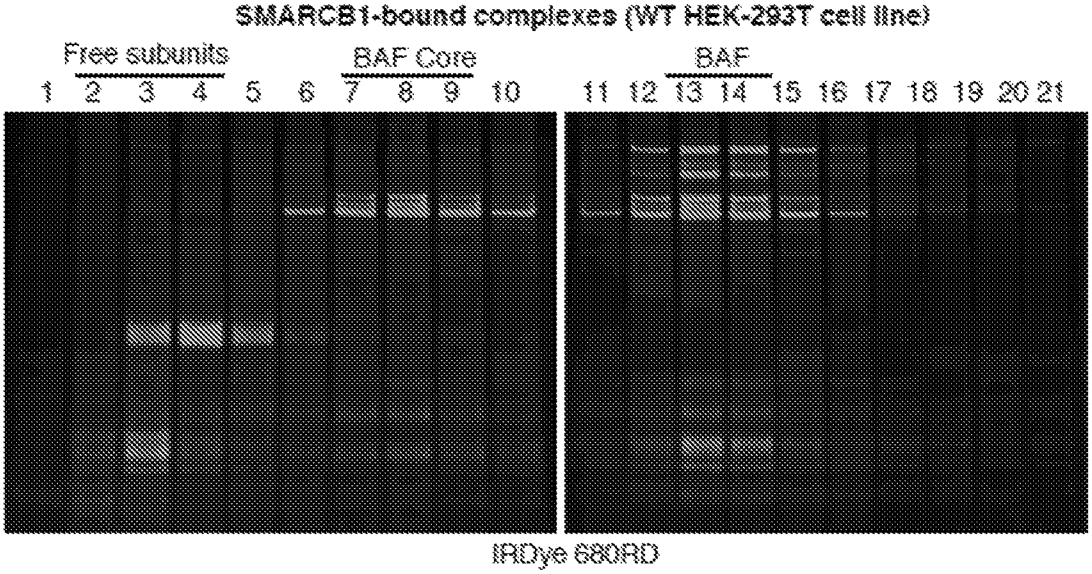
FIG. 6B shows the SDS-PAGE blot. Native HA-SMARCB1 BAF complexes were prepared as in FIG. 6A but each fraction was labeled using IRDye 680RD NHS ester.
Figure 6C:
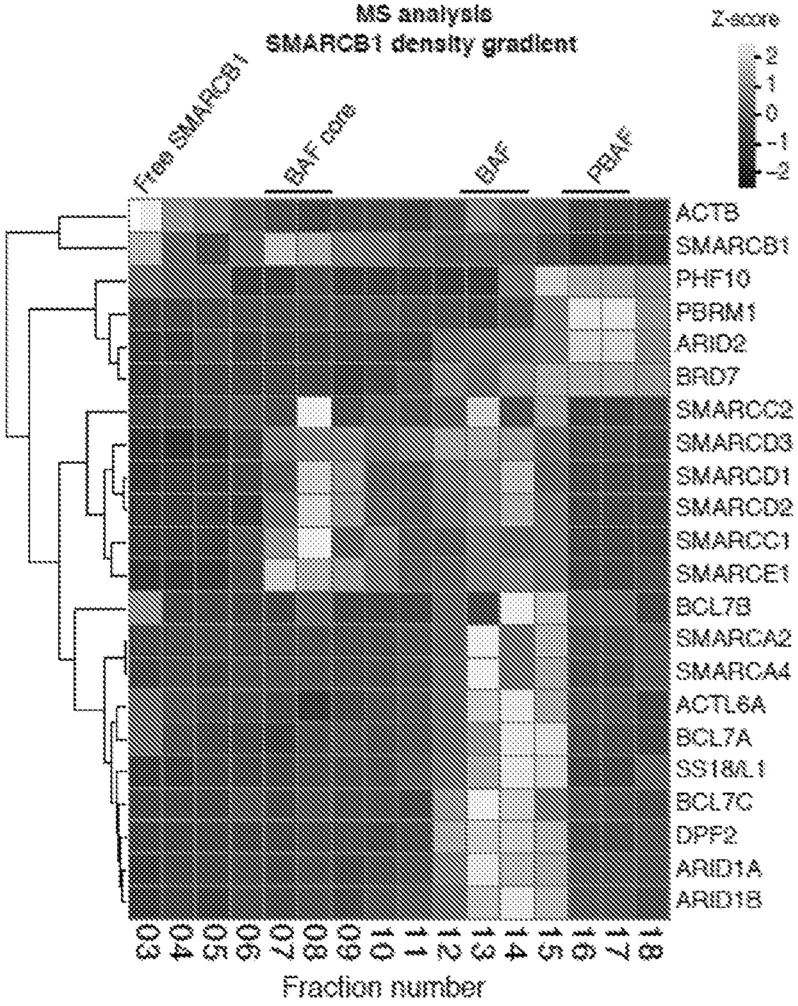
FIG. 6C shows the clustering heatmap of HA-SMARCB1 density gradient mass spec fractions displayed as Z-scores.
Figure 6D:
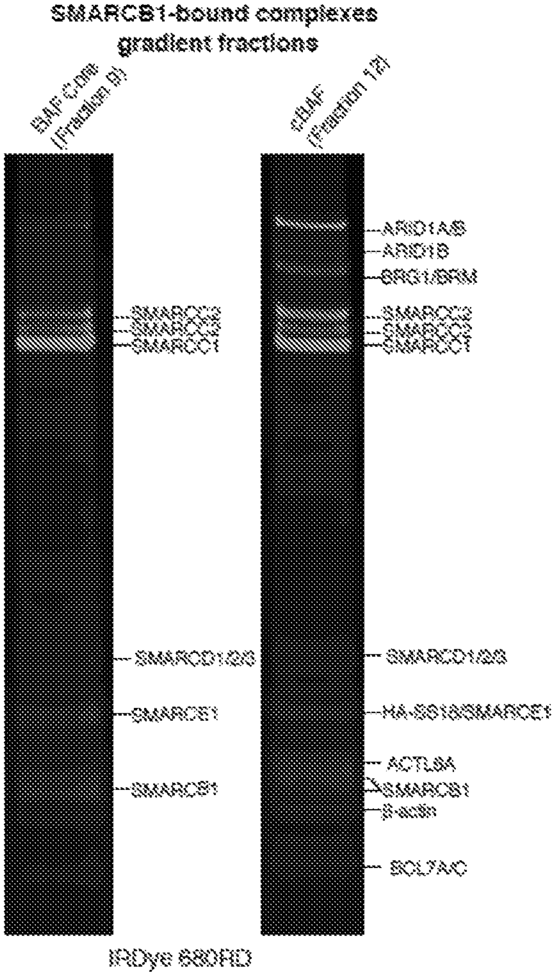
FIG. 6D shows the IRDye 680RD detection performed on Fractions 9 and 12 from FIG. 6A. Identified proteins are labeled.
Figure 6E:
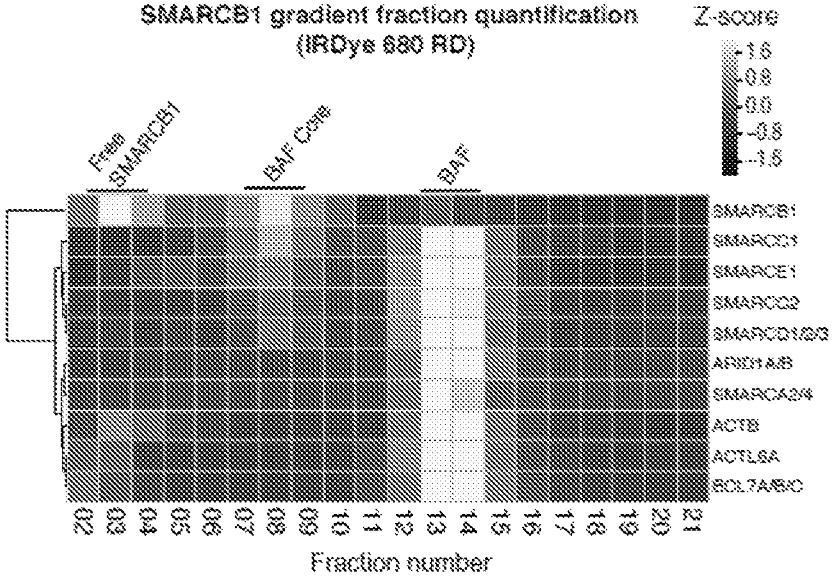
FIG. 6E shows the clustering heatmap of HA-SMARCB1 density gradient IRDye 680RD quantification displayed as a Z-score.
Figure 6F:
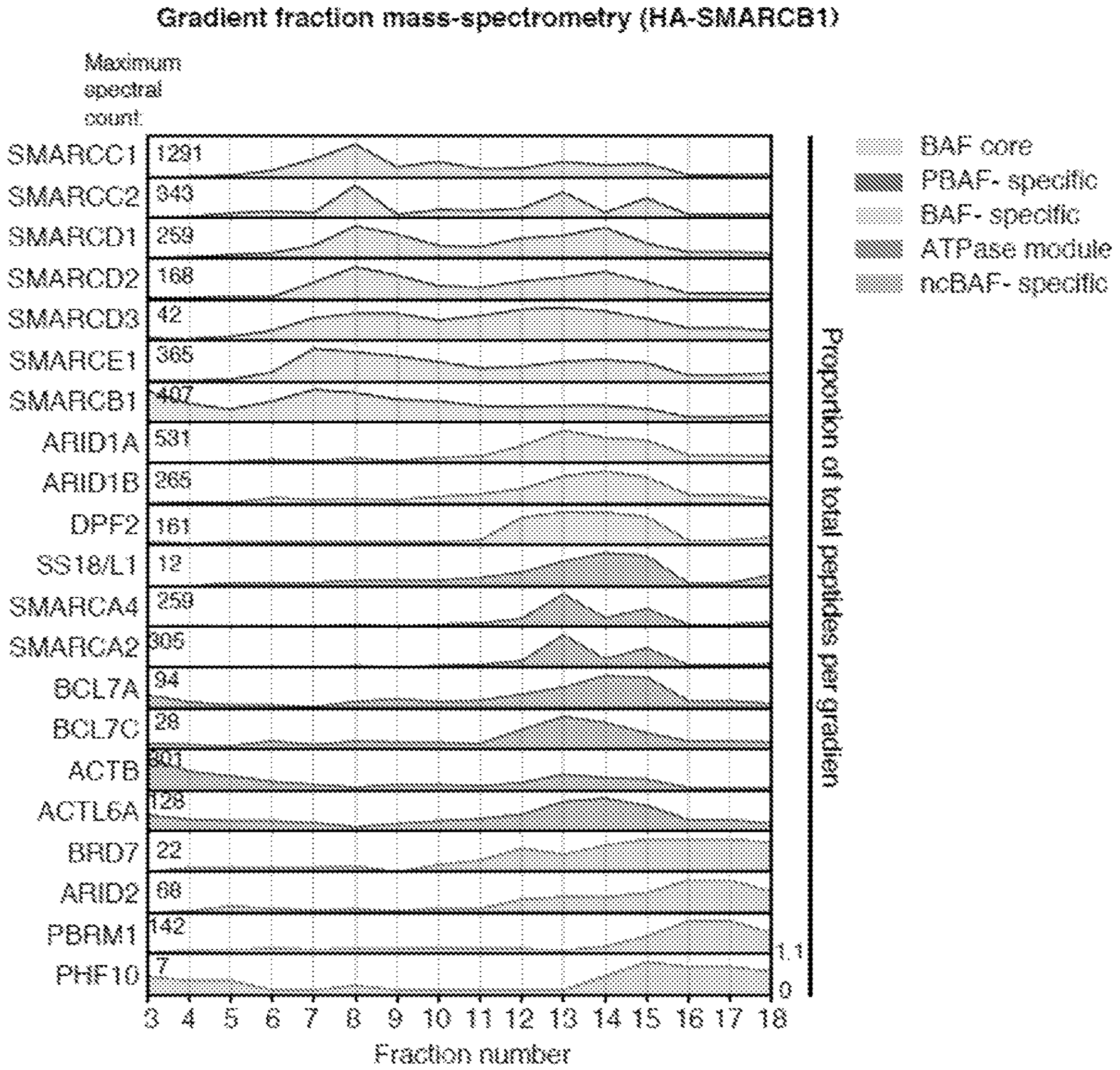
FIG. 6F shows the graphical representation of peptide relative abundance in each density gradient fraction identified by MS analysis. Total spectral counts for each subunit are indicated.
Figure 6G:
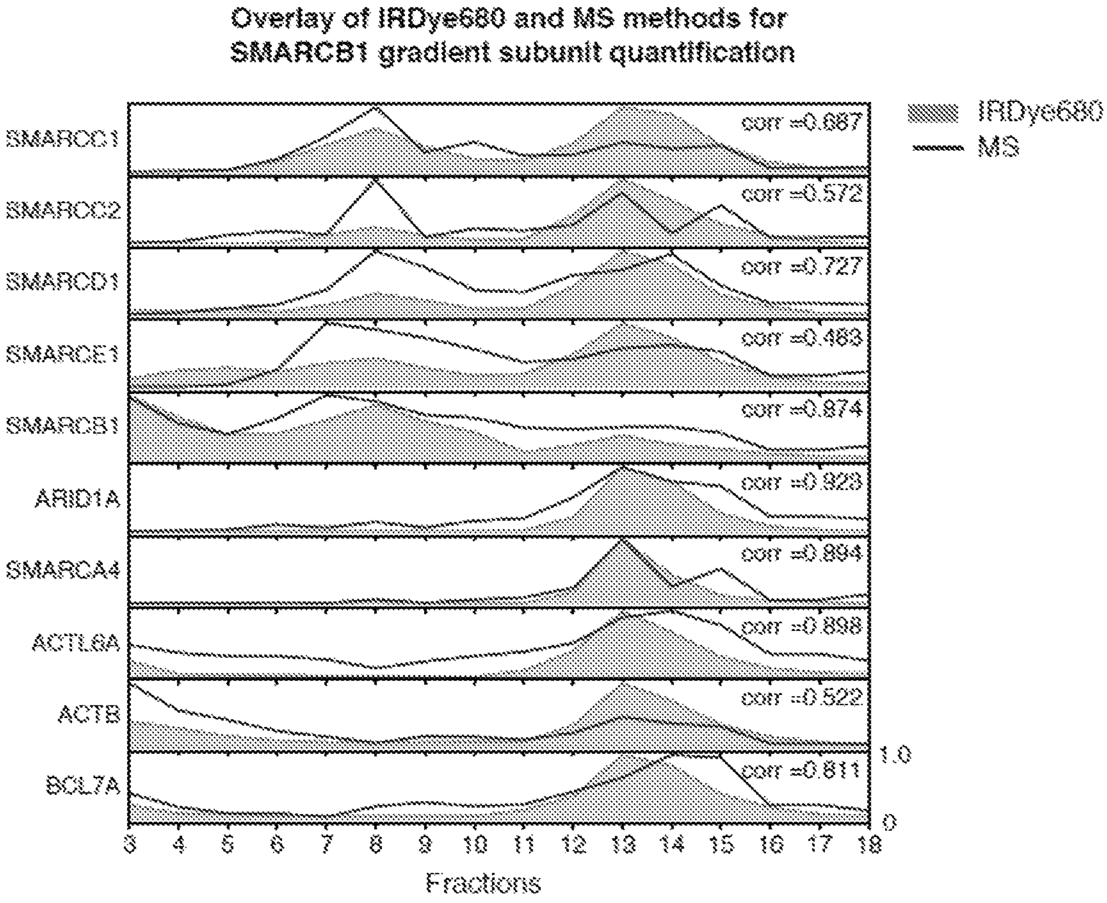
FIG. 6G shows the graphical representation of IRDye 680RD quantification and peptide relative abundance in each density gradient fraction from two independent biological replicates of data displayed in FIGS. 6A and 6B.
Figure 6H:
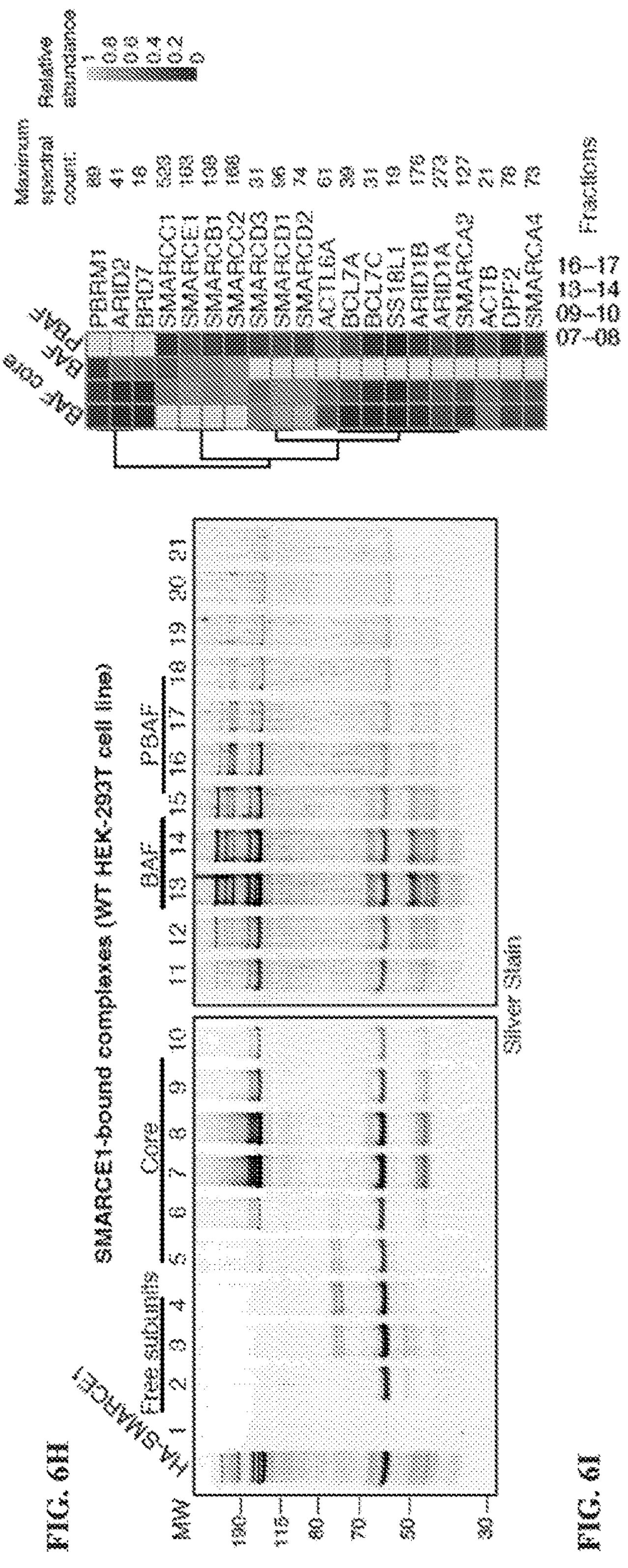
FIG. 6H shows the native HA-SMARCE1 BAF complexes purified from WT HEK-293T cells and subjected to glycerol gradient centrifugation; collected fractions were SDS-PAGE separated and silver stained (left). Clustering heatmap and spectral counts of HA-SMARCE1 density gradient mass spec fractions are shown (right).
Figure 6I:
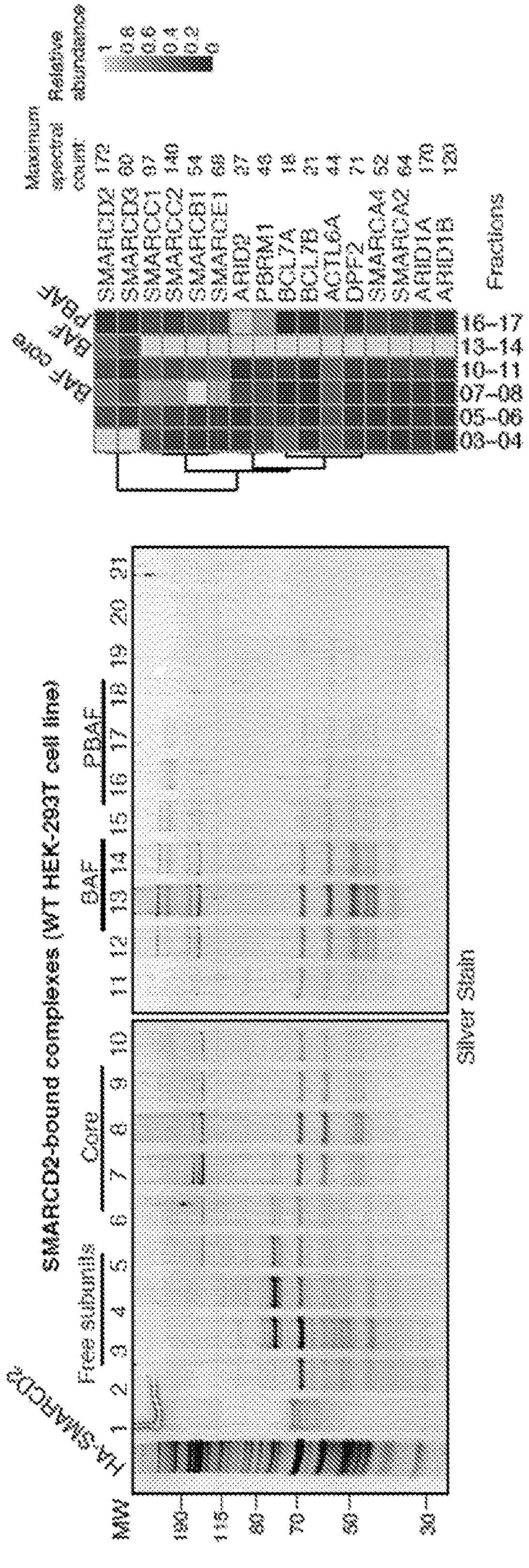
FIG. 6I shows the native HA-SMARCD2 BAF complexes purified from WT HEK-293T cells and subjected to glycerol gradient centrifugation; collected fractions were SDS-PAGE separated and silver stained (left). Clustering heatmap and spectral counts of HA-SMARCD2 density gradient mass spec fractions are shown (right).

Example 4: Characterization of the BAF Core Module Components and Their Assembly Complex purifications (FIGS. 1B and 1D) coupled with these CX-MS analyses demonstrated the presence of an early subcomplex containing SMARCD and SMARCC followed by SMARCEL and SMARCB1 subunits (FIG. 5A). Indeed, SMARCC1 purifications showed enrichment of the same subcomplex module (FIG. 5B and Table 6C). Similar results were obtained from SMARCB1, SMARCEL and SMARCD2 purifications (FIGS. 6A-6I and Tables 6D-6F) using both MS and fluorometric approaches, and demonstrated SMARCB1 association with the BAF core module of cBAF and PBAF (FIGS. 6C-6E). Of note, ncBAF-specific BRD9 and GLTSCR1/1L components were completely absent in these three purifications, further demonstrating that these subunits mark complexes of unique composition and lack several ubiquitously expressed, highly conserved subunits.

Figure 5C:
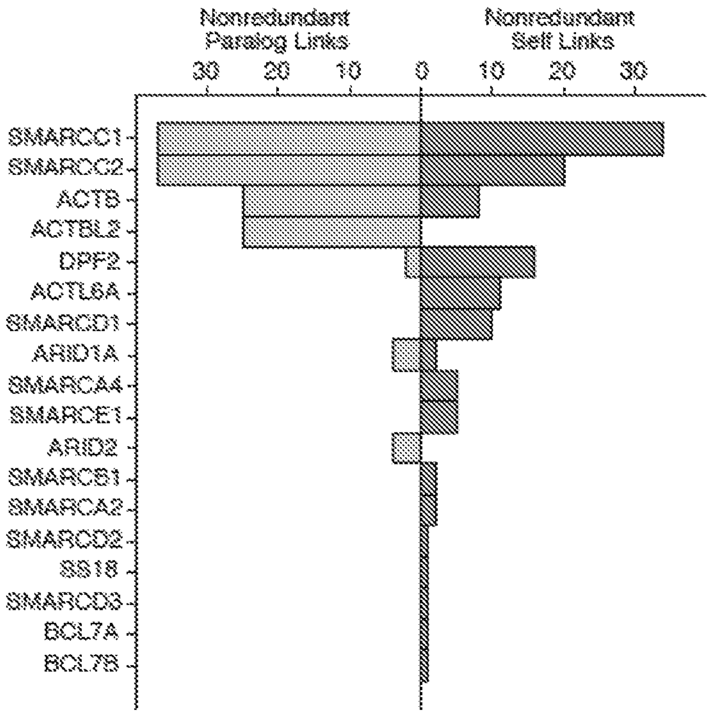
Figure 5D:
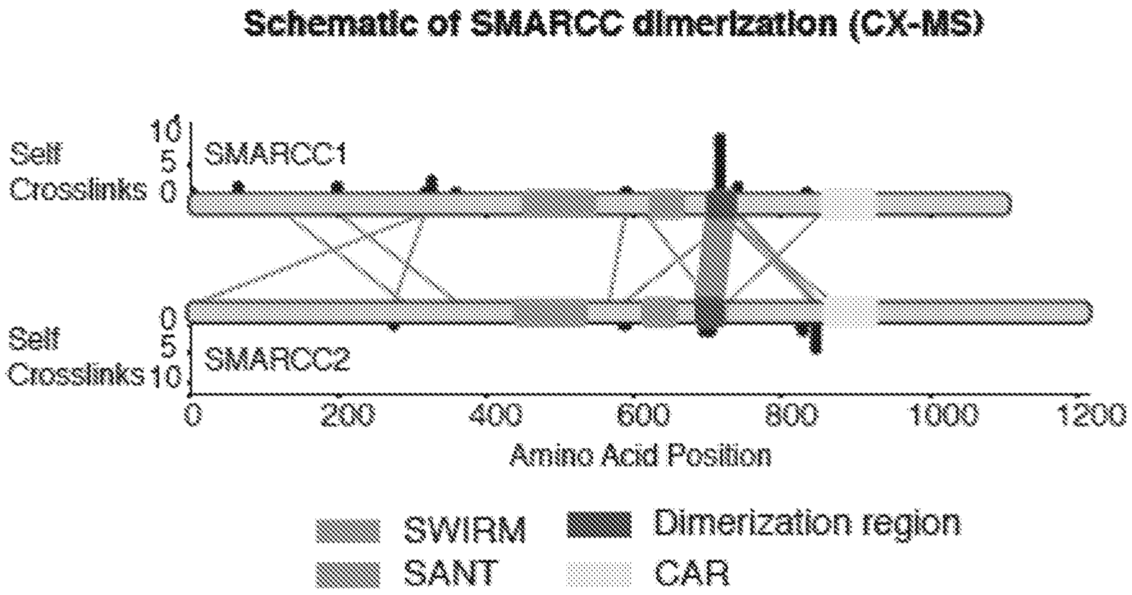
Figure 6J:
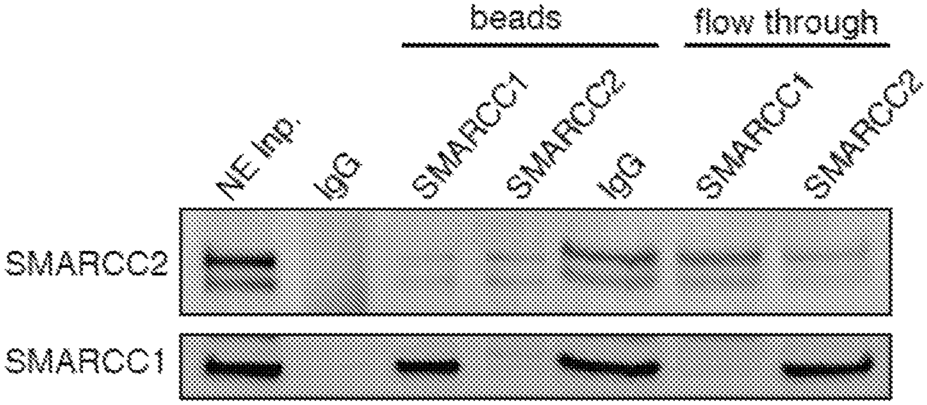
FIG. 6J shows that HEK-293T nuclear extracts were immunodepleted using indicated antibodies. Input, IP and flow through fractions were loaded on to SDS-PAGE and analyzed using WB with indicated antibodies.
Figure 6K:
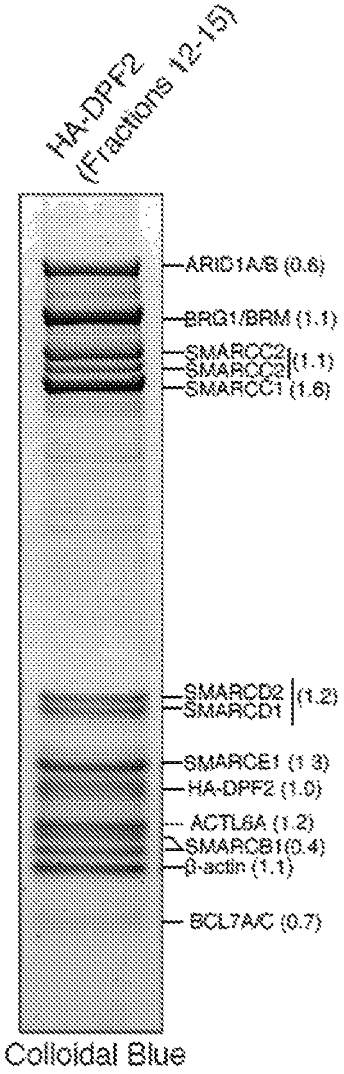
FIG. 6K shows the representative colloidal blue near infra-red detection of fractions 12-15 from DPF2-purified BAF complexes. Identified proteins are labeled and their approximated stoichiometry relative to DPF2 bait are indicated in parentheses.
Figure 6L:
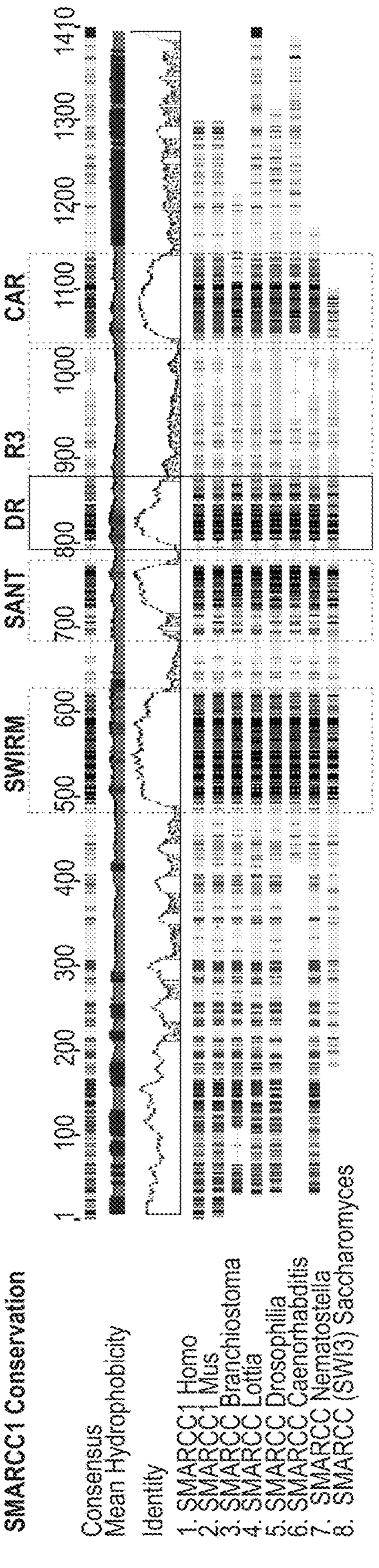
FIG. 6L shows the evolutionary conservation of the SMARCC subunits. Conserved domains and regions are indicated.

SMARCC subunits have been shown to form homo- and hetero-dimers (as C1/C1, C1/C2, or C2/C2), with C1/C1 homodimers found in ES cells and C1/C2 heterodimers in most differentiated cell types (Ho et al. (2009) *Proc Natl Acad Sci USA* 106: 5181-5186; Wang et al. (1996) *Genes Dev.* 10:2117-2130). CX-MS analysis showed either heterodimerization (by crosslinking between paralog subunits) or homodimerization (by crosslinked residues mapping to the same position of the identical peptide sequence, hereafter termed ‘self-crosslinks’) (FIG. 5C). Self-crosslinks were abundant in SMARCC subunits and β-actin, which is known to polymerize (DPF2 also exhibited some crosslinking owing to high free subunit concentrations). Immunodepletion of SMARCC1 and SMARCC2 further revealed preferential homodimerization of this subunit family (FIG. 6J). Using colloidal blue stain and fluorometric analysis of DPF2-purified complexes to approximate relative subunit stoichiometry, it was discovered herein that most components of the complex are present in nearly 1:1 stoichiometry with the exception of SMARCC1 that displayed 1:1.6, reflecting its known dimerization (FIG. 6K). SMARCC2 displayed near 1:1 stoichiometry most likely owing to its lower expression in these cells in comparison to SMARCC1. Despite preferential homodimer formation, it was identified herein that substantial SMARCC1/C2 crosslinks, and found a region C-terminal to the SANT domain (aa 679-747) that contained the majority of self/paralog crosslinks, which is hereafter termed the dimerization region (DR), while no crosslinks were identified within established domains (FIGS. 5D and 6L). The SMARCC coiled-coil region also contained a high number of crosslinks to the SWIB domain of the SMARCD core subunit (FIG. 3A). The observation that a SMARCC/SMARCD heteromer was repeatedly found without any other BAF core module components in early gradient fractions, demonstrates that this trimer is the first mSWI/SNF assembly intermediate, which is hereafter termed the initial BAF core.

Figure 5E:
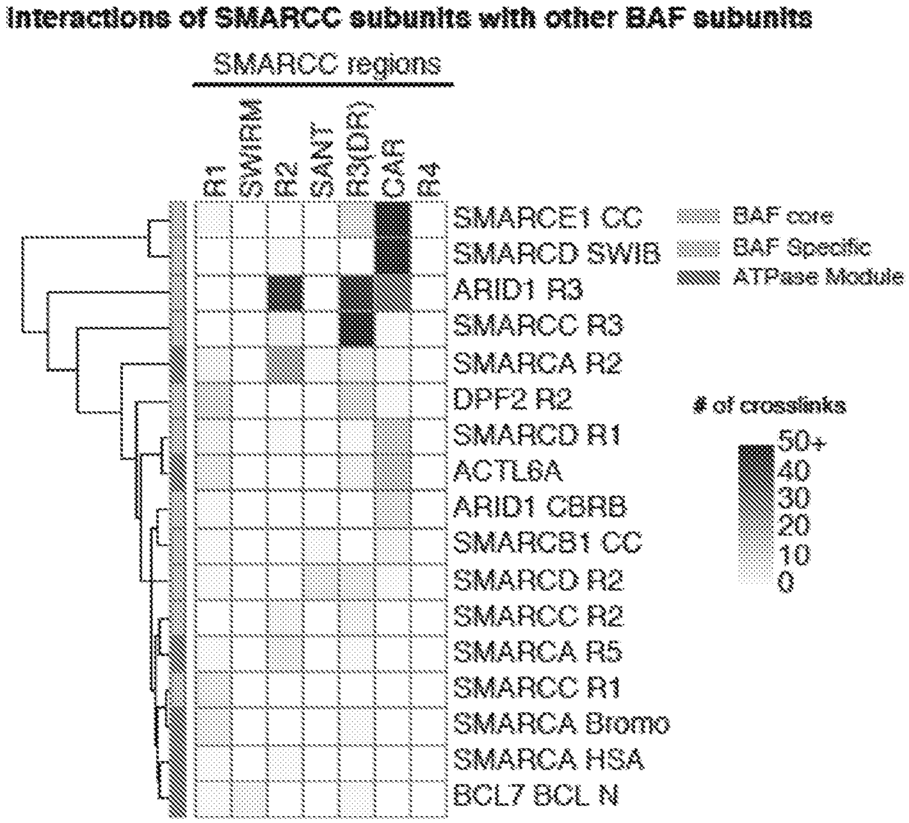
Figure 5F:
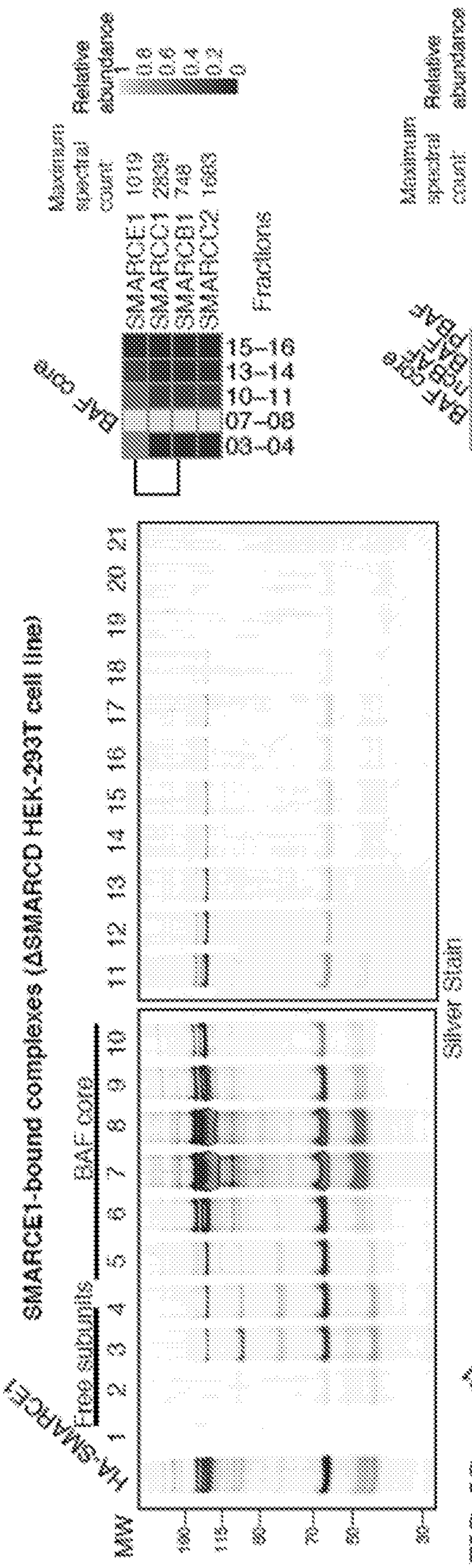

To determine the order of assembly for the BAF core module of SMARCC, SMARCD, SMARCB1, and SMARCE1 subunits, each component was systemically deleted using CRISPR-Cas9, removing all paralogs of each subunit family (i.e. SMARCC1/C2, SMARCD1/2/3, SMARCE1 (one gene) and SMARCB1 (one gene)) owing to structural redundancy. Importantly, removal of both SMARCC subunits resulted in near-complete degradation of all mSWI/SNF complex components (FIG. 6M), demonstrating the role for the SMARCC dimer as a platform for mSWI/SNF formation. Indeed, SMARCC crosslinks reveal additional binding regions aside from the DR: a conserved region (core assembly region (CAR)) that interacts with core subunits SMARCEL and SMARCD and the R2 and CAR regions that crosslink to ARID1 subunits (FIGS. 3A, 4B, and 5E). Loss of SMARCD inhibited BAF complex assembly and resulted in complete disruption of ARID and ATPase subunit binding; nonetheless, SMARCD-deficient BAF core formation was observed in fractions 7-8 using SMARCE1 and SMARCB1 as baits for purification and in co-IP experiments (FIGS. 5F and 6M-6O and Table 6G). These data demonstrate that all three BAF core subunits bind the SMARCC dimer platform using distinct, independent interfaces.

Figure 5G:
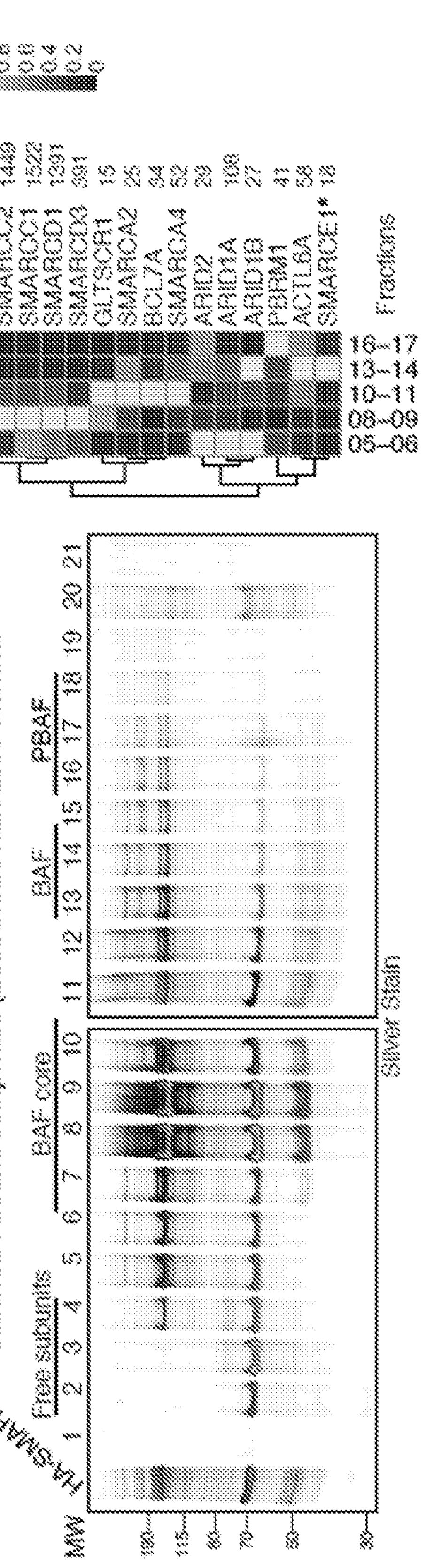
Figure 5H:
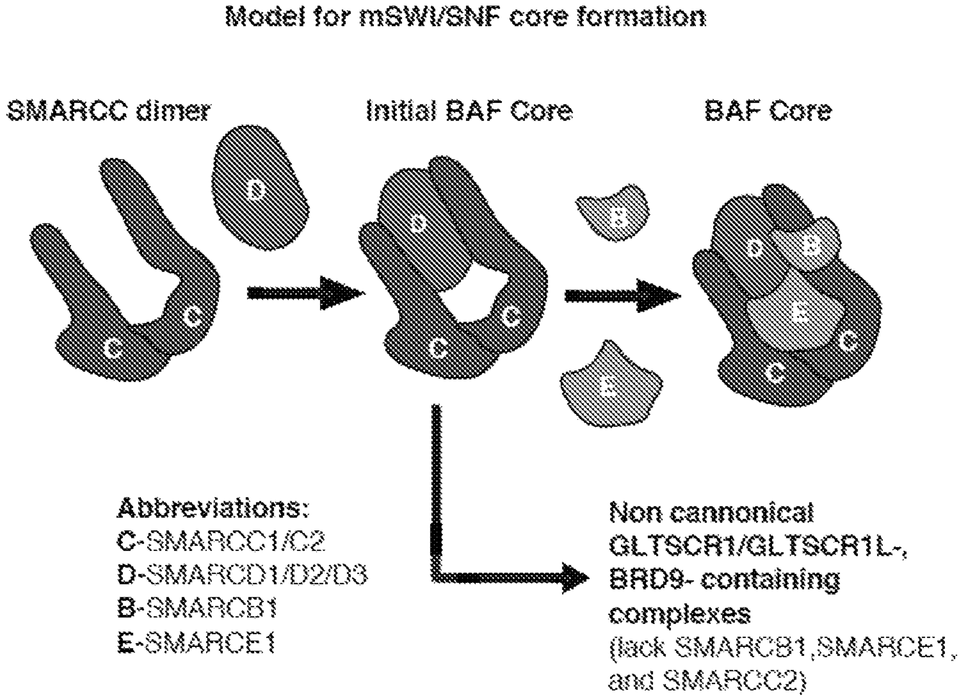
Figure 6M:
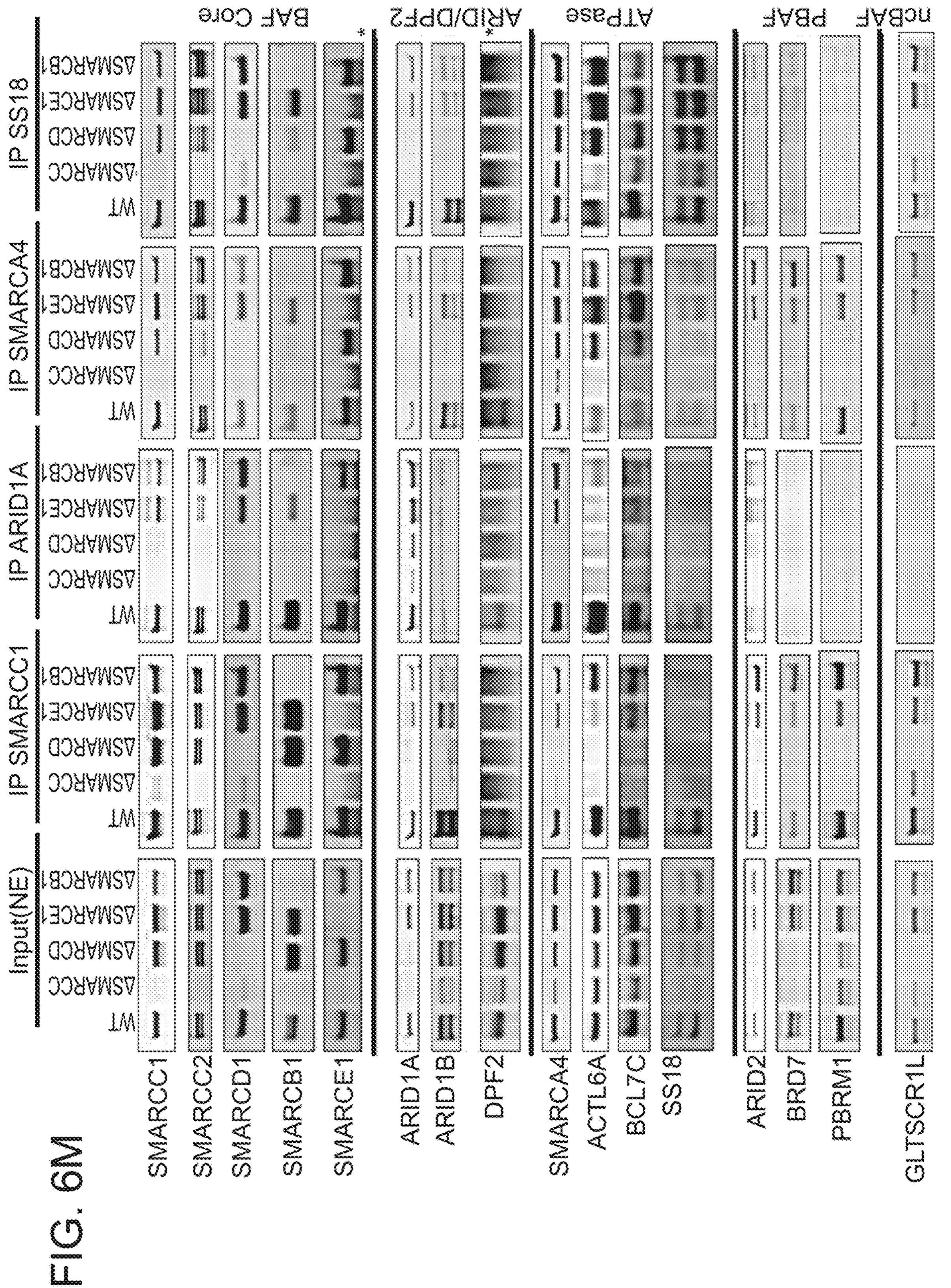
FIG. 6M shows the co-IP/immunoblot analysis of BAF core module WT and subunit KO cells. Antibodies used for detection are indicated.
Figure 6N:
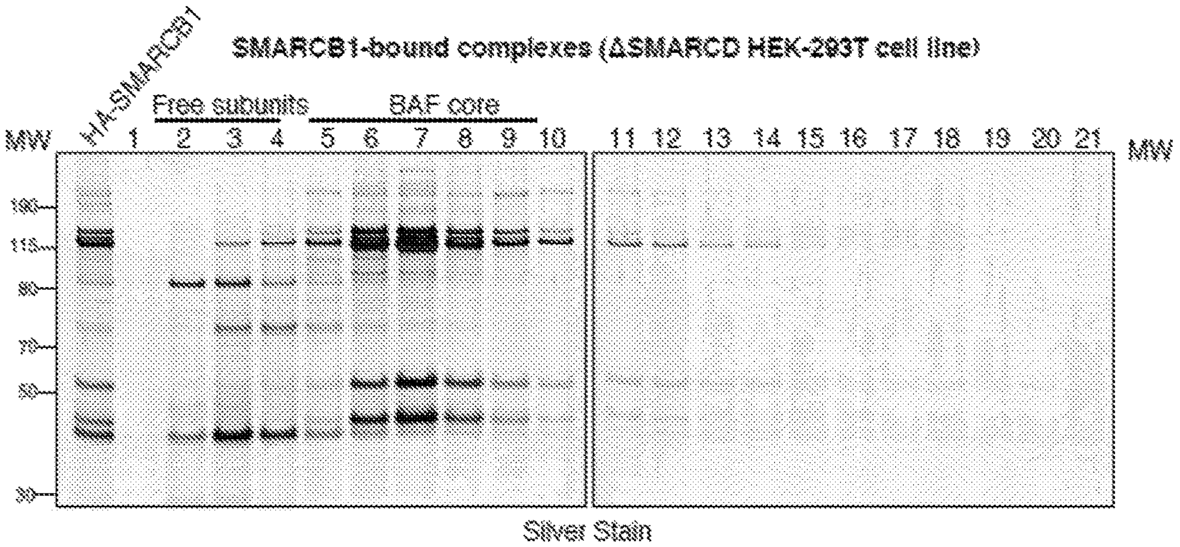
FIG. 6N shows the native HA-SMARCB1 BAF complexes were purified from ΔSMARCD 293T cells and subjected to glycerol gradient centrifugation, collected fractions were SDS-PAGE separated and silver stained (left).
Figure 6O:
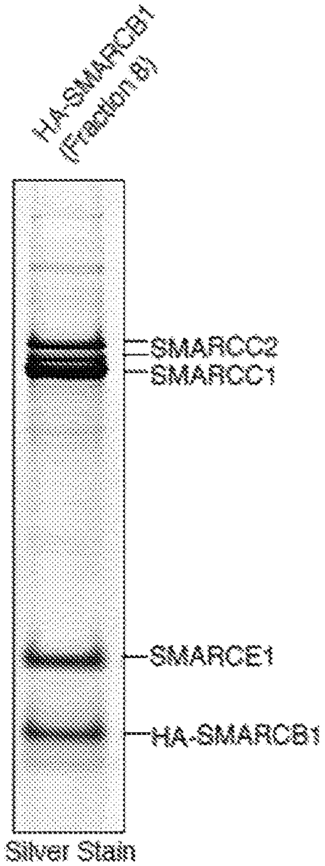
FIG. 6O shows the silver stain analysis of Fraction 8 of the HA-SMARCB1 gradient in WT HEK-293T cells. Subunits are labeled.
Figure 6P:
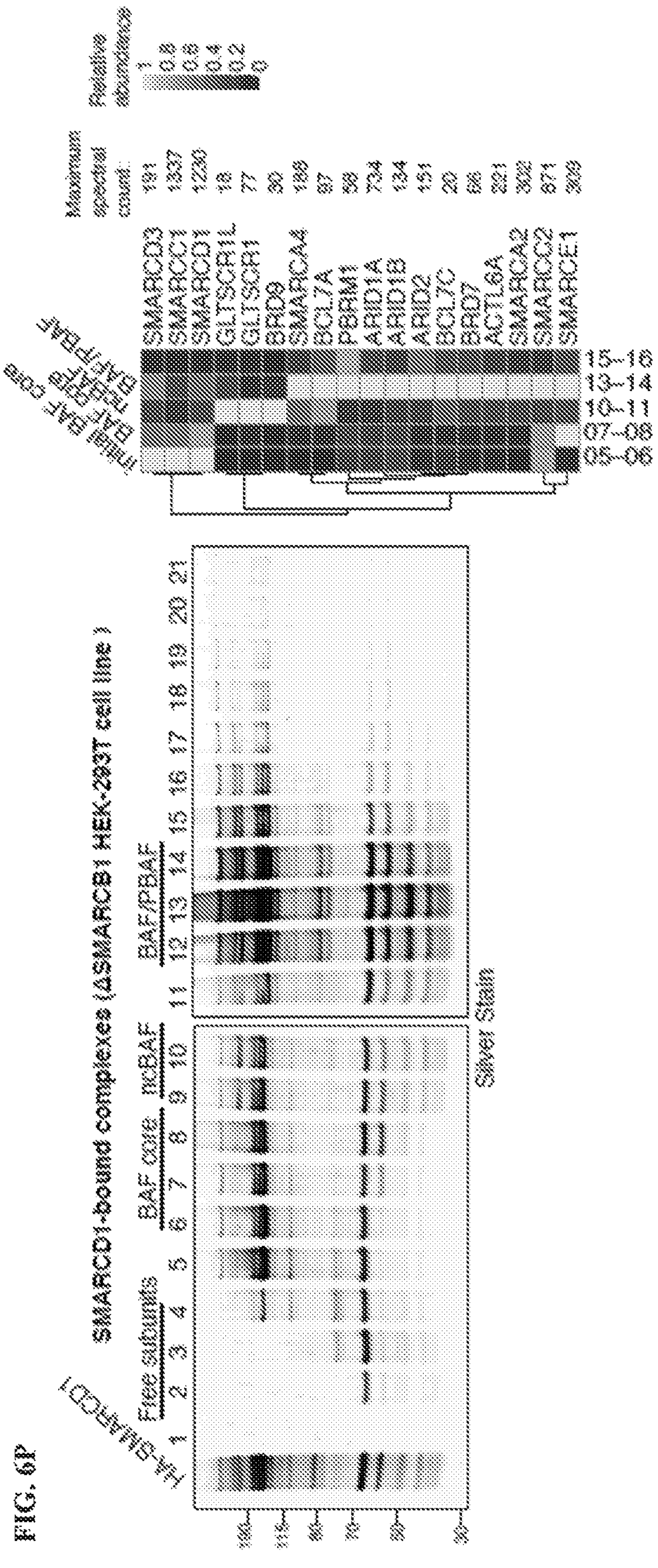
FIG. 6P shows the native HA-SMARCD1 BAF complexes were purified from ΔSMARCB1 cells and were subjected to glycerol gradient centrifugation. Collected fractions were SDS-PAGE separated and silver stained (left). Clustered heatmap and spectral counts of the mass spec analysis performed on selected pulled fractions are shown (right).
Figure 6Q:
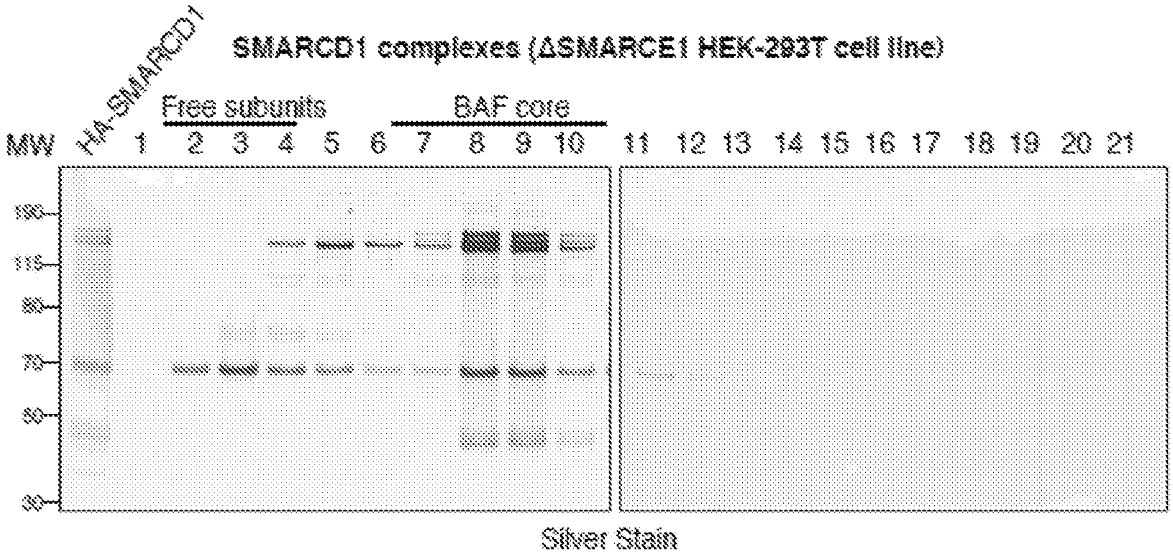

Loss of SMARCE1 resulted in partial complex destabilization, as subunit abundance was drastically shifted toward BAF core intermediates in Fx 8-9 (FIGS. 5G and 6Q and Table 6H). Complexes were destabilized relative to WT BAF, and ARID subunits were observed in Fx 5-6, indicating that they are unable to stably bind complexes in the absence of SMARCE1. In contrast to stringent gradient sedimentation, co-IP showed that SMARCE1 loss minimally affected BAF complex formation, implicating a possible role in inter-module stability (FIG. 6M). Finally, SMARCB1 deletion resulted in minimal impact on BAF complex formation, confirming the previous observations (Nakayama et al. (2017) *Nature genetics* 49:1613-1623) (FIG. 6P and Table 6I). However, a shift in the migration of PBAF components to Fx 12-14 (in contrast to Fx 16-17 in WT cells) was observed, indicating that SMARCB1 is important for normal PBAF stoichiometry or PBAF-specific subunit binding. Of note, in both ΔSMARCEL and ΔSMARCB1 settings, ncBAF complex components were still readily detectable and unaffected (Fx 10-11), consistent with the finding that these complexes lack SMARCEL and SMARCB1 (FIGS. 5G and 6P). Taken together, these data demonstrate that mSWI/SNF complex assembly is triggered by the formation of the initial BAF core (SMARCC/SMARCD) formed around the SMARCC dimer. This initial subcomplex then acts as a platform for independent docking of SMARCE1 and SMARCB1 subunits to form the BAF core module, which is required for assembly toward fully-formed cBAF and PBAF complexes (FIG. 5H).

Figure 7A:
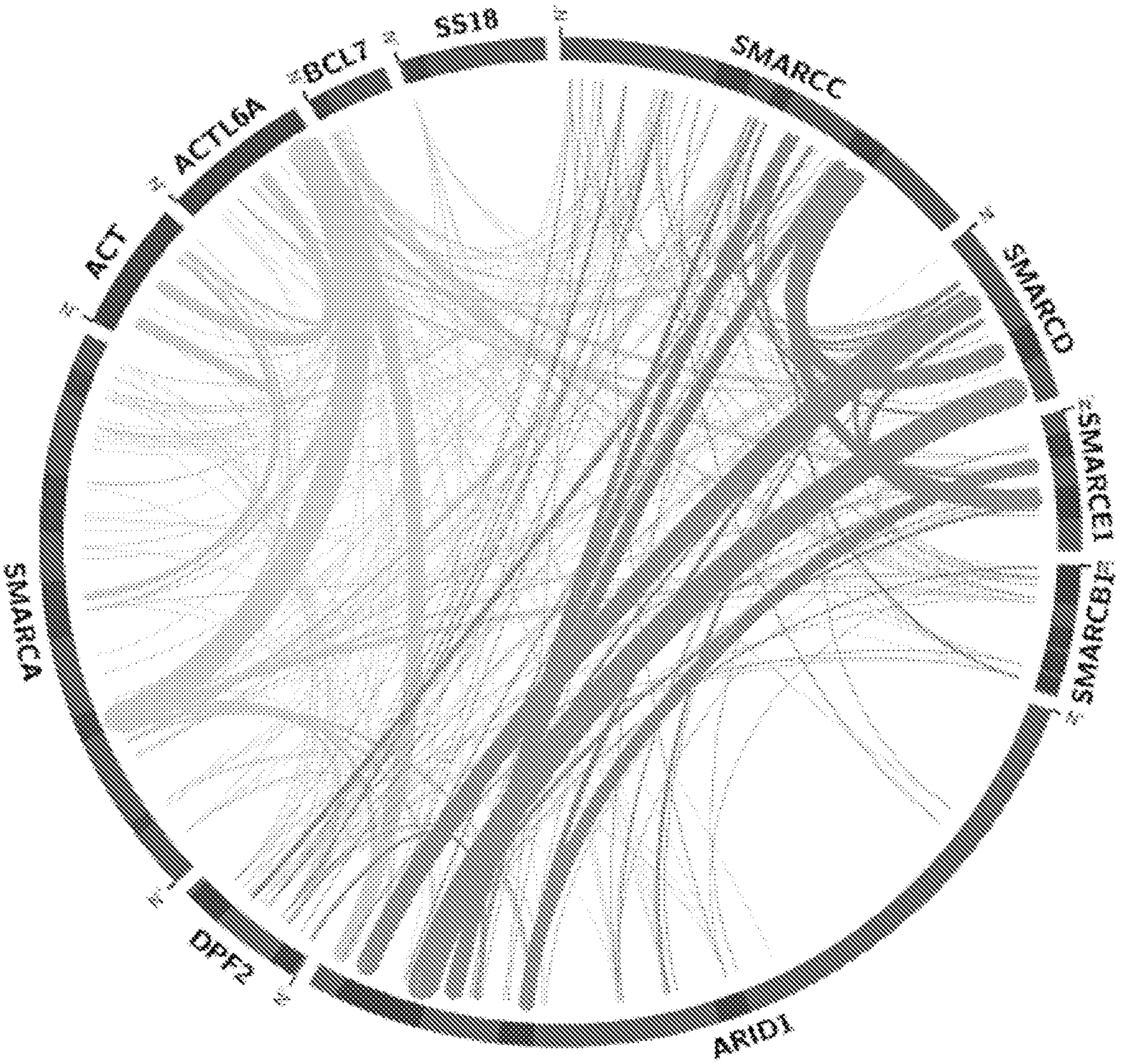
FIG. 7A-FIG. 7H show that ARID subunits dictate specific branches of BAF and PBAF complex assembly.
Figure 7B:
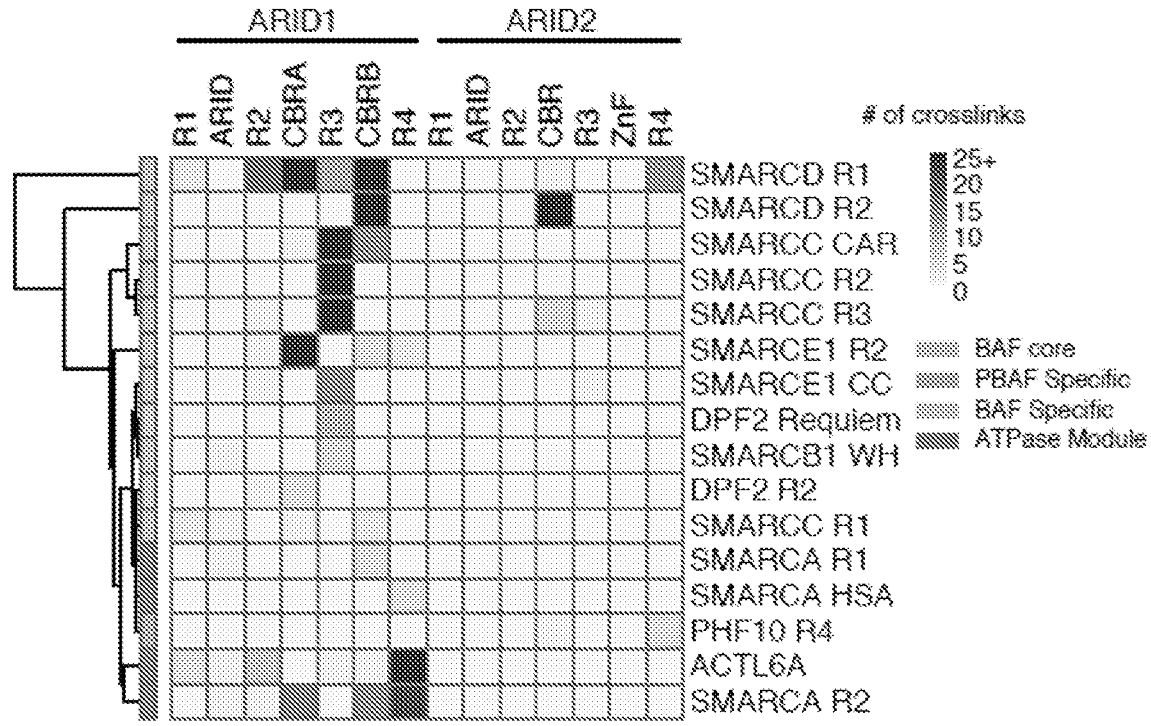
Figure 7C:
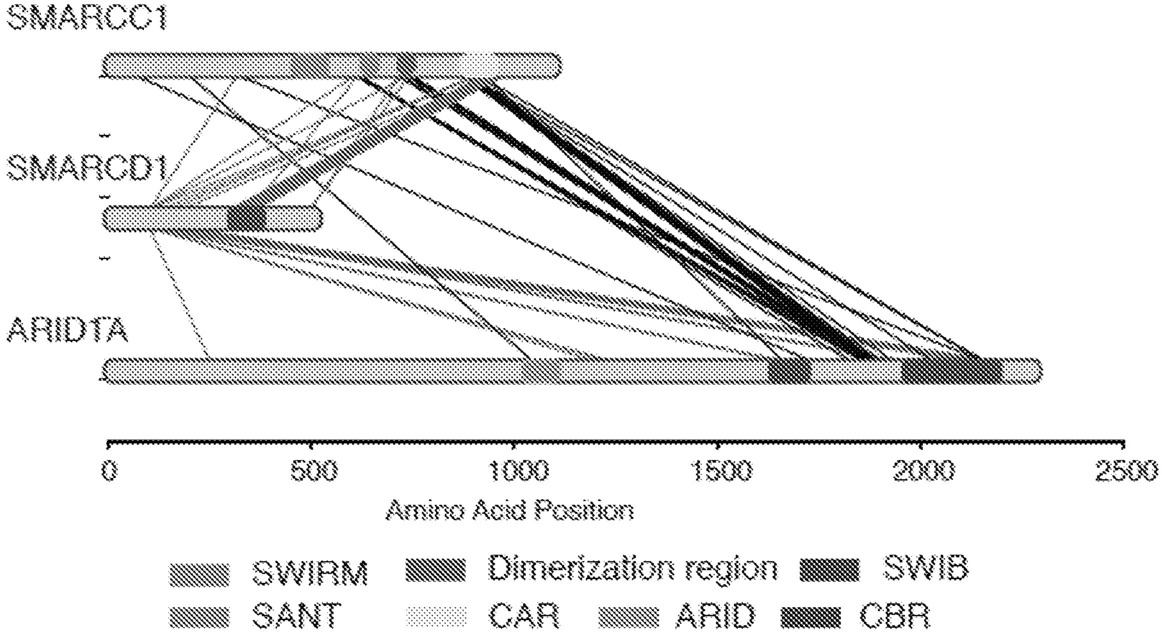
Figure 8A:
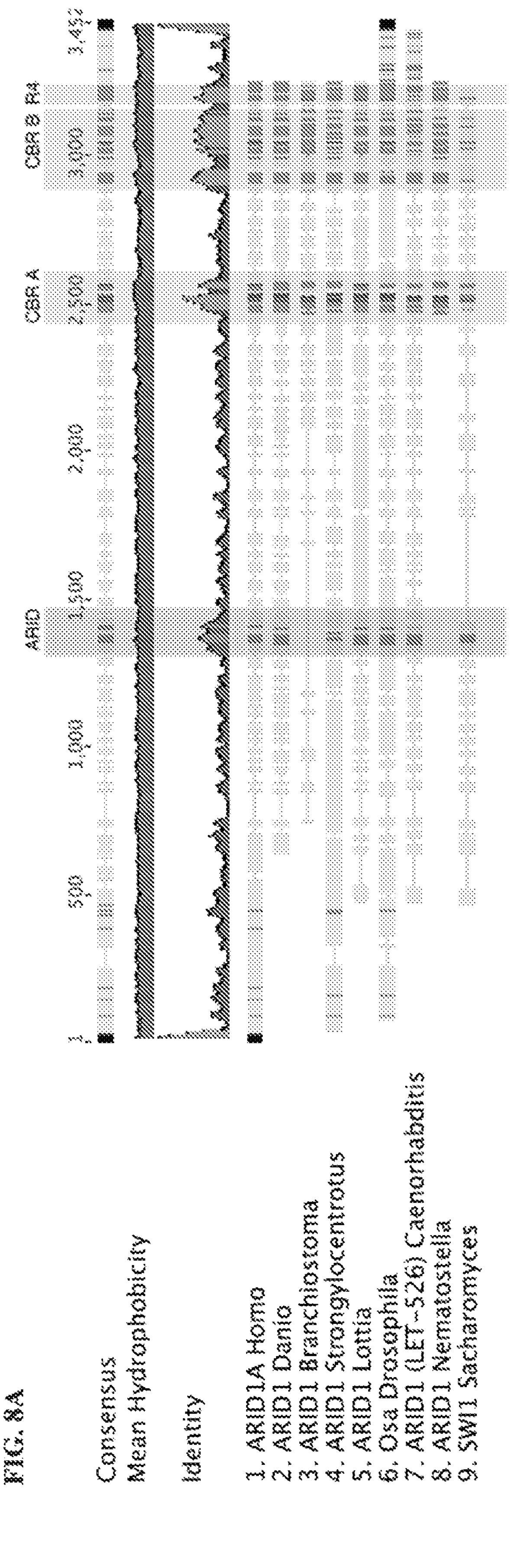
Figure 8B:
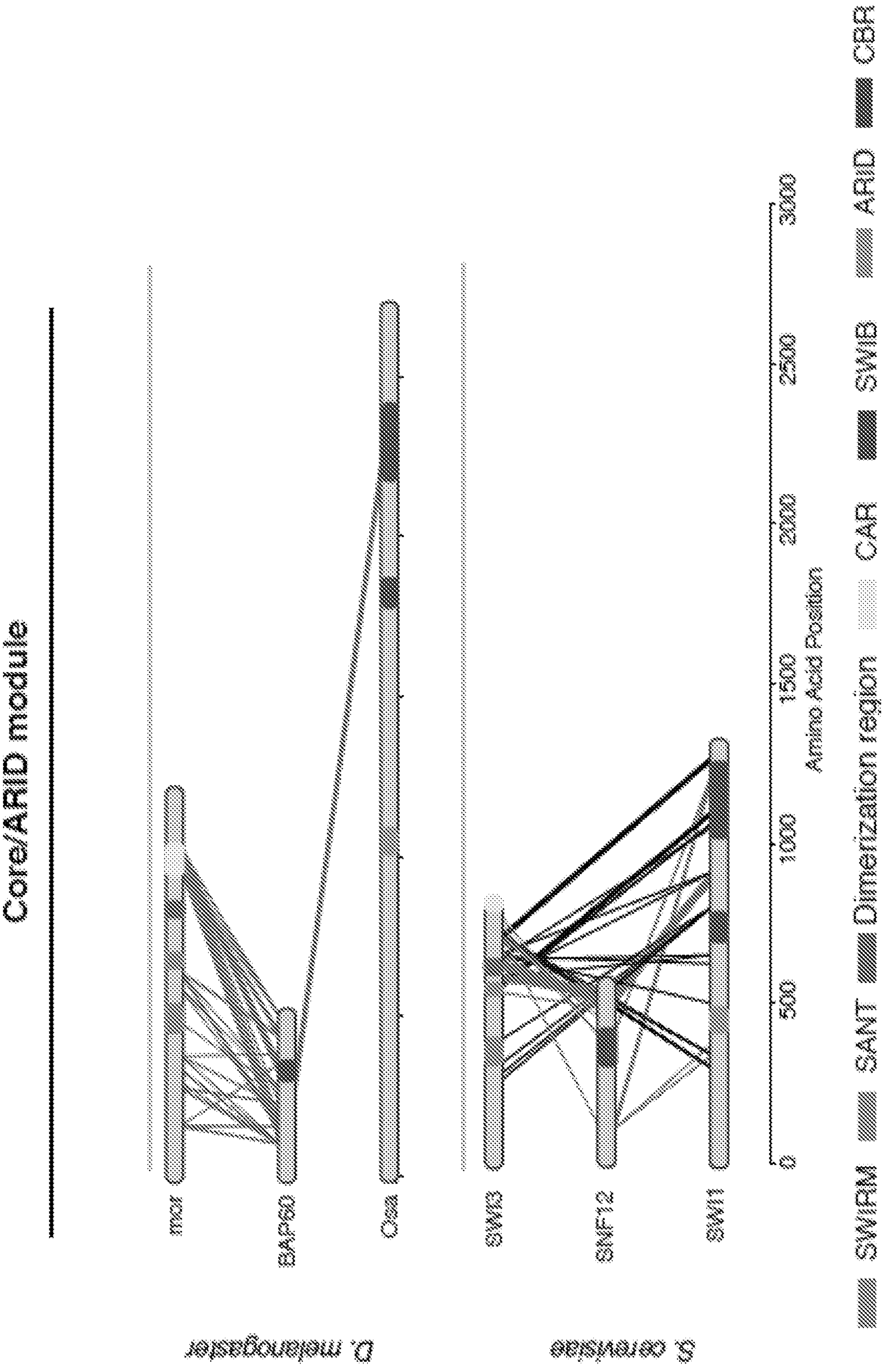
Figure 8C:
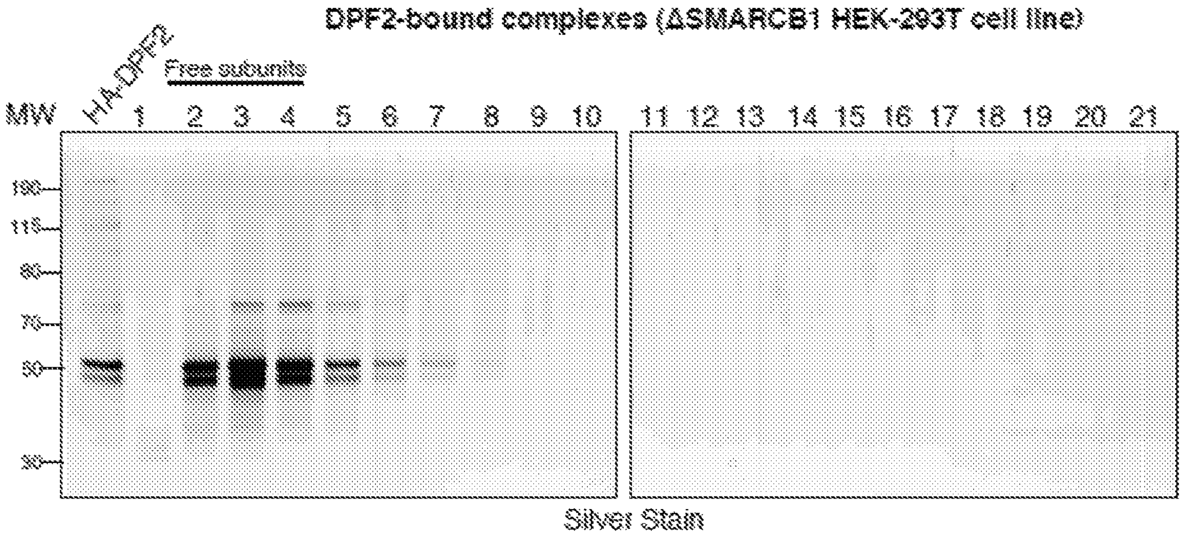
Figure 8D:
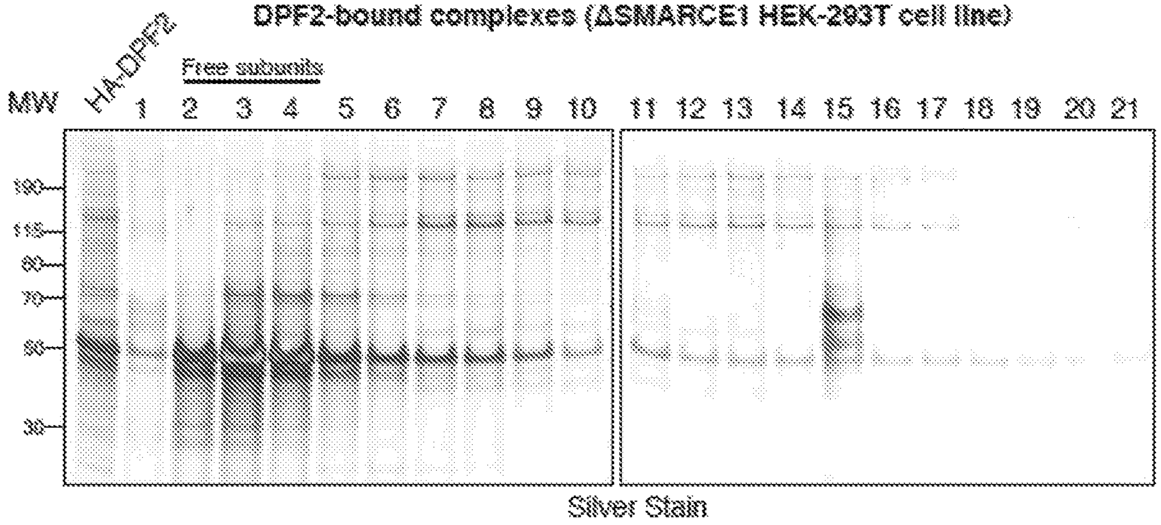
FIG. 8D shows the gradient and MS heatmap of native HA-ARID1A C-terminus-bound BAF complexes purified from WT HEK-293T cells.
Figure 8E:
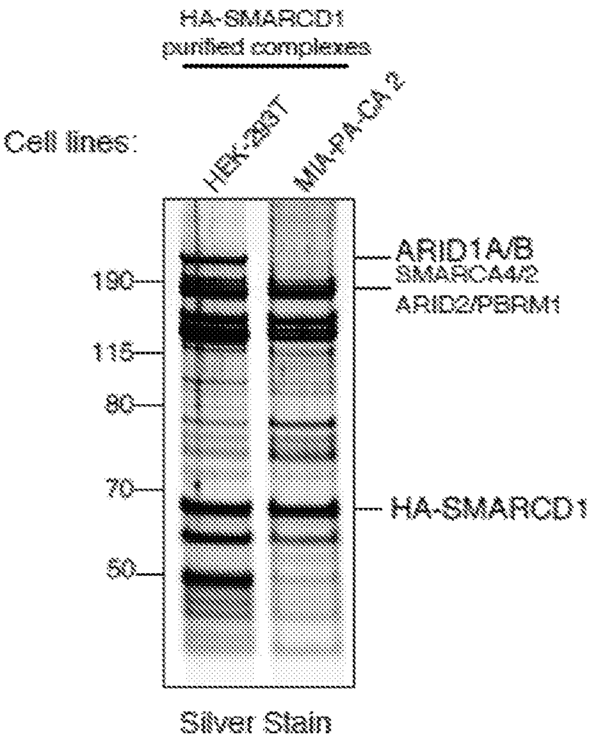
FIG. 8E-FIG. 8G show the native HA-SMARCD1 purification and gradient MS in (FIG. 7E) ARID1A/ARID1B-deficient, (FIG. 7F) ARID1A/B/ARID2-deficient, (FIG. 7G) SMARCA4/2-deficient HEK-293T cells.
Figure 8F:
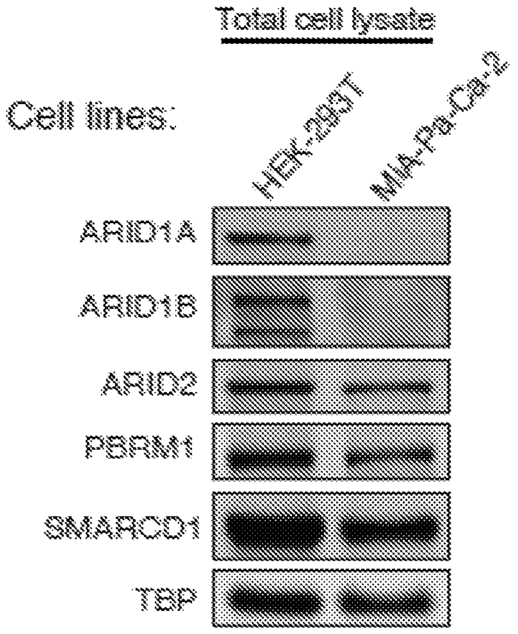
Figure 8G:
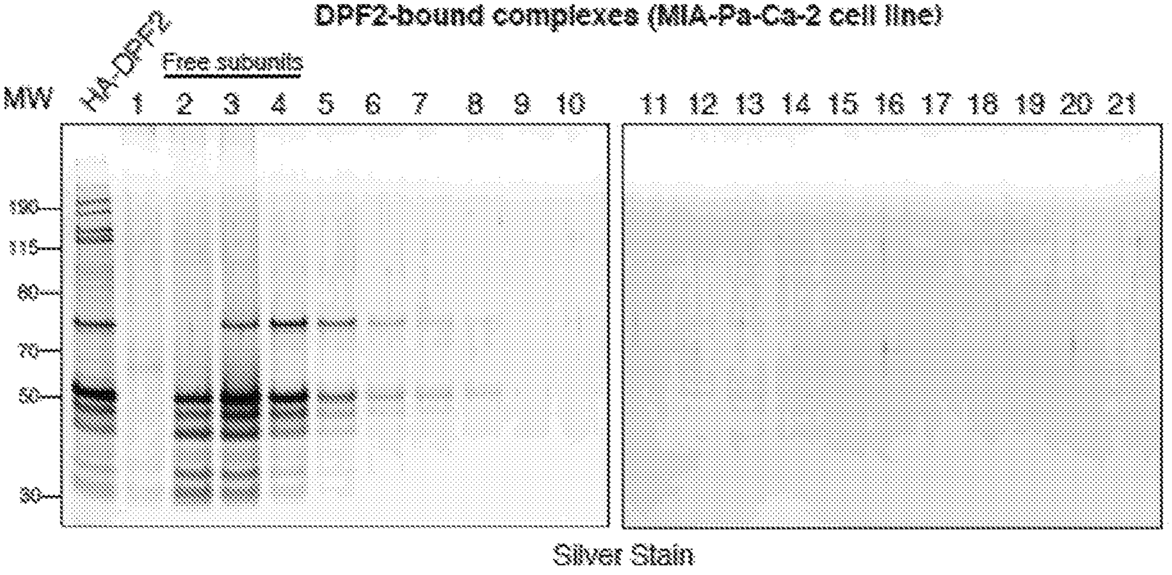

Example 5: ARID Subunits Interact with the BAF Core Module to Facilitate Binding of the ATPase Subcomplex CX-MS analyses indicated that BAF core components (SMARCD, SMARCC, SMARCB1, SMARCE1) strongly crosslinked with ARID subunits, ARID1A/B. The C-terminal region of ARID1A/B exhibited a large number of crosslinks to the BAF core, particularly to SMARCC and SMARCD (FIG. 7A). ARID1 proteins contain several distinct, conserved regions, including the N-terminus, ARID domain and three potential domains in the C-terminus which is hereafter termed score binding region A and B (CBR A and (BR B) and region 4 (R4) (FIGS. 3A, 4B, and 8A). CBR and R4 regions crosslink to the BAF core and ATPase subunits, respectively (FIG. 7B). For example, CBR A displays preferential binding to SMARCD1 R1 and SMARCE1 R2, ARID1 R3 exhibits crosslinks to several SMARCC regions, and CBR B crosslinks to SMARCC CAR and SMARCD R1 and R2 regions. ARID1 R4 crosslinks to ATPase components SMARCA and ACTL6A components (FIGS. 7B and 7C). These results were similar in both yeast and Drosophila, indicating conservation of the ARID/SWI1 binding modality (FIG. 8B).

Figure 7D:
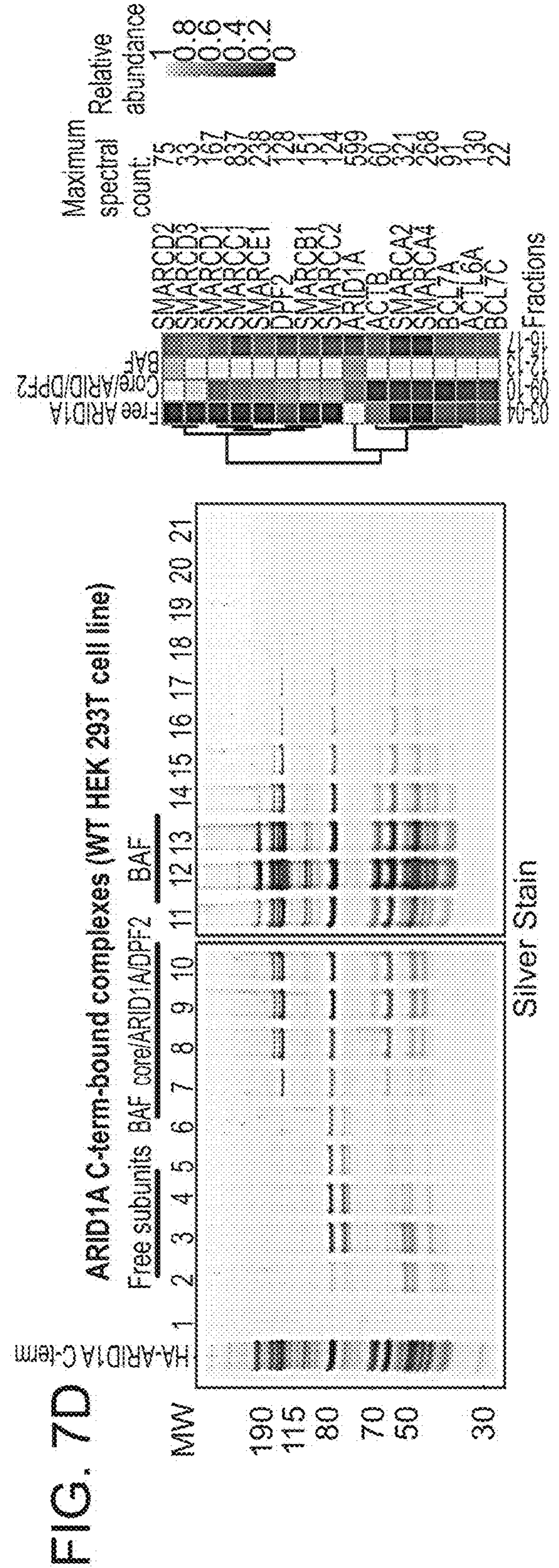

The ARID domain of ARID1 subunits displayed limited crosslinking, demonstrating its involvement in complex recruitment to DNA rather than its role in assembly of the complex. Guided by these results, it was cloned and expressed herein a C-terminal ARID1A fragment containing CBR A, CBR B and R4 regions (aa1611-2285) that are predicted to stably bind and facilitate the assembly of complete BAF complexes. It was discovered herein that HA-ARID1A C-terminus is sufficient to interact with and capture fully-formed BAF complexes (FIG. 7D and Table 6J). MS analysis of lower molecular-weight gradient fractions revealed intermediates containing the BAF core module, ARID1A C-terminal region, and DPF2 (FIG. 7D). In addition, the ARID1A C-terminus was sufficient to enable incorporation of DPF2 into both ARID1/BAF core intermediates as well as full BAF complexes, indicating that the DPF2 subunit requires both modules for its binding.

Figure 8H:
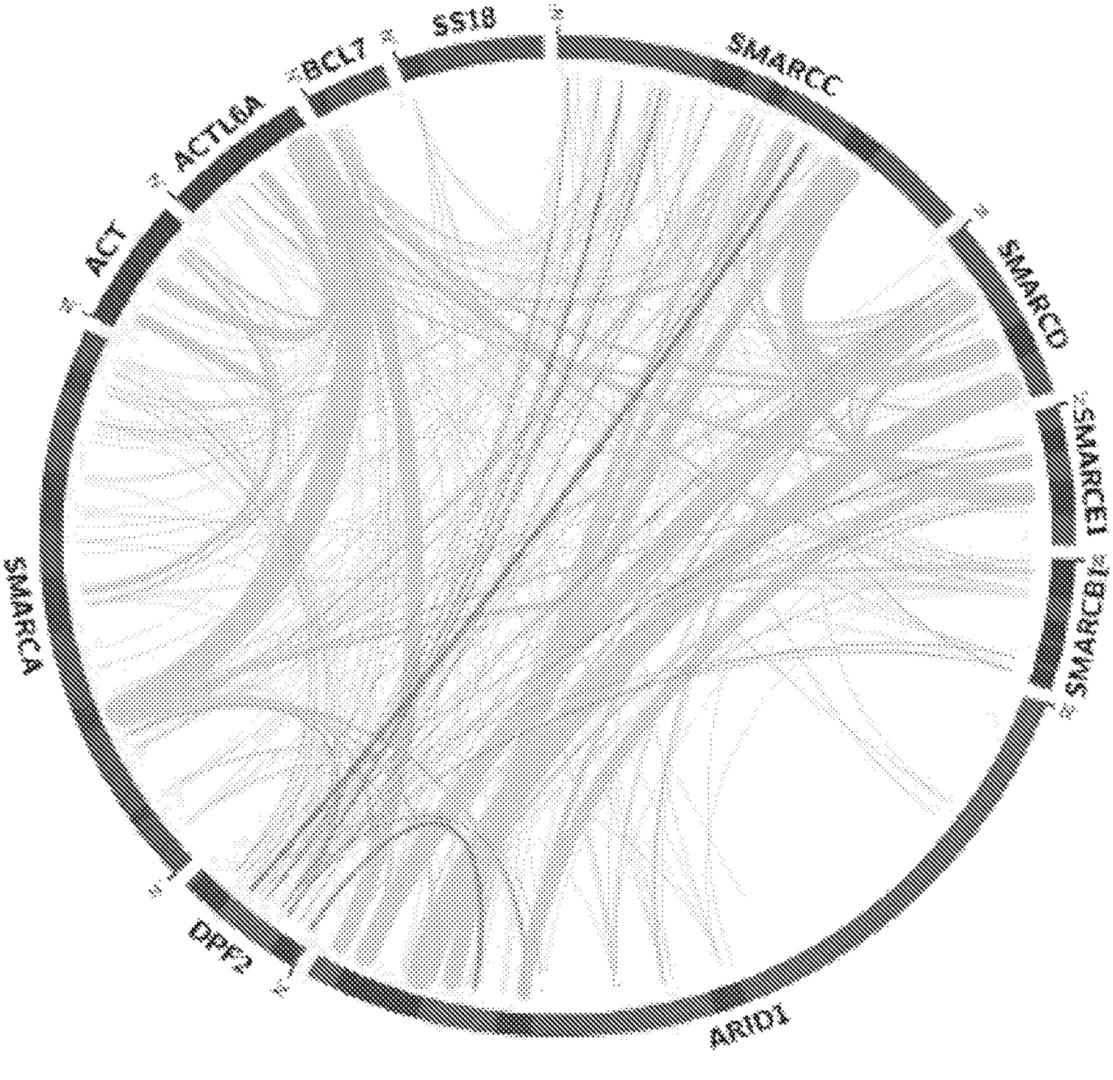

To test this, it was performed herein DPF2 affinity purifications in BAF core module subunit deletion mutant cell lines (ΔSMARCB1 and ΔSMARCE1 lines). Importantly, a complete loss of BAF complex capture (and hence DPF2 binding) was observed in these settings as well as in ARID1A/B double KO 293T cells or MIA-Pa-Ca-2 cells (deficient in ARID1A/B) (FIGS. 8C-8G). DPF2 crosslinks to all modules of the BAF complex, indicating a large interaction interface, and consistent with its binding preference for fully-formed cBAF complexes (FIG. 8H). However, removal of the ATPase subunits SMARCA2/SMARCA4 did not disrupt DPF2 assembly (FIGS. 81 and 8J), indicating that the ATPase module is the last to be incorporated into mSWI/SNF complexes. These data corroborate results from DPF2 purifications (FIG. 1C), explaining why DPF2 exists only as part of fully-formed BAF complexes or as a free subunit, and never part of any assembly intermediates.

Figure 7E:
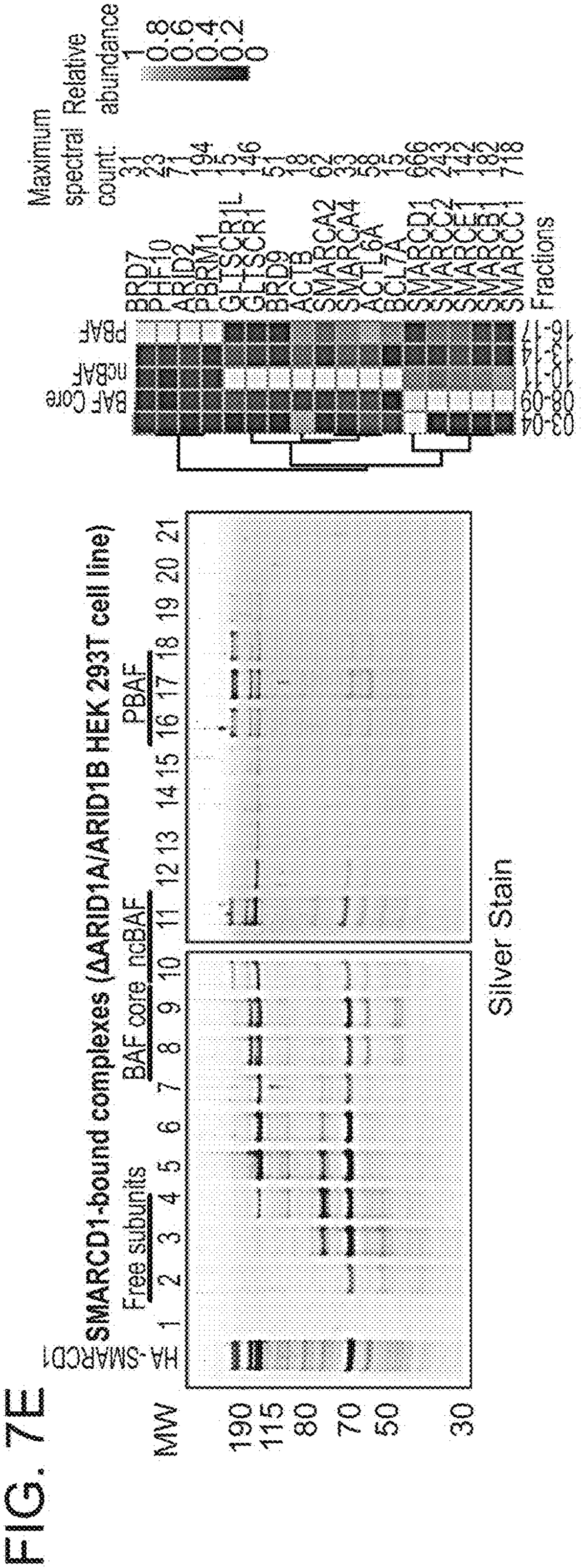
Figure 7F:
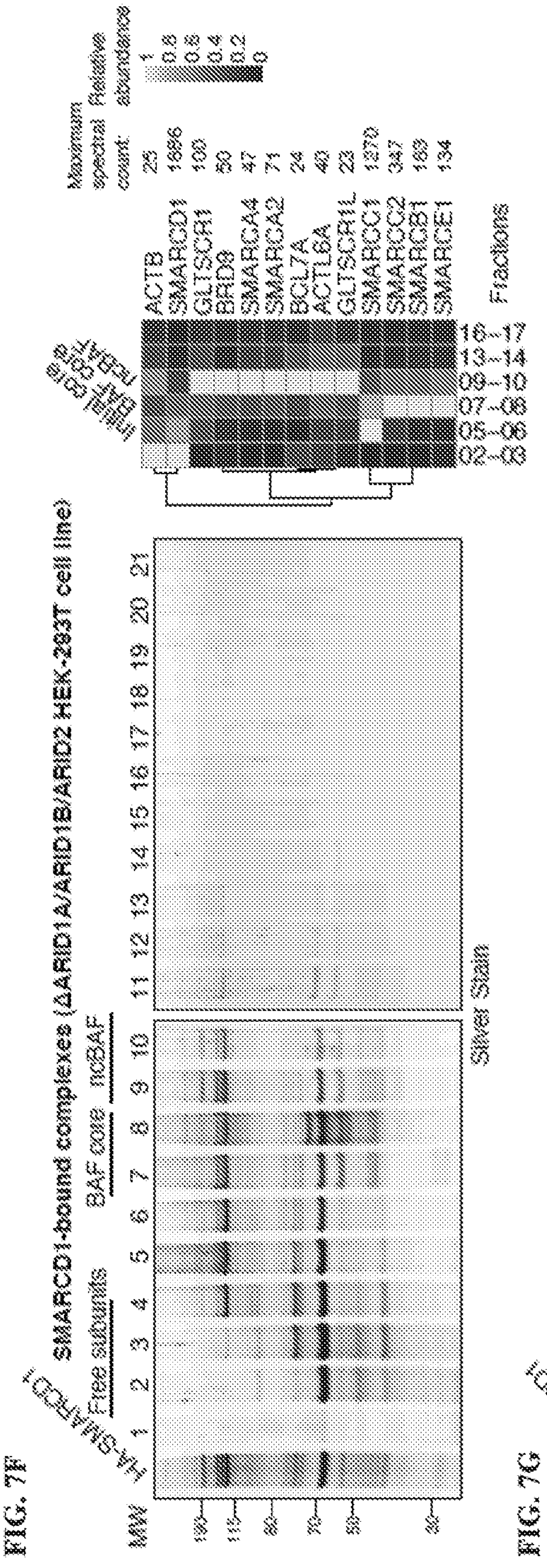

To define the requirement for ARID1 subunits in BAF complex assembly, it was herein analyzed SMARCD1-bound complexes in ΔARID1 (ΔARID1A/ARID1B) KO cells (FIG. 7E and Table 6K). Normal BAF core formation was observed in Fx 8-9; ncBAF was observed in Fx 10-11; and PBAF was observed in Fx 16-18. However, there were no detectable cBAF complexes in the expected Fx 13-14. These surprising data indicate that ARID proteins interact with fully-assembled BAF core modules which then enable binding of the ATPase module through interaction of the ARID R4 domain with ACTL6A and SMARCA subunits. In addition, it was found herein that ncBAF forms completely independently of the presence of ARID1 subunits, demonstrating an ARID-independent ATPase recruitment mechanism. Finally, it was purified herein SMARCD1-bound complexes in cells lacking all three mSWI/SNF family ARID proteins (ΔARID1A/ΔARID1B/ΔARID2 cells). Despite intact assembly of the BAF core module, upon losing ARID2 in addition to ARID1A/B, assembly of both BAF and PBAF complexes was completely inhibited (FIG. 7F and Table 6L).

Figure 7G:
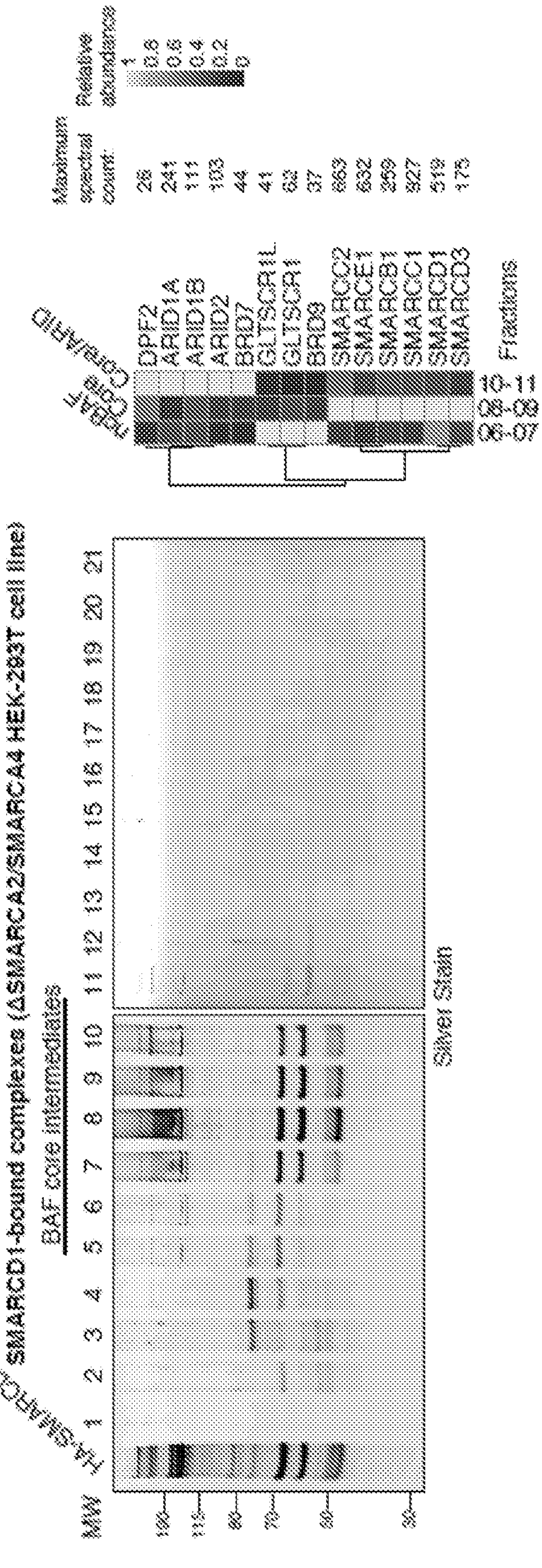
Figure 7H:
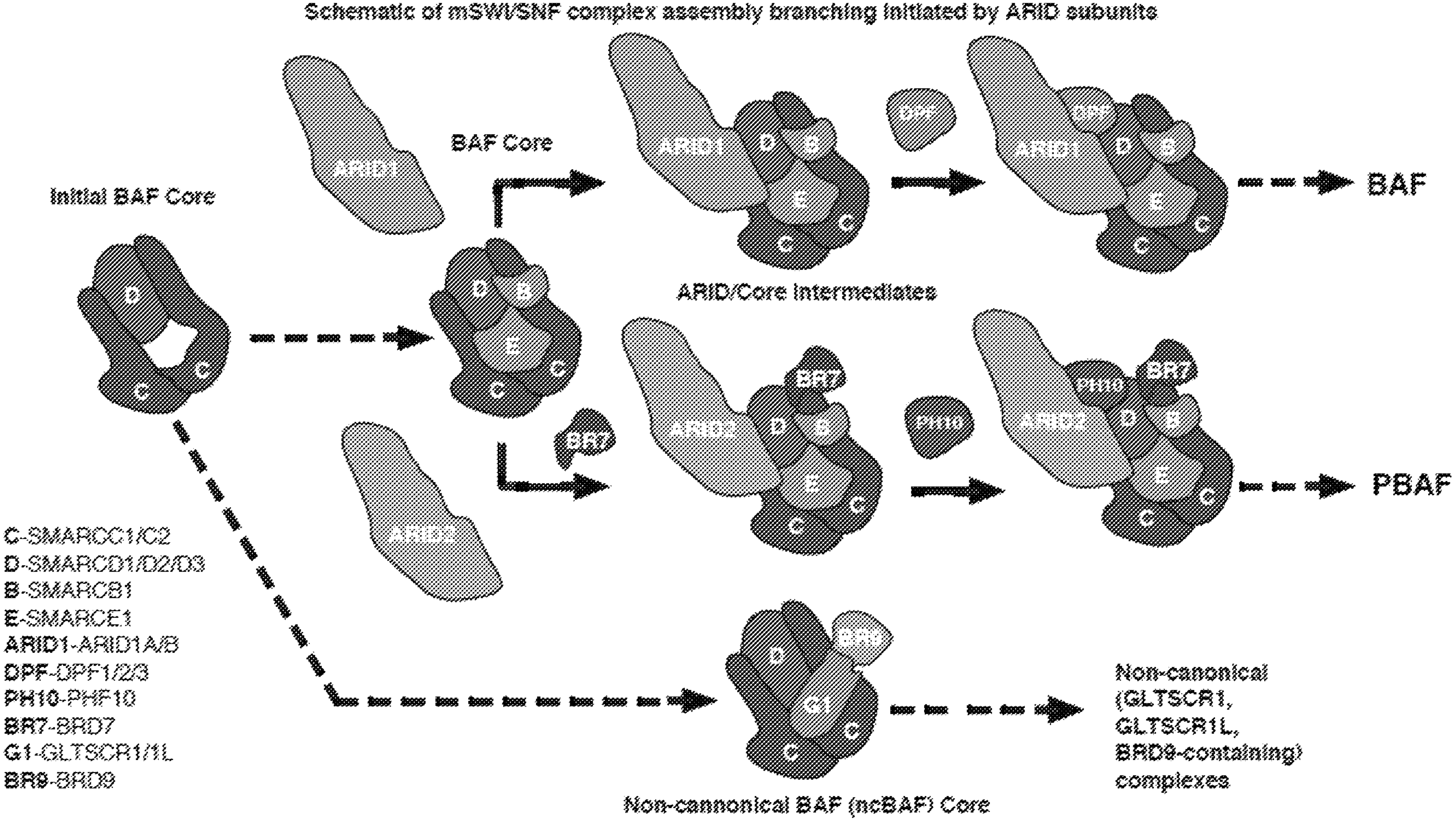
Figure 8K:
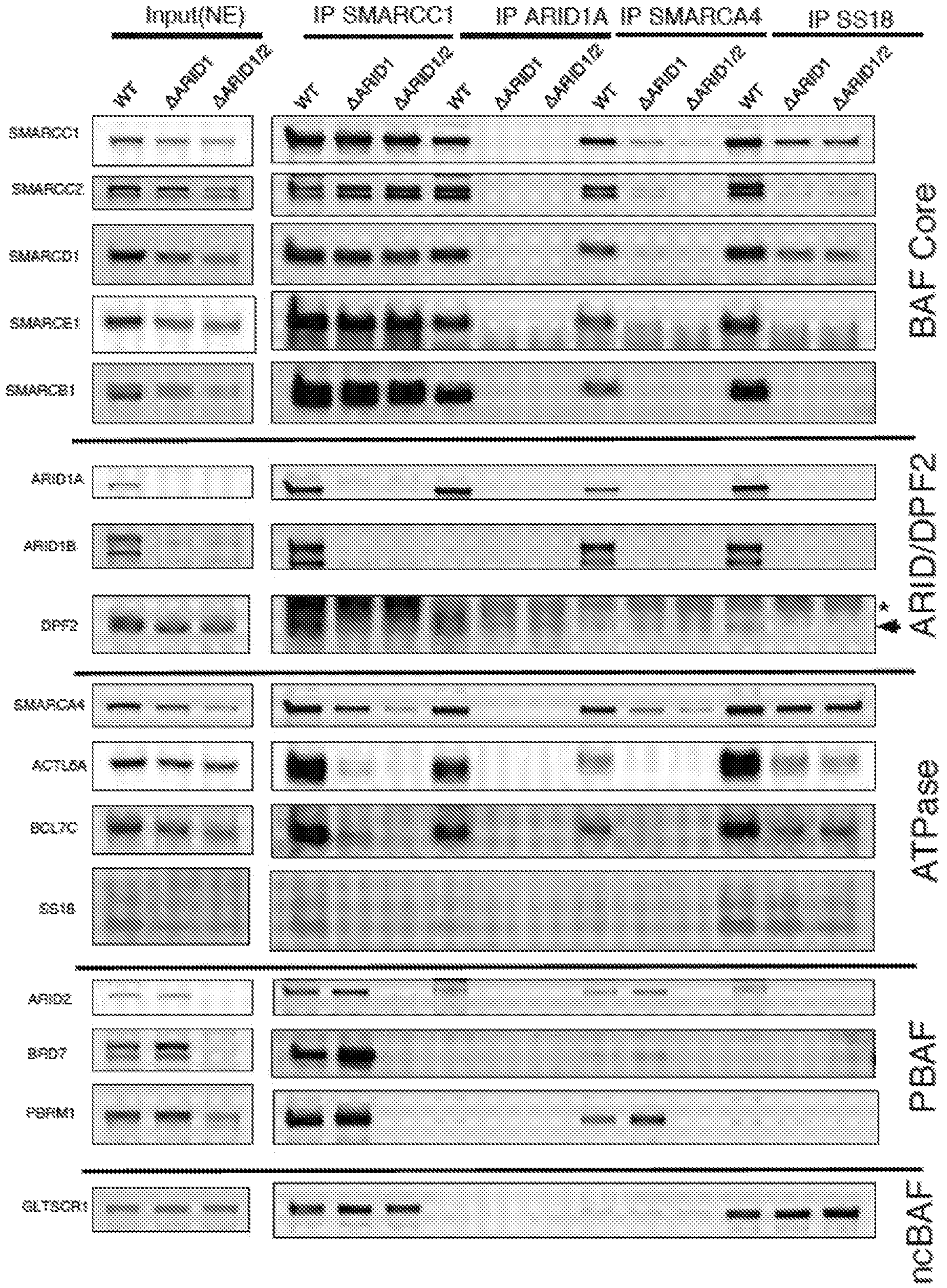

These results demonstrate that ARID proteins nucleate complex-specific branching into BAF and PBAF complexes (ARID1A/B for BAF and ARID2 for PBAF). To detect ARID-containing intermediate complexes, SMARCD1 purifications were performed from HEK-293T cells lacking both ATPases (ΔSMARCA2/ΔSMARCA4), followed by native complex gradient separation and MS (FIG. 7G, and Table 6M). It was detected herein complexes of smaller size, similar to DPF2-purified BAF complexes from SW13 cells (FIGS. 81 and 8J) which resolved partially-formed ncBAF complexes (consisting of the initial core (SMARCC/SMARCD1) and BRD9/GLTSCR but lacking the ATPase and its associated components in Fx 6-7), which was termed the ncBAF core module, BAF core module components SMARCB1 and SMARCE1 which do not bind ncBAF (Fx 8-9), and a mixture of BAF/PBAF intermediates containing core module, ARID1 or ARID2, and the PBAF-specific subunit BRD7 (Fx 10-11) (indicating that BRD7 is the next PBAF-specific member to assemble on to the core/ARID modules) (FIG. 7G). Global co-IP and immunoblot confirmed findings across a range of mutant cell lines (FIG. 8K).

Figure 9A:
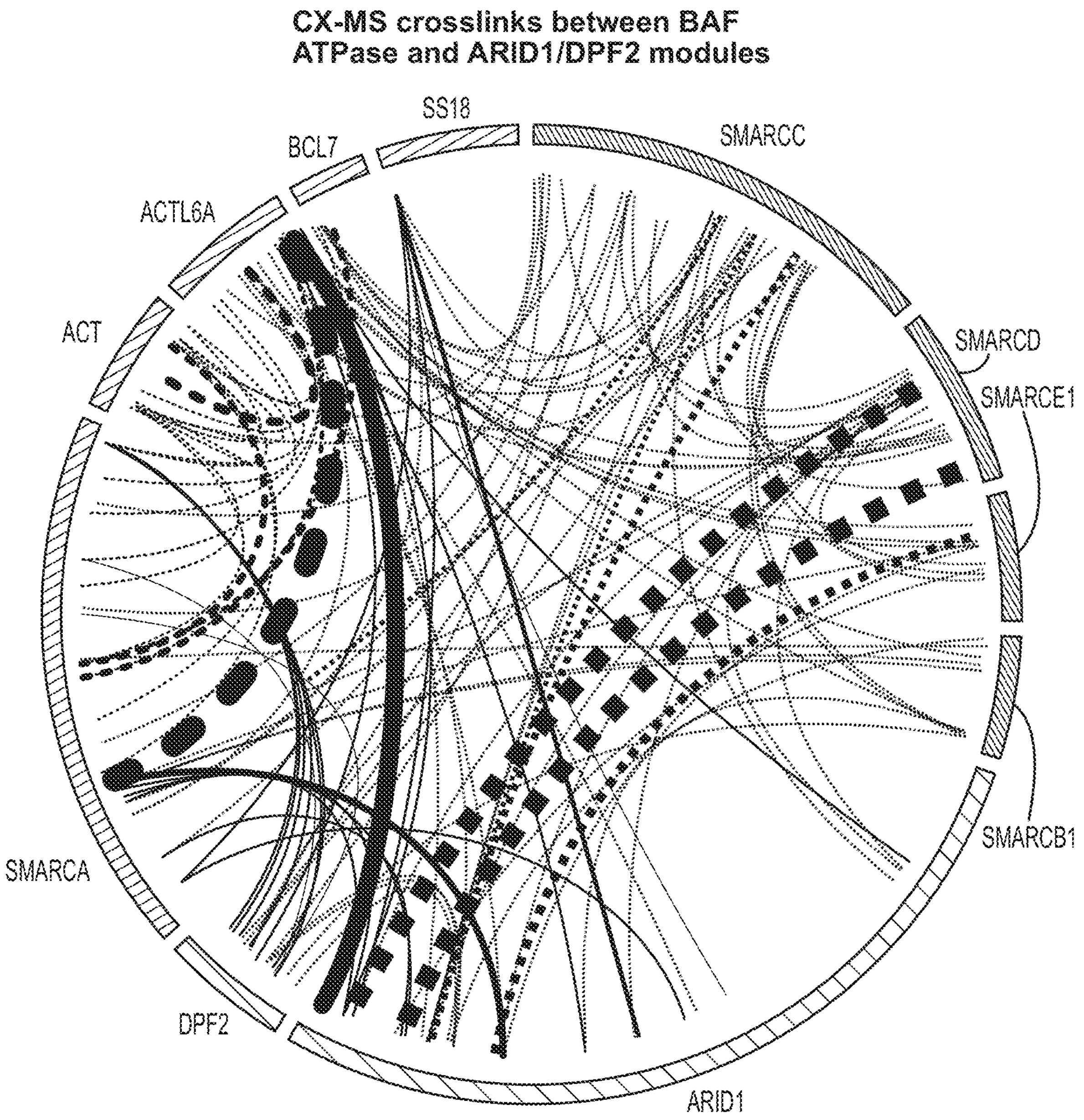
FIG. 9A-FIG. 9G show that the mSWI/SNF ATPases recruit accessory subunits and finalize BAF, PBAF, and ncBAF complex assembly.
Figure 9B:
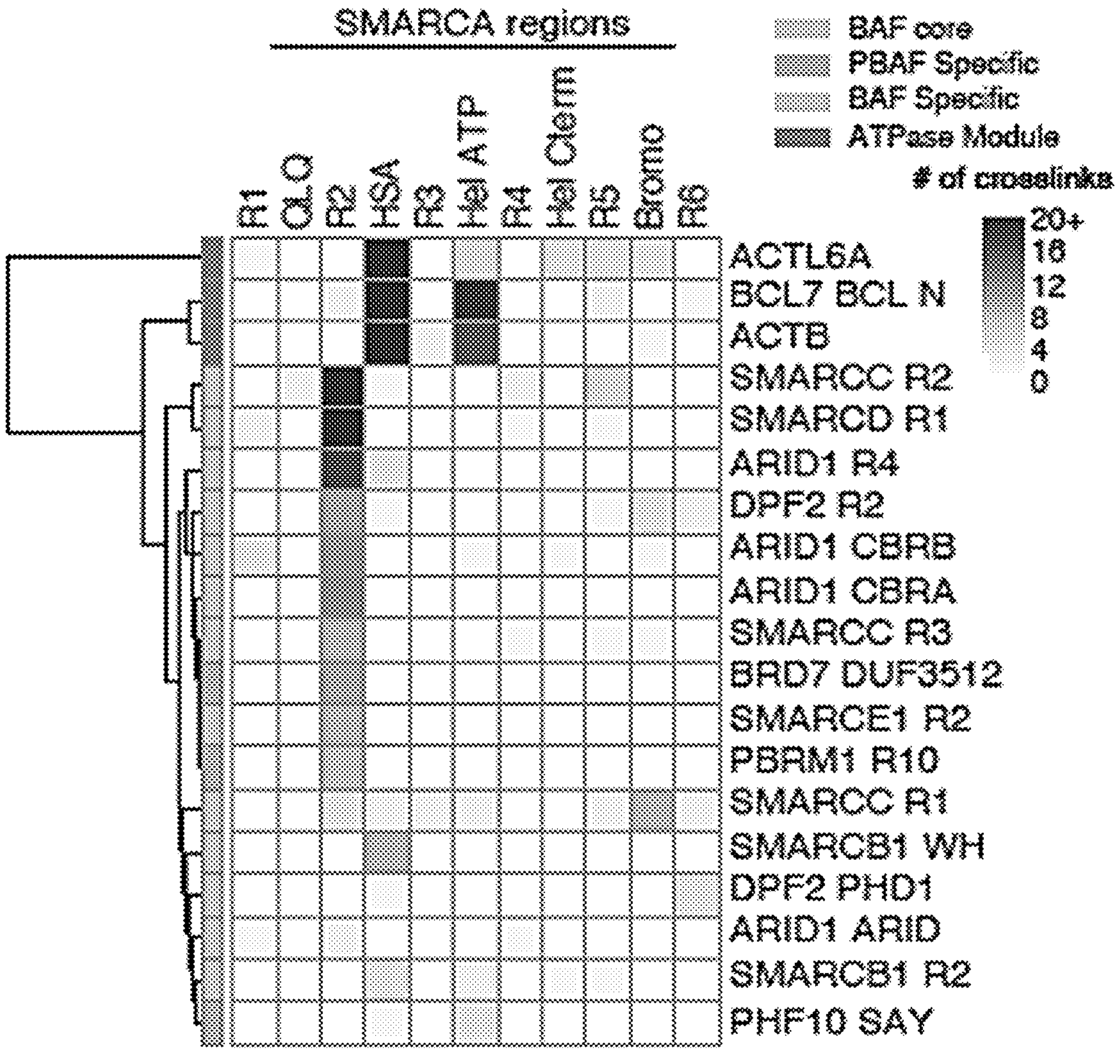
Figure 10A:
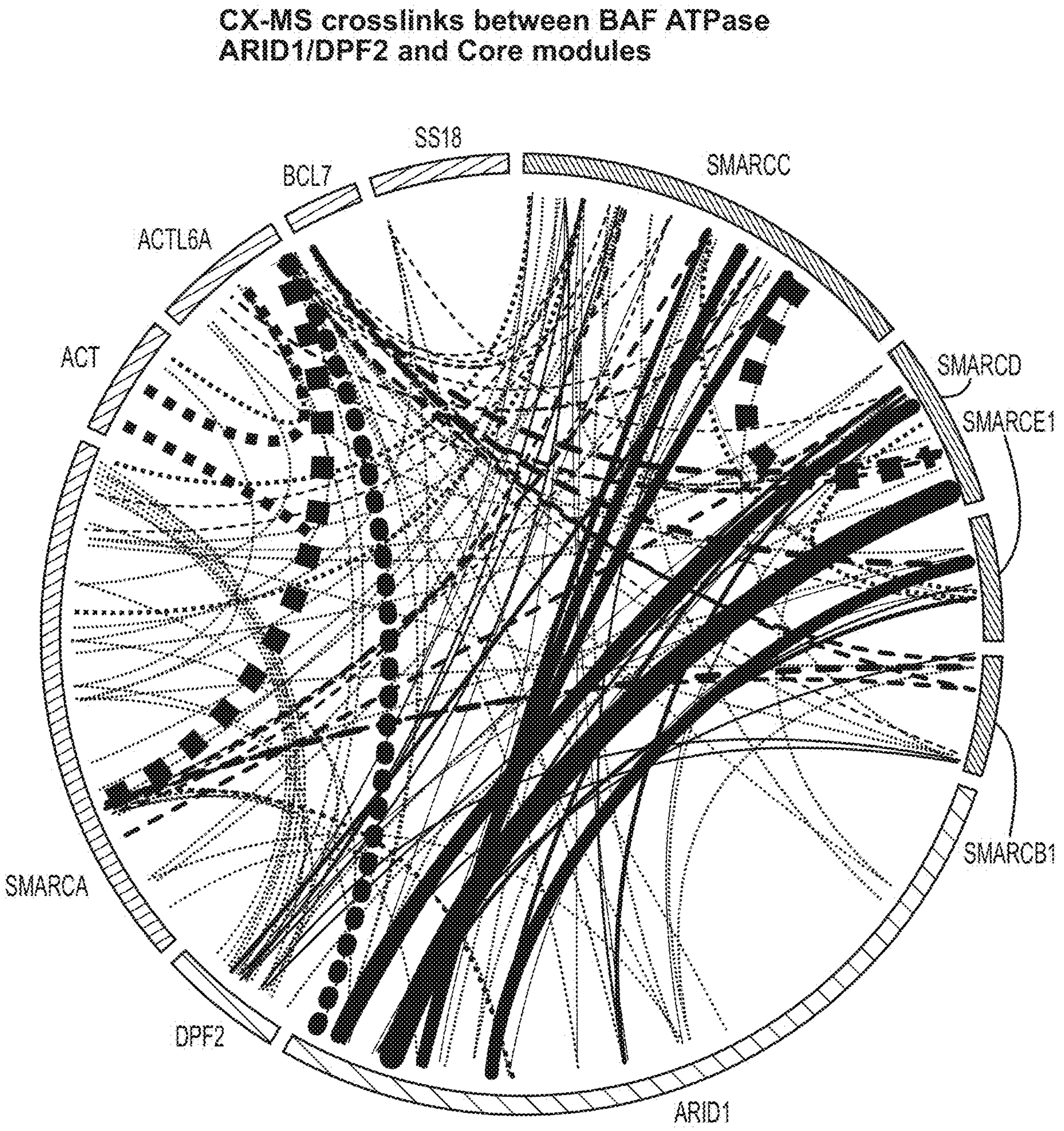
FIG. 10A-FIG. 10I show that the biochemical purifications and mass spectrometry define the mSWI/SNF ATPase module.
Figure 10B:
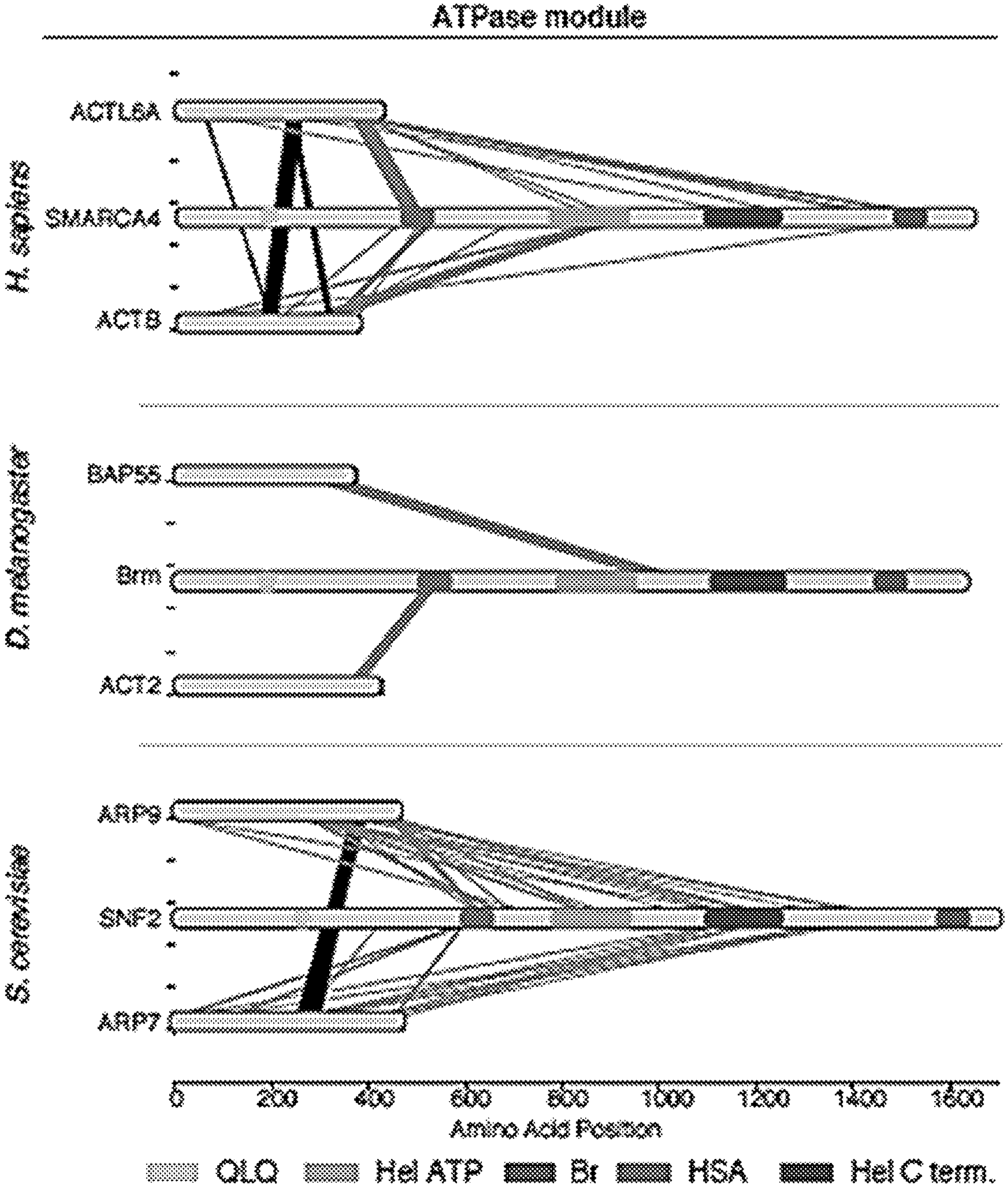

Example 6: The ATPase Module Finalizes Assembly of All Three mSWI/SNF Family Complexes SMARCA2 and SMARCA4 ATPases crosslink extensively with components previously identified to engage with the ATPase, such as β-actin and ACTL6A (Zhao et al. (1998) *Cell* 95:625-636), as well as BCL7A/B/C and SS18/SS18L1 (FIGS. 9A and 10A). Substantial crosslinks were detected between ACTL6A and β-actin and the SMARCA2/4 HSA domain, and between β-actin and ACTL6A (FIG. 9B). It was discovered herein similar interaction preferences for the actin-like proteins and the HSA and catalytic domains across species (FIG. 10B). In further support of the model in which ARID1 bridges the BAF core and ATPase modules, it was detected herein a large number of crosslinks between ACTL6A and the ARID1 C-terminal R4, as well as between SMARCA2/4 and ARID1 CBR A and B (FIG. 9B). In addition, R2 of SMARCA crosslinks with both ARID1 subunits as well as other BAF core components including SMARCC R2 and SMARCD R1. N-termini of both SS18 and BCL7 crosslink to the N-terminal R1 and HSA domains of SMARCA subunits, respectively.

Figure 9C:
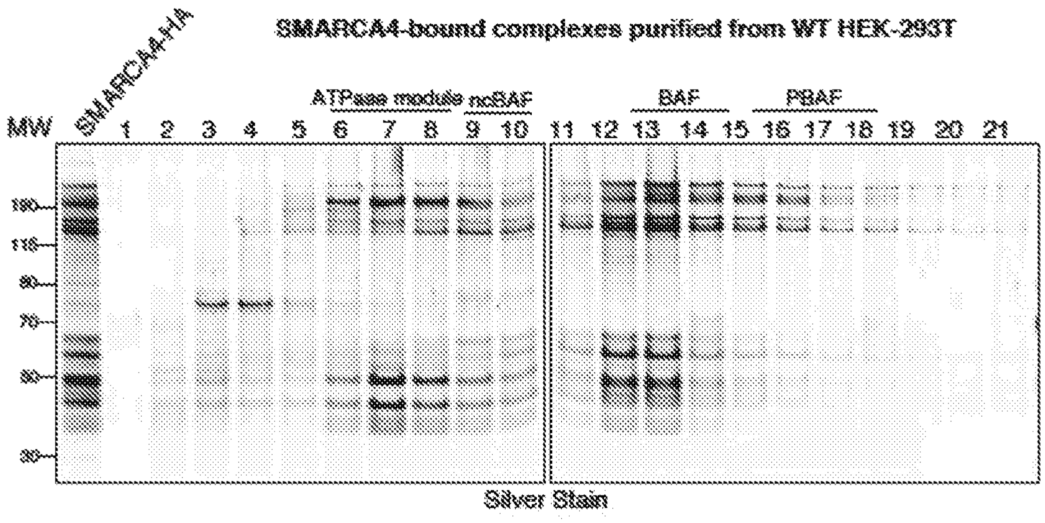
Figure 9D:
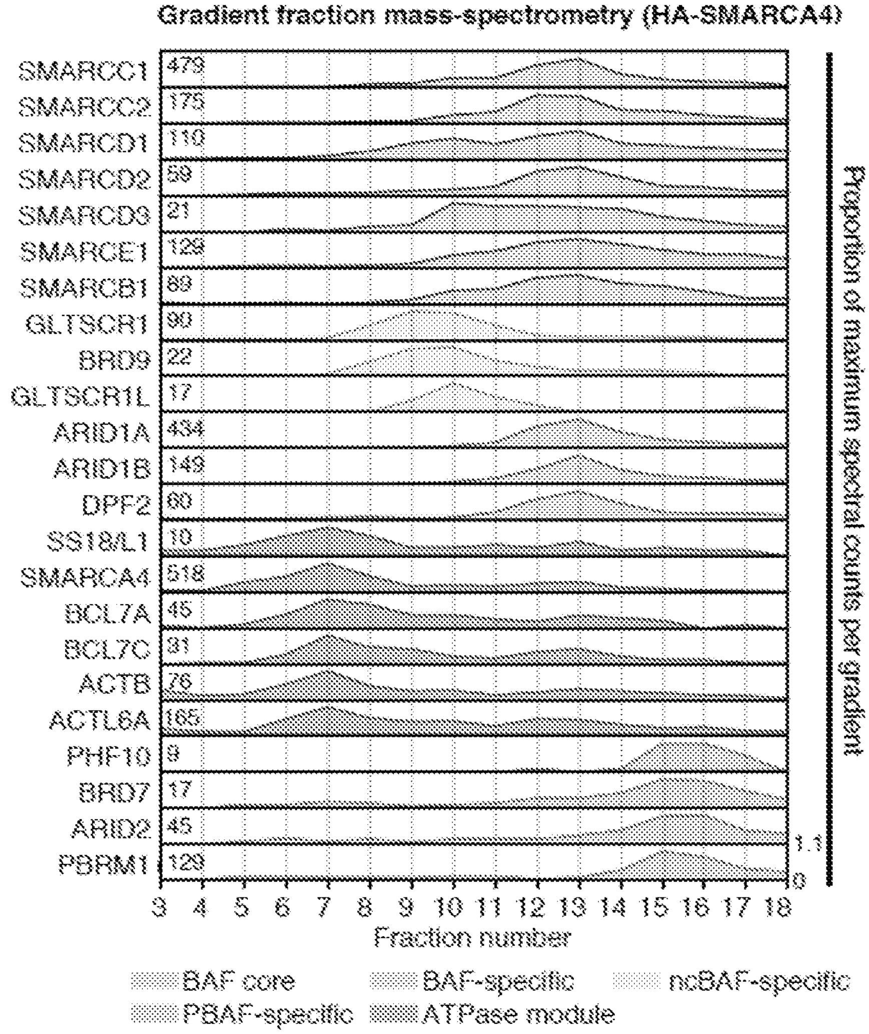
Figure 9E:
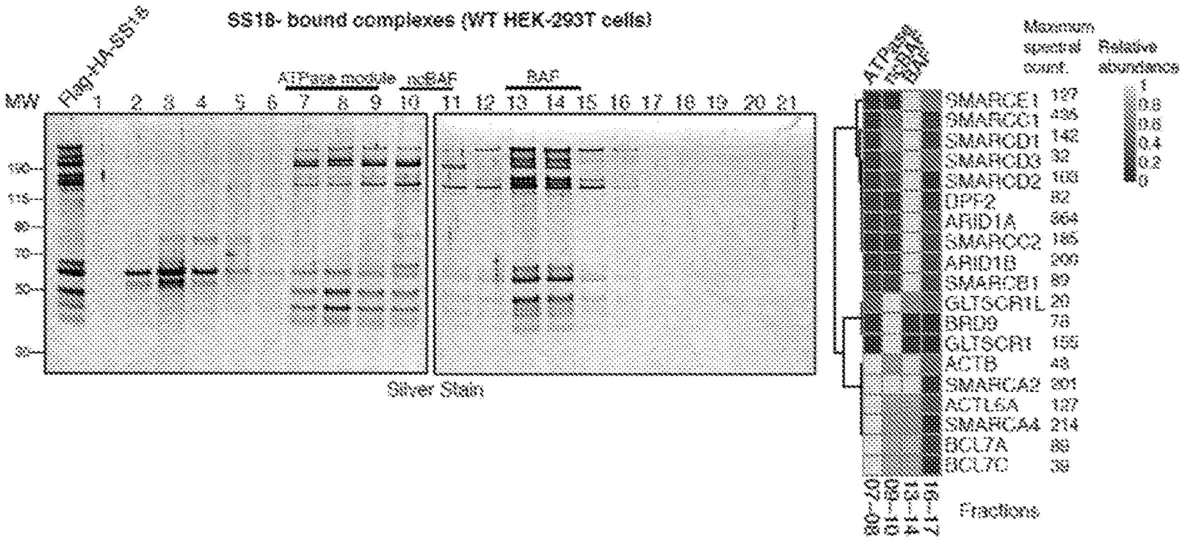
Figure 10C:
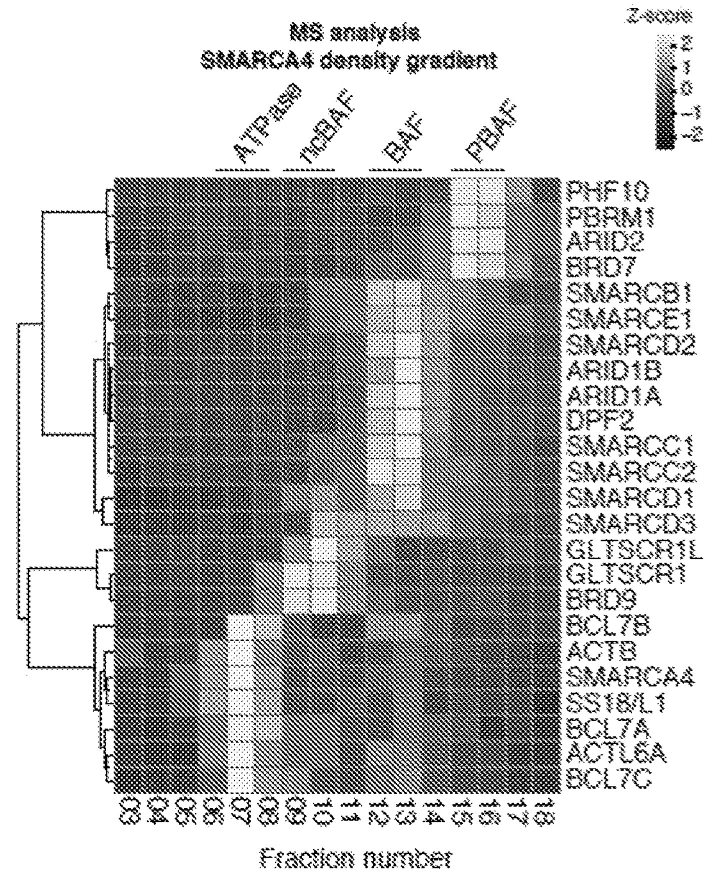
Figure 10D:
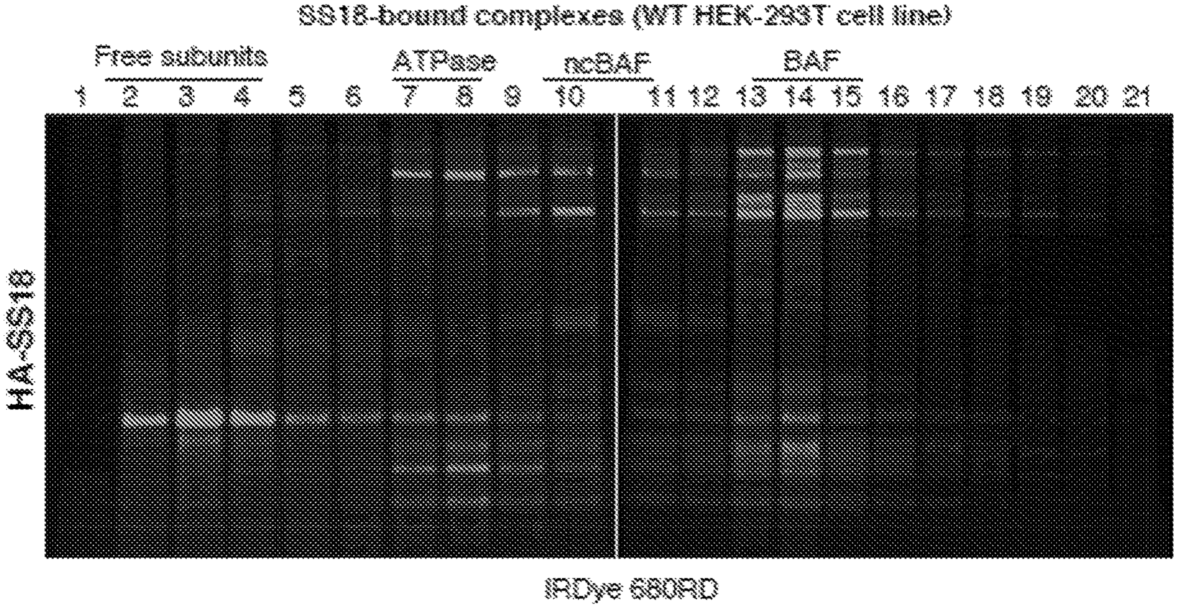
Figure 10E:
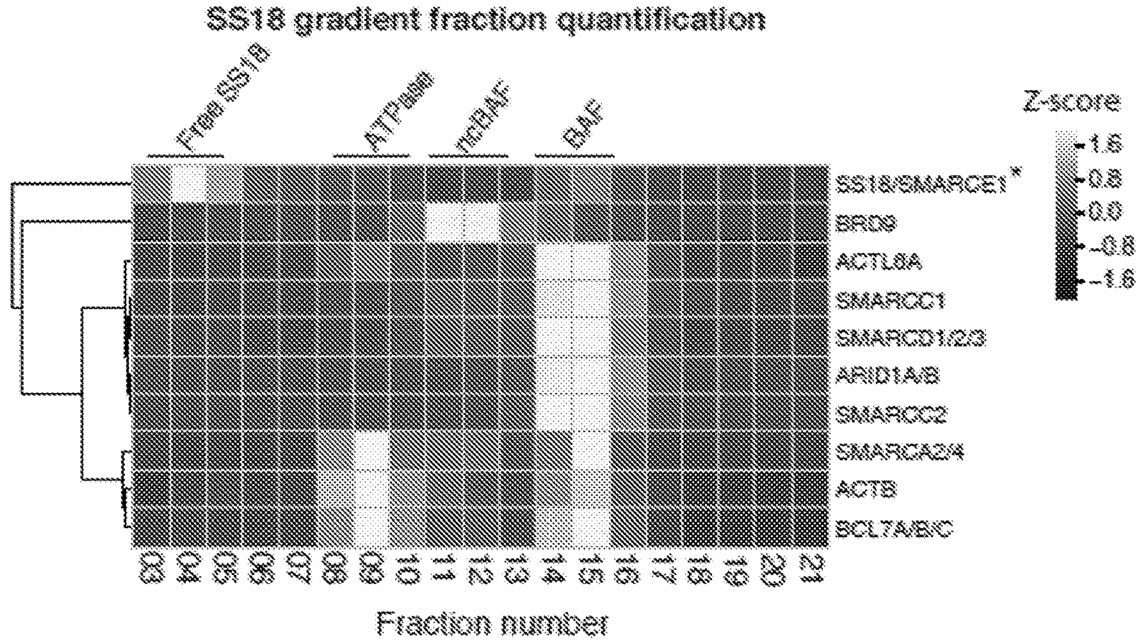
Figure 10F:
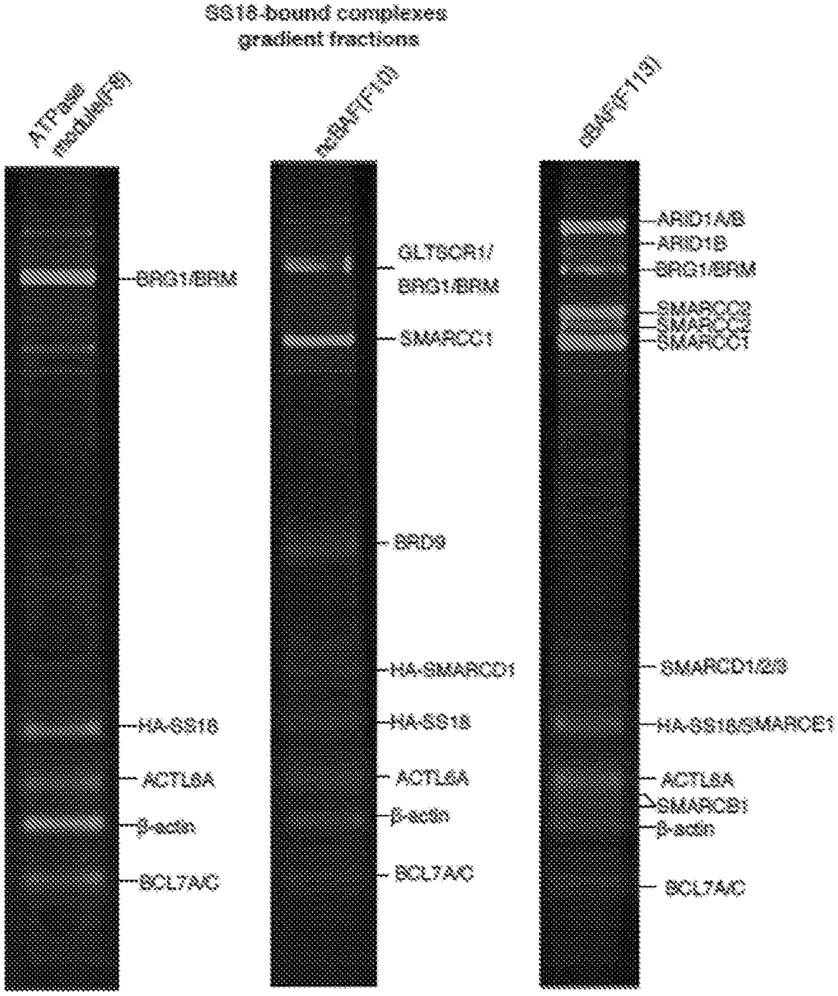

To reveal whether ATPases and their associated subunits form a separate module, SMARCA4-bound complexes were purified. Indeed, the ATPase module in Fx 6-9 was clearly separated from ATPase module-containing full BAF complexes (FIGS. 9C, 9D, and 10C). In addition to cBAF complexes, SMARCA4 purification captured components of ncBAF and PBAF in expected Fx 9-10 and 15-16, respectively.

Figure 10G:
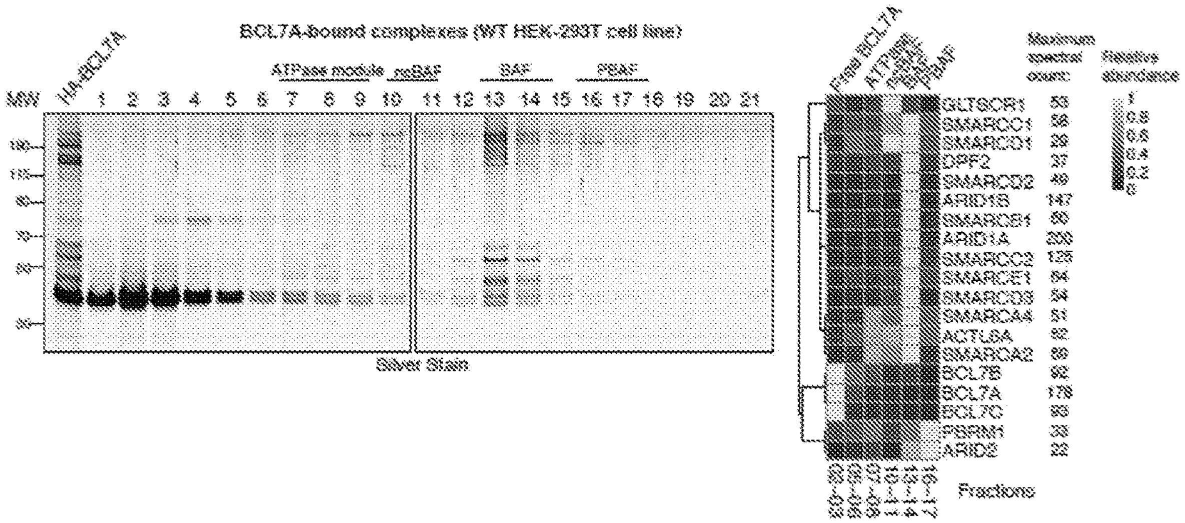

In further validation of the ATPase as a distinct module, purifications using satellite ATPase module subunits were performed. SS18-bound complexes separated on gradients in a manner similar to SMARCA4-bound complexes and captured ncBAF complexes (Fx 10-11) (FIGS. 9E and 10D-10F and Table 6N), but not PBAF subunits as SS18 does not assemble into PBAF complexes (Nakayama et al. (2017) *Nature genetics* 49:1613-1623), indicating a mutually exclusive competition between SS18 and PBAF-specific subunits such as PBRM1. BCL7 purifications resolved all three mSWI/SNF complexes in expected fractions (FIG. 10G), demonstrating that BCL7 proteins are pan-mSWI/SNF ATPase module components.

Figure 9F:
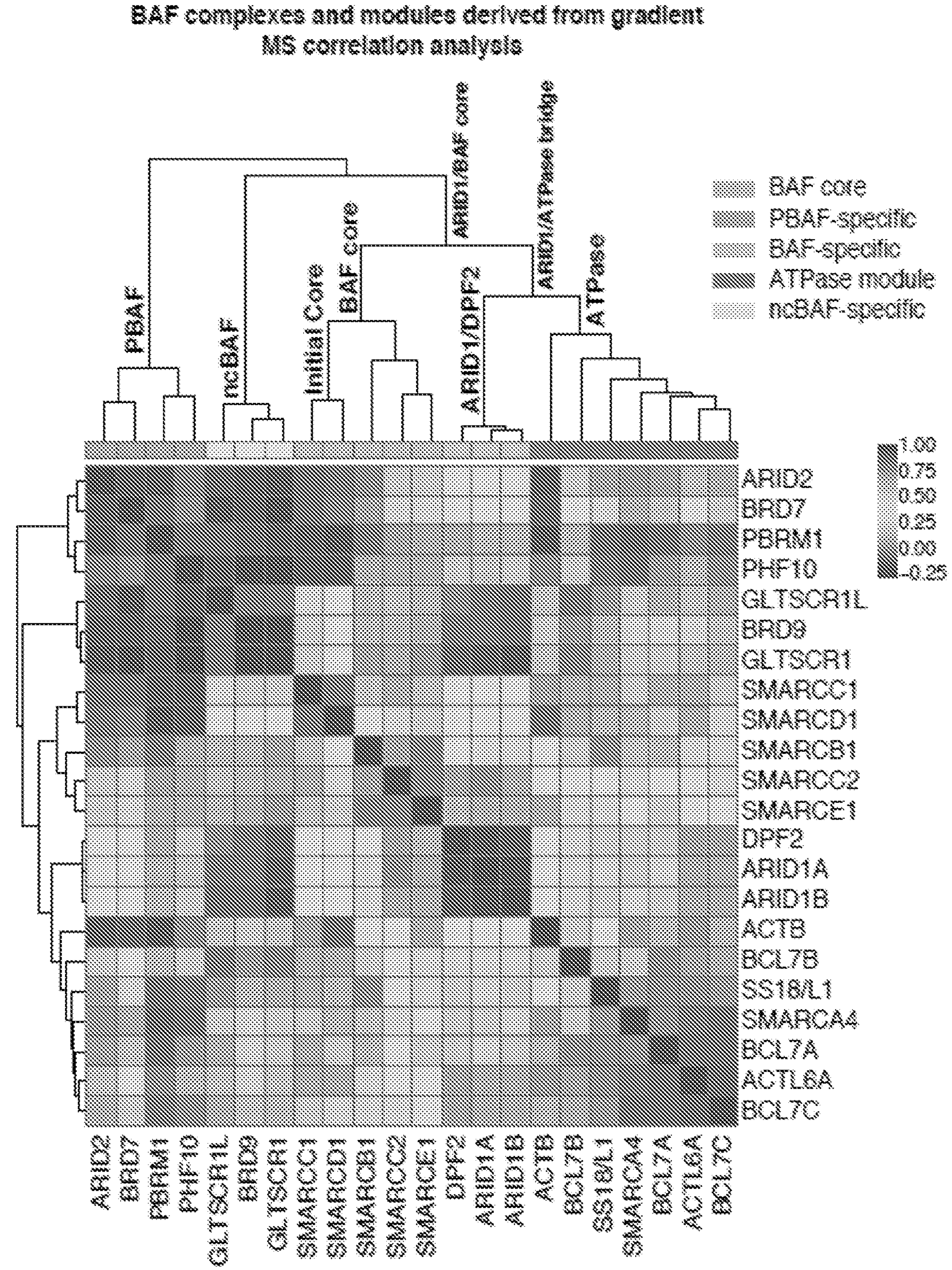
Figure 10H:
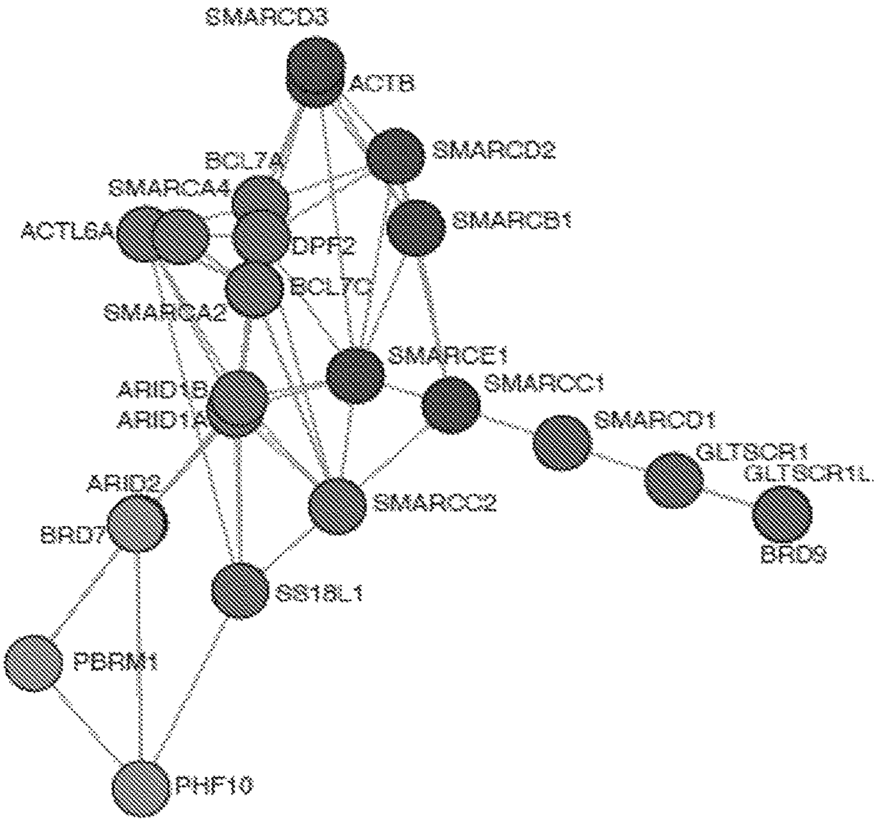
Figure 10I:
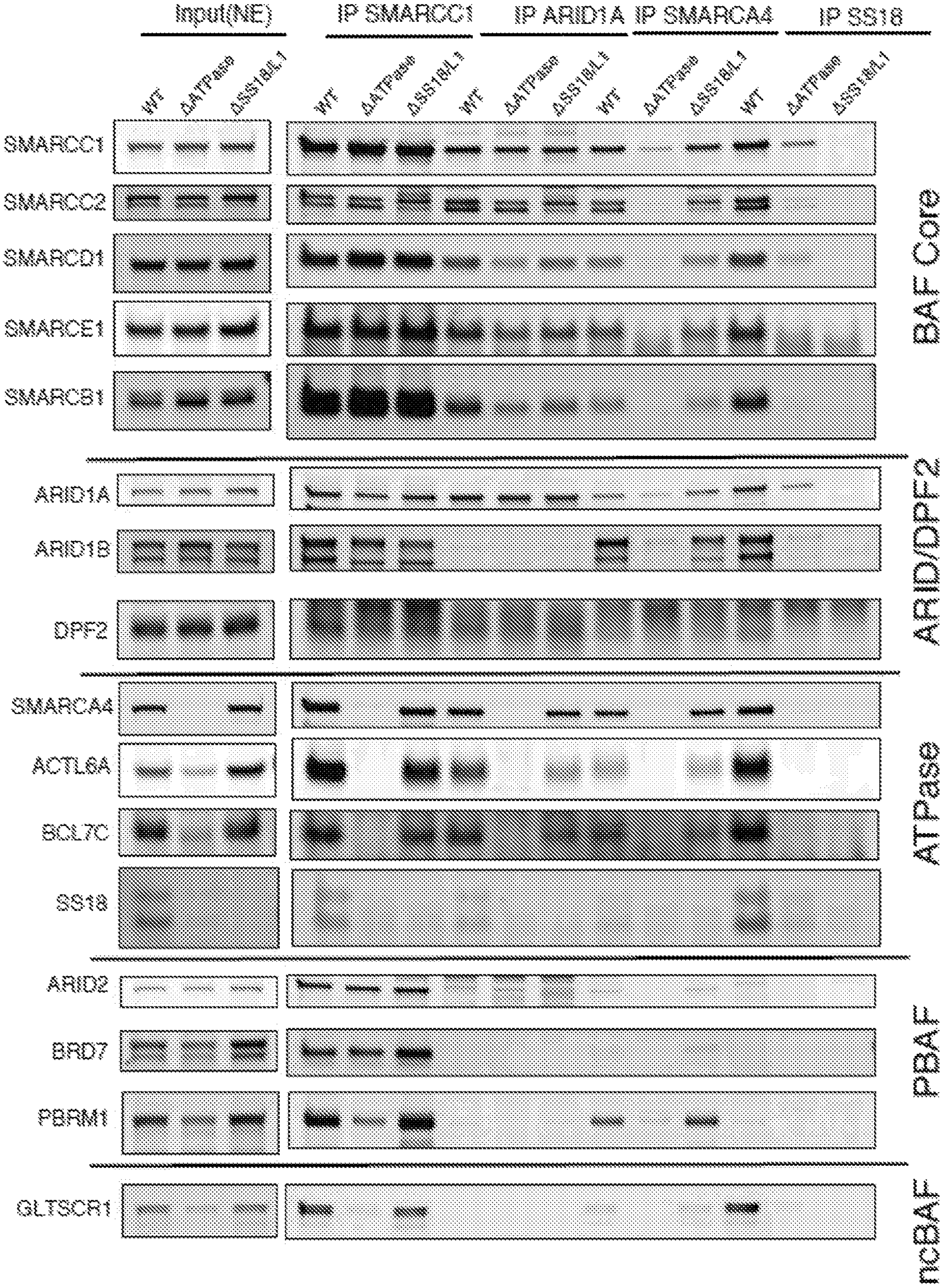

Louvain modularity analysis performed on MS datasets from SMARCD1, SMARCB1 and SMARCA4 purifications showed clear separation of core BAF, ATPase, and ARID modules, as well as separation between PBAF and ncBAF as branches connected to the main group of subunits through ARID2 and SMARCD1, respectively (FIGS. 9F and 10H). Co—IP and immunoblot of endogenous complexes from SMARCA2/4 KO HEK293T cells indicated intact assembly of the BAF core and ARID/DPF2 modules, but a marked and specific loss of ATPase module stability and interaction (FIG. 10I). SS18/SS18L1 double-KO cells displayed no assembly defects, apart from a general increase in PBAF complex abundance, corroborating the competition model above.

Figure 9G:
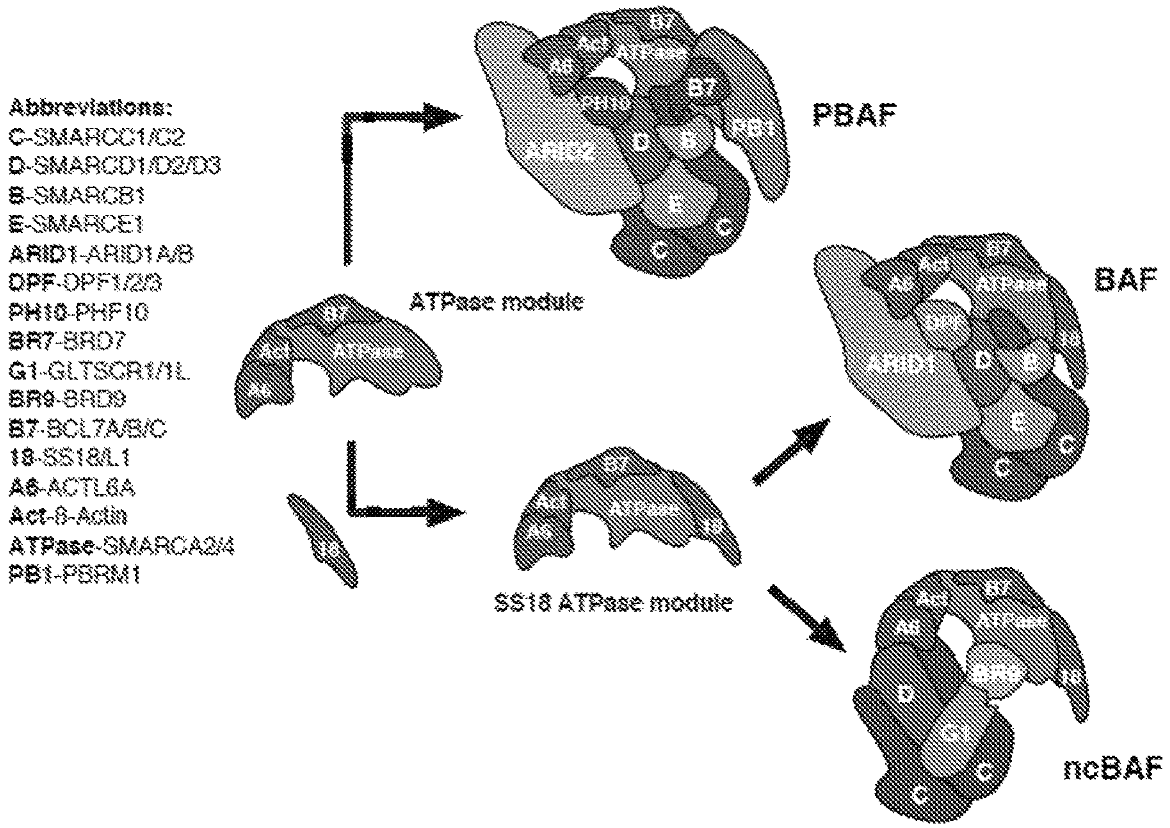

Owing to the lack of intermediate ATPase subcomplexes, it is herein concluded that each of the components of this module binds independently to the large SMARCA platform, which is then incorporated as a unit into pre-assembled BAF, PBAF, and ncBAF subcomplexes. It is herein defined a split in assembly of the ATPase modules that differs between BAF, ncBAF and PBAF, as SS18-containing complexes contained only BAF and ncBAF components, but were devoid of PBAF components. These data demonstrate that the final step of mSWI/SNF complex assembly is controlled by both specific components of the core BAF modules as well as the elements of the ATPase subcomplex components, SS18 and PBRM1 (FIG. 9G).

Figure 11A:
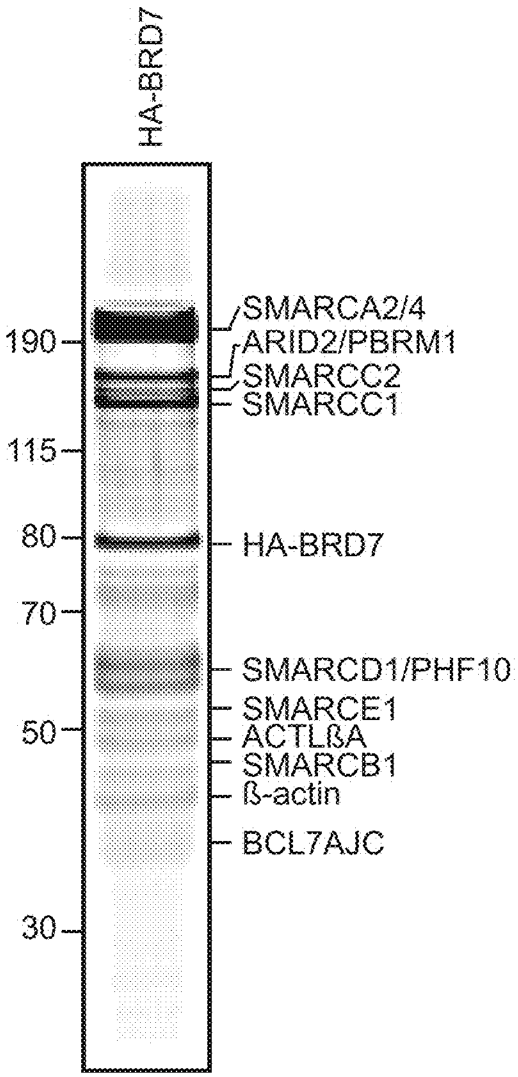
FIG. 11A-FIG. 11J show the cross-linking mass-spectrometry analysis of PBAF complexes.
Figure 11A:
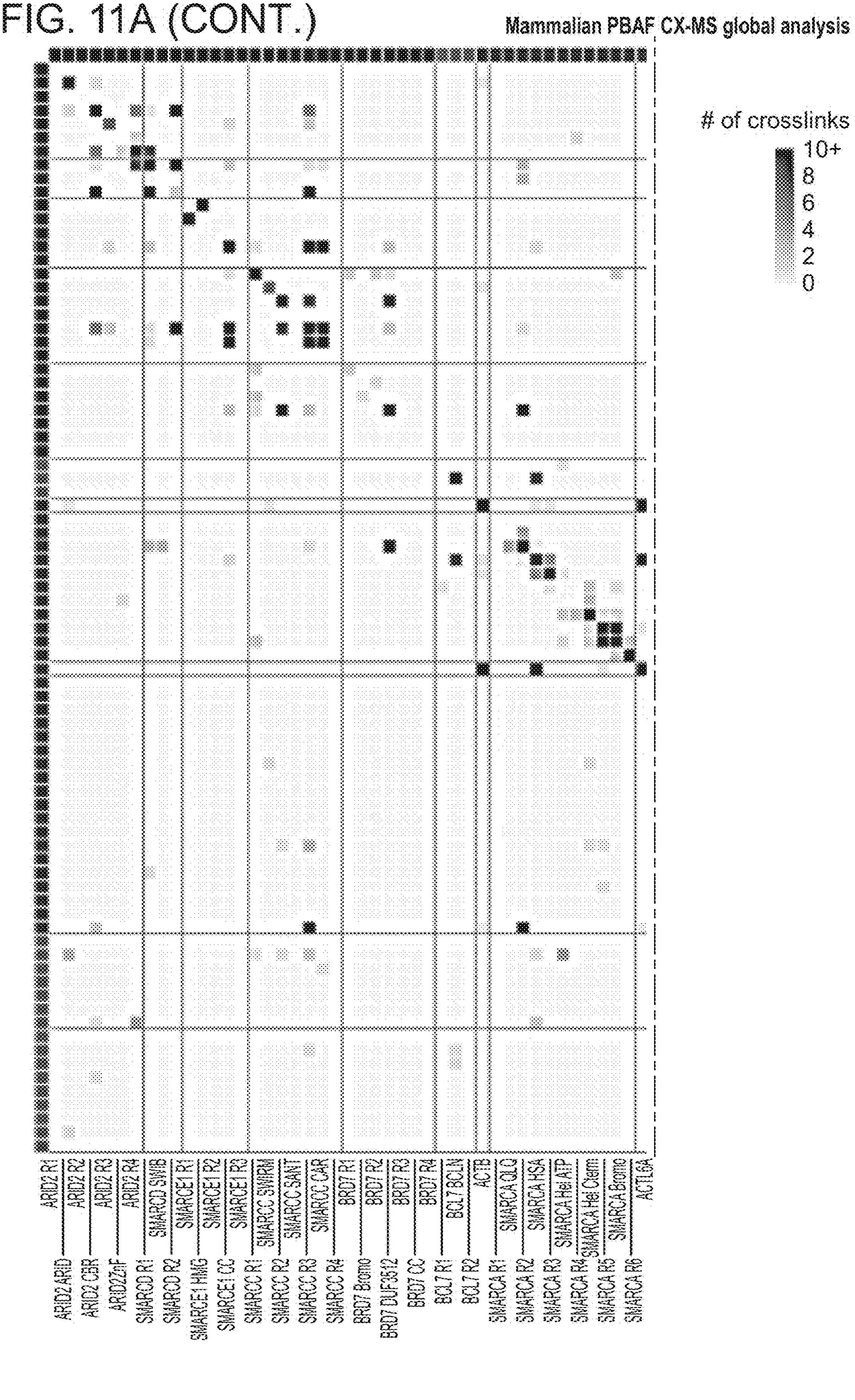
Figure 11A:
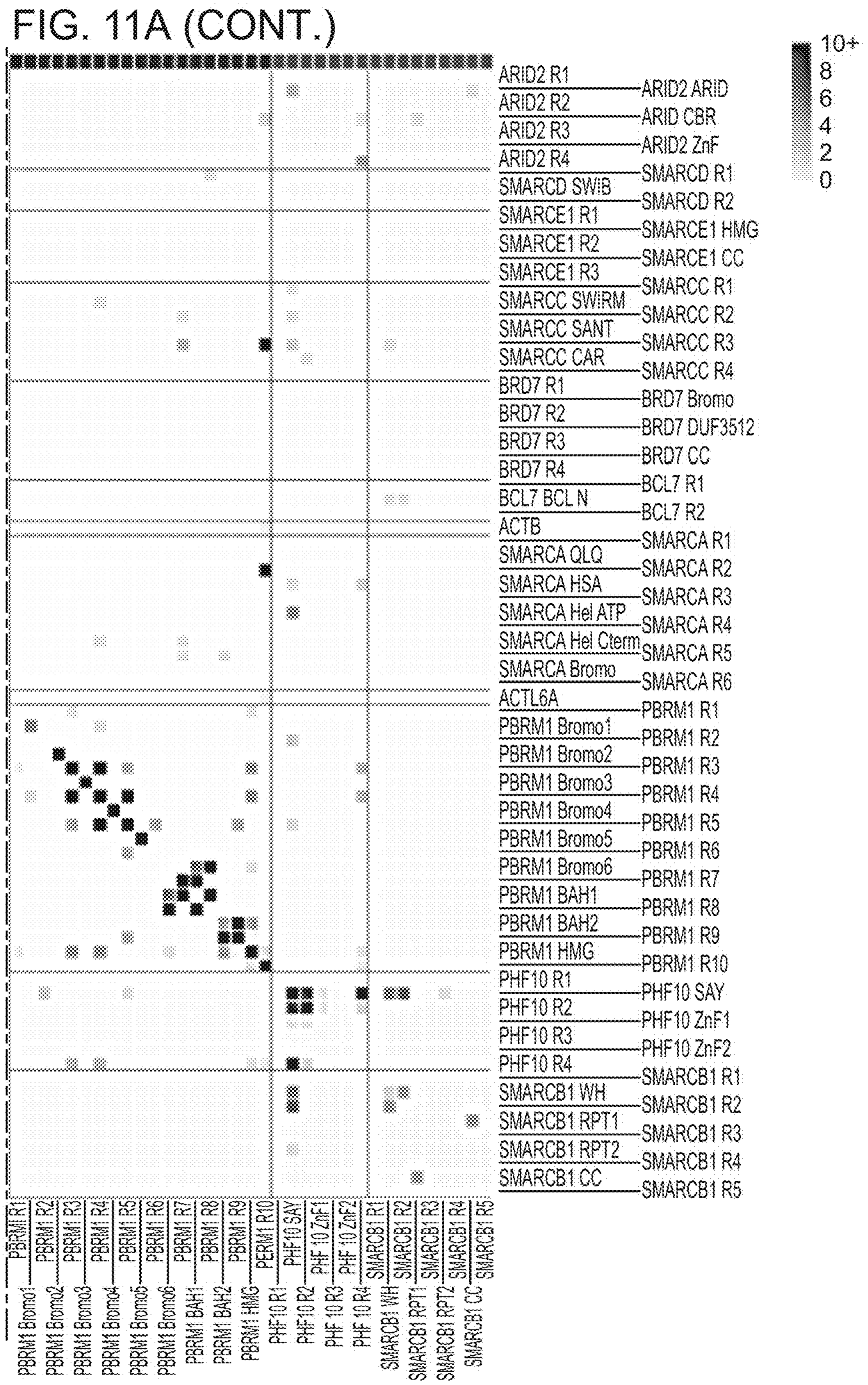

Example 7: Assembly of PBAF and ncBAF Complexes and the Global Mammalian SWI/SNF Assembly Pathway To define the assembly and inter-subunit linkages of PBAF complexes, CX-MS on BRD7- and PHF10-bound complexes was performed, confirming that PBAF complexes contain the same common BAF core module as BAF complexes (FIG. 11A and Tables 10A-10D). It is detected herein PBAF intermediates containing the BAF core module, ARID2, BRD7 and PHF10 (FIG. 7G). PBAF assembly is initiated by ARID2, since its loss completely disrupts PBAF complex assembly (FIG. 8K). In order to dissect the last steps of PBAF assembly, ARID2-bound complexes were purified using a mini version of ARID2 predicted by CX-MS to bind PBAF (mARID2, aa 1-626 fused to C-terminal aa1592-1835). mARID2 displayed increased expression levels compared to full-length ARID2, sufficient to purify protein complexes (FIG. 12A and Table 6Q). Fully-formed PBAF complexes were observed in Fx 15-17 and partial assemblies were observed in Fx 12-13, with PBRM1 being the only subunit absent in PBAF subcomplex fractions, indicating that it requires full-length ARID2, other PBAF-specific subunits and the ATPase module for its incorporation. Finally, PBRM1-bound PBAF complexes migrated in Fx 15-17. MS analysis did not identify any PBRM1-containing intermediate complexes apart from its free form in Fx 2-3 (FIG. 12B), demonstrating that PBRM1 is one of the last subunits to be added to the PBAF complex via cross-linking of its C-terminus to both SMARCC and ATPase module subunits as determined by CX-MS (FIG. 11B and Tables 10A-10D).

Figure 11B:
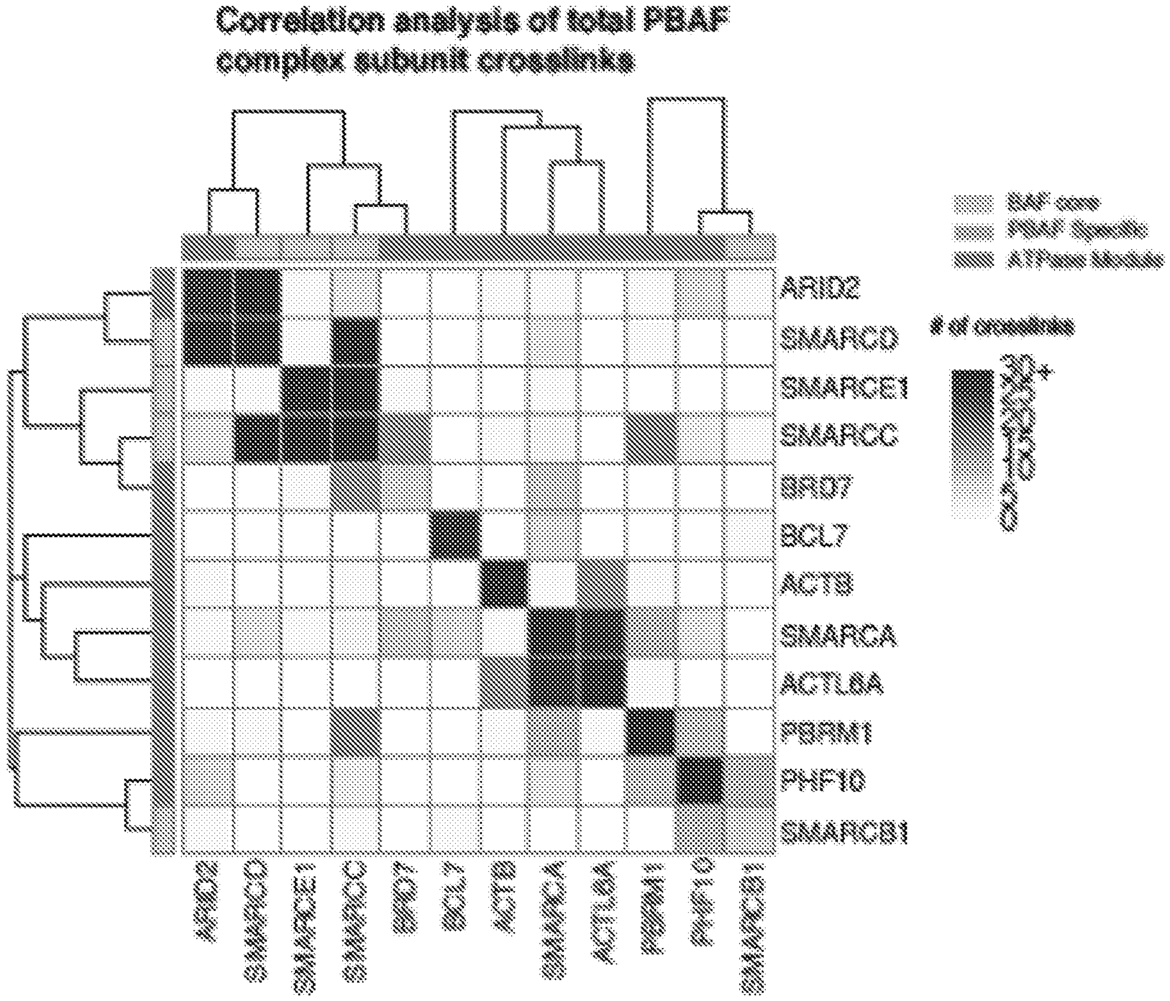
Figure 11C:
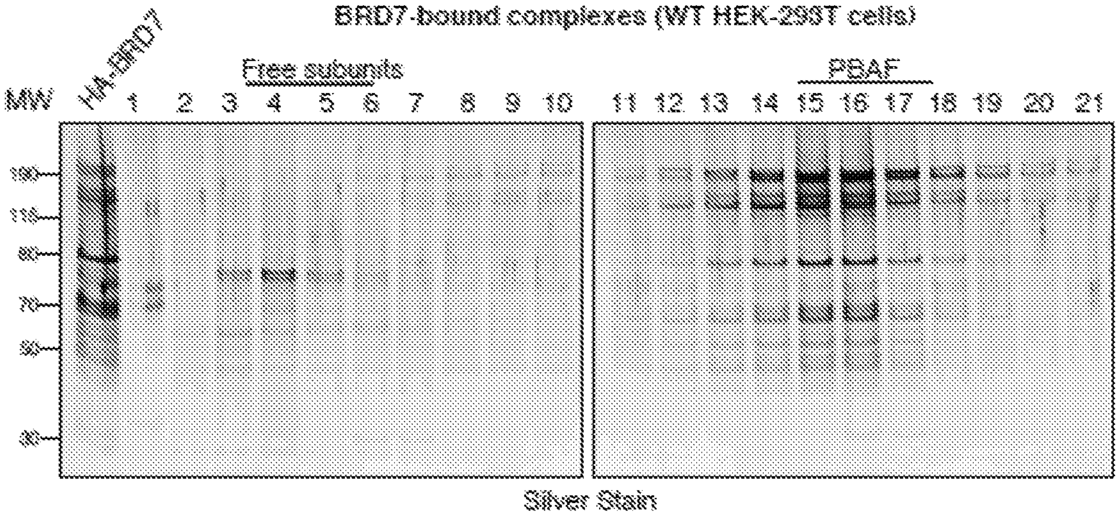
Figure 11D:
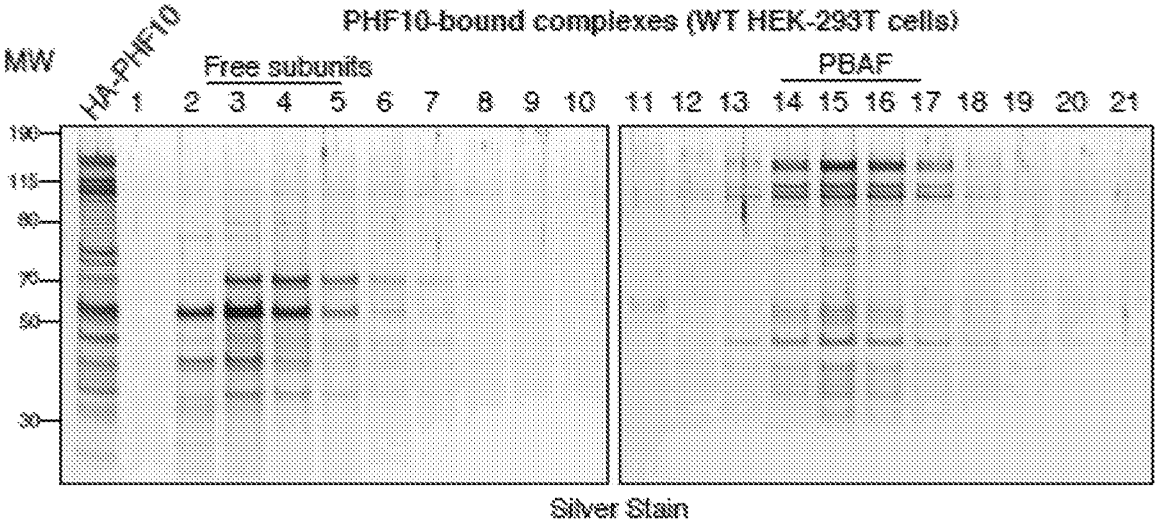
Figure 11E:
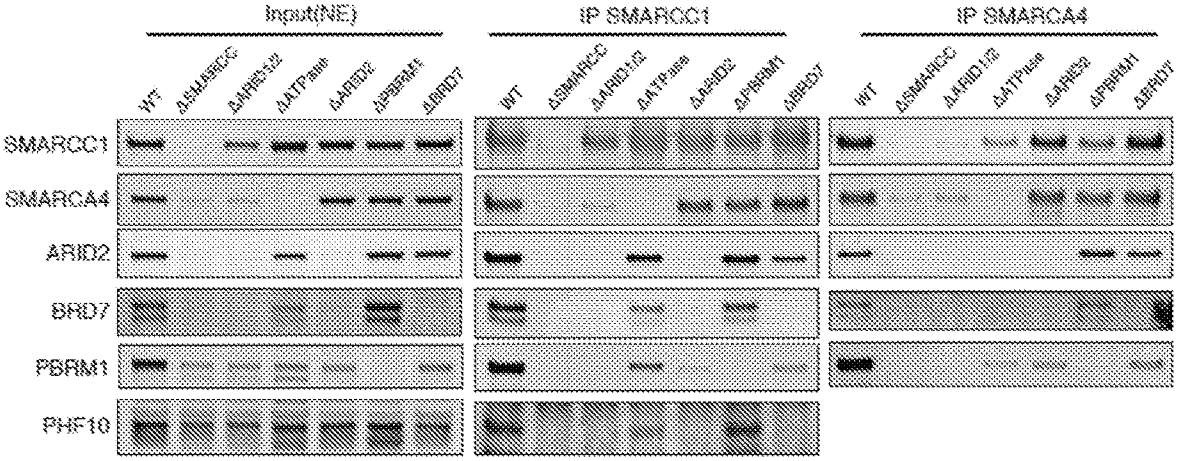
Figure 11F:
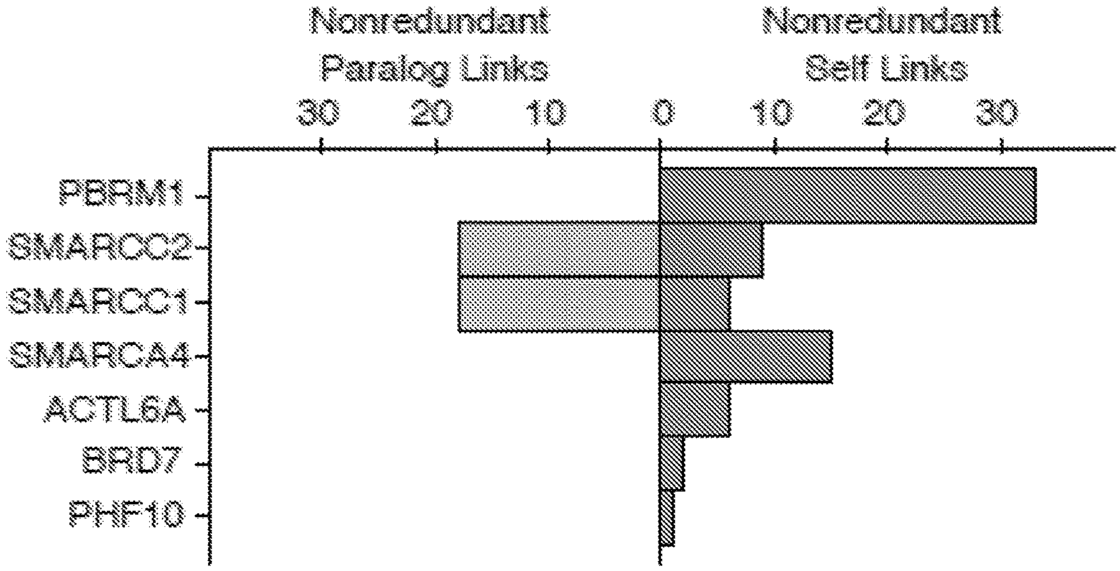
Figure 11G:
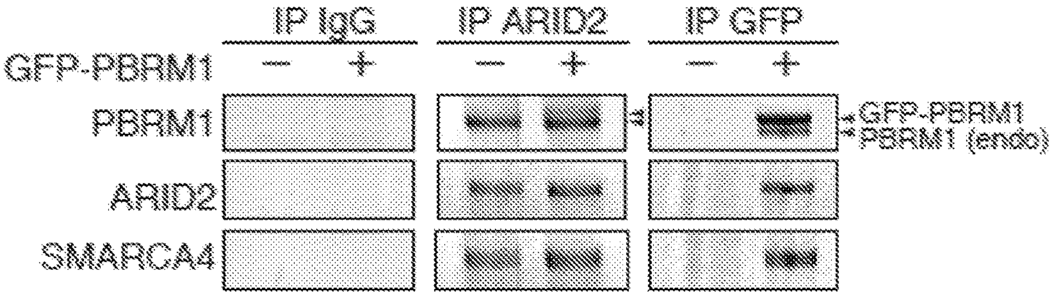
Figure 11H:
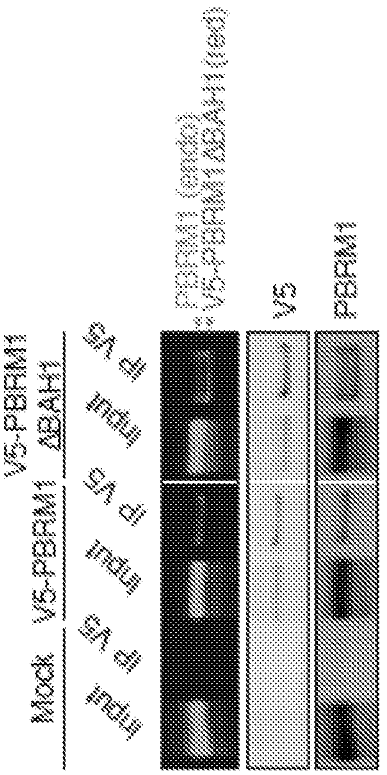
Figure 12A:
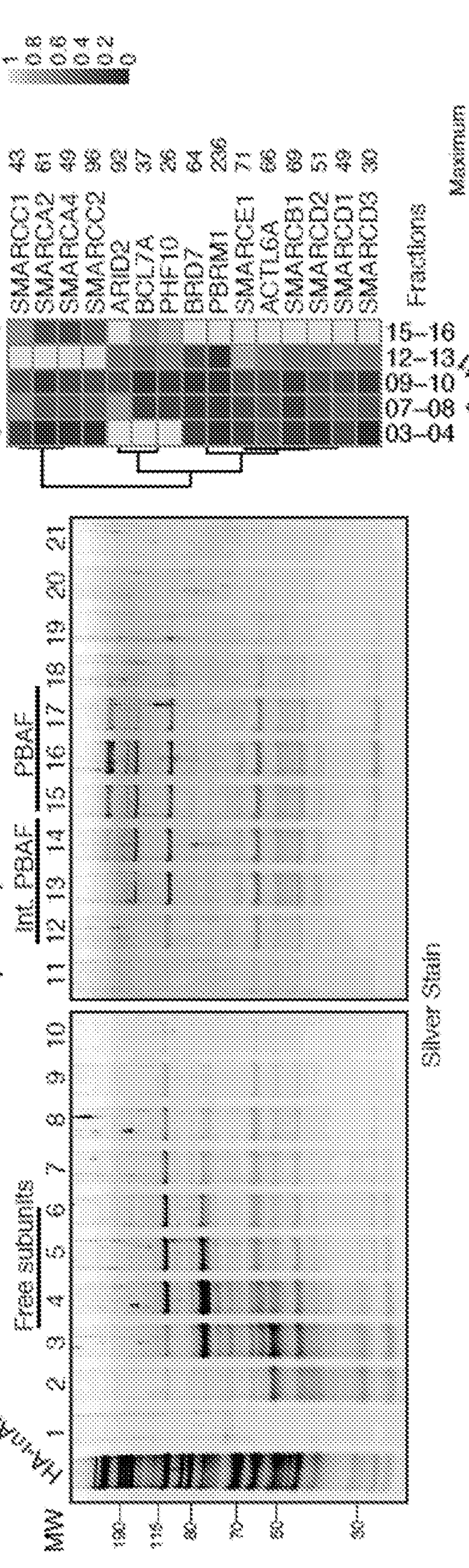
FIG. 12A-FIG. 12G show the assembly of alternative mSWI/SNF complexes, PBAF and ncBAF, and the full assembly pathway.
Figure 12B:
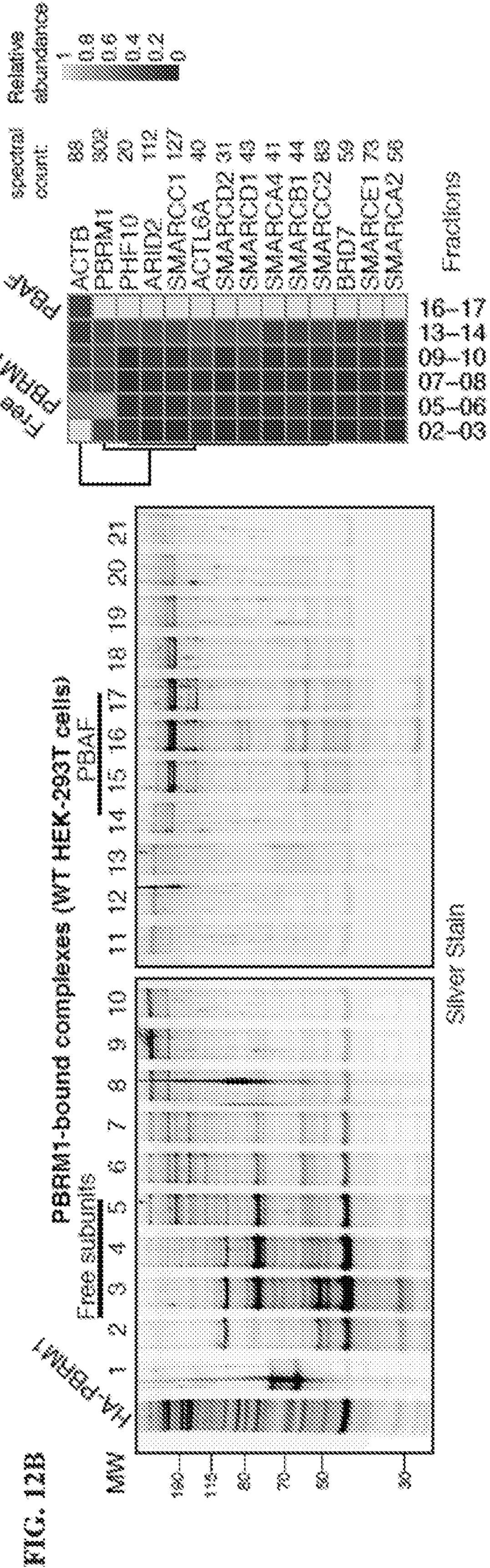
Figure 12C:
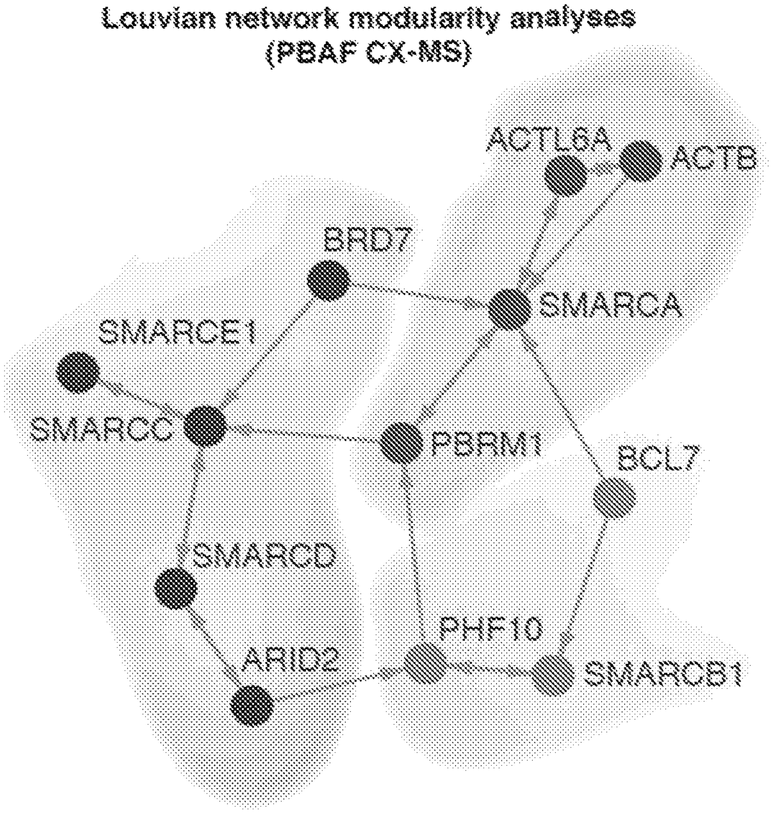

ATPase and BAF core modules were similar to those of cBAF complexes, while interestingly, PBAF-specific subunits such as BRD7 and PBRM1 associated with both the BAF core and ATPase modules (FIGS. 11B and 12C). Purification of two other PBAF specific subunits, BRD7 and PHF10, yielded only full complexes without intermediates (FIGS. 11C and 11D). Co-IP of PBAF component KO cell lines proved to be more informative regarding the order of integration of these subunits (FIG. 11E). Loss of ARID2 resulted in loss of stability of BRD7, PBRM1, and PHF10, confirming the early role for ARID2 in PBAF assembly. BRD7 deletion minimally impacted ARID2 stability but strongly affected both PHF10 and PBRM1 interactions. Finally, PBRM1 deletion had no effect, implicating this subunit as the last to assemble into PBAF complexes. Surprisingly, significant enrichment in self crosslinks within PBRM1 was found, demonstrating its multimerization within PBAF complexes (FIG. 11F), and this finding was confirmed using biochemical approaches with tagged PBRM1 variants (FIGS. 11F-11H).

Figure 11I:
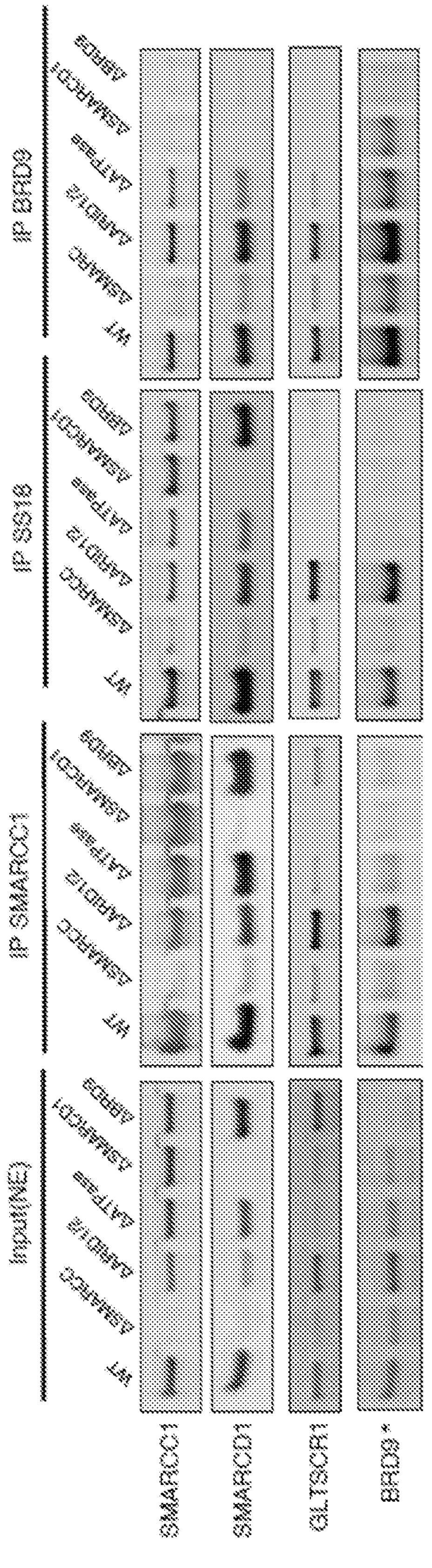
Figure 12D:
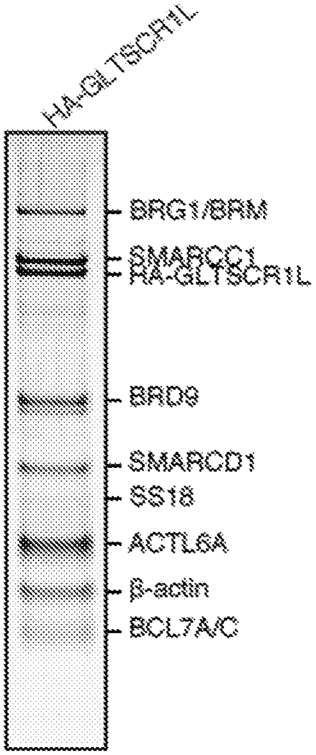
Figure 12E:
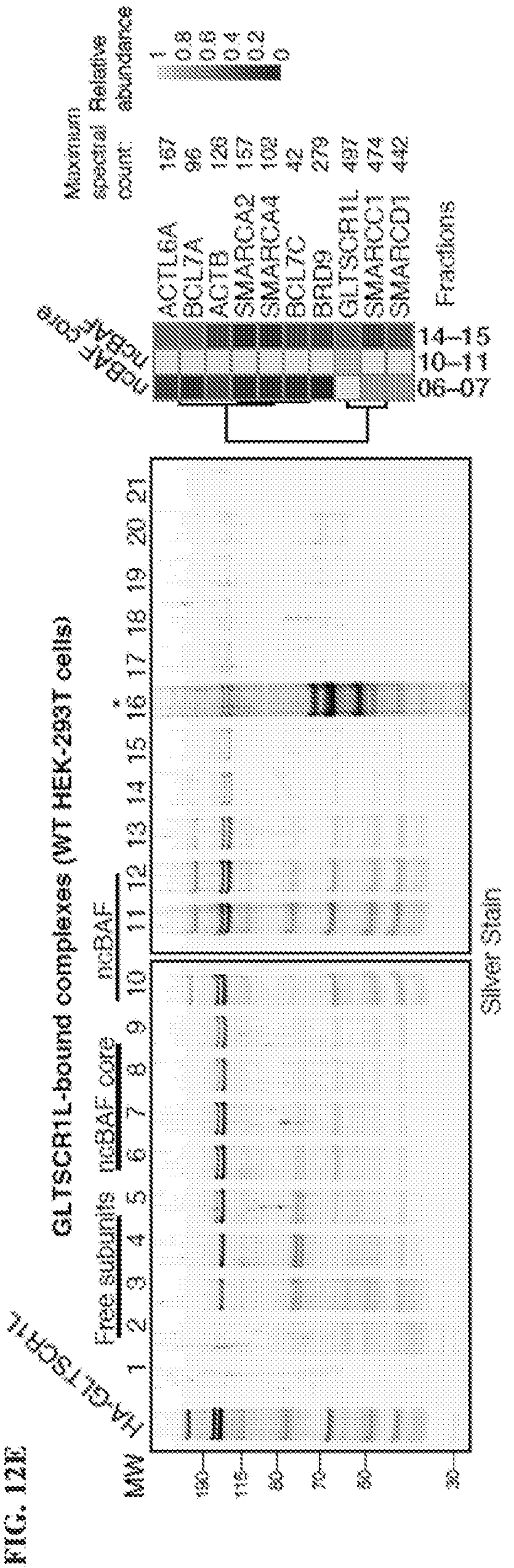
Figure 12F:
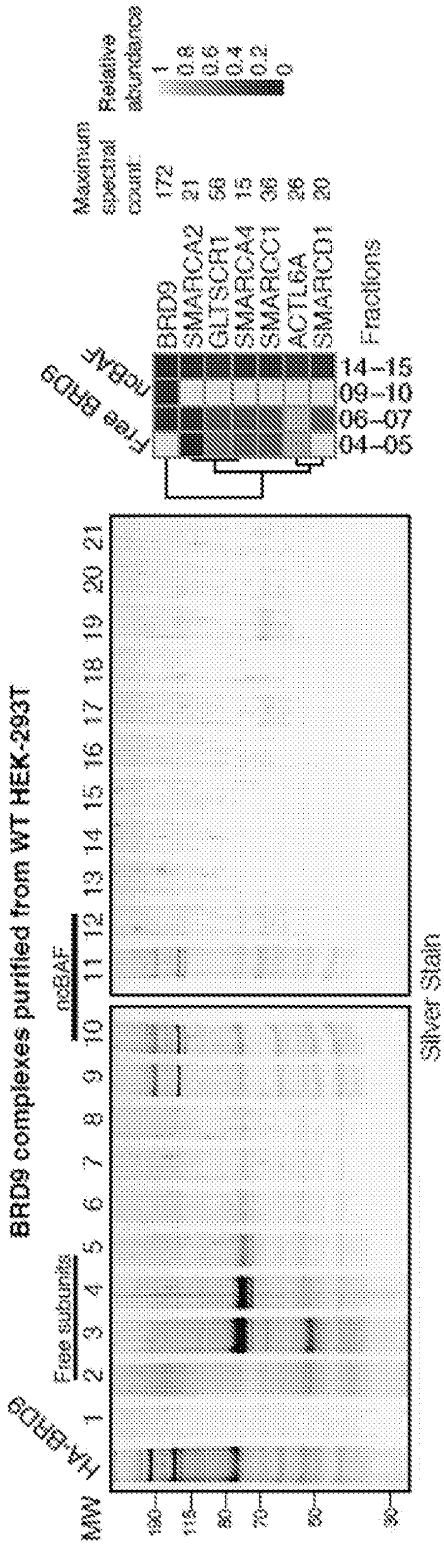

To finalize the composition and assembly of ncBAF complexes, GLTSCR1L- and BRD9-containing complexes were purified. It was identified herein complexes containing initial core SMARCC1/D1 subunits, ATPase module components, and BRD9; however, no other core subunits (SMARCC2, SMARCD2/3, SMARCEL or SMARCB1) were identified (FIGS. 12D and 12E). GLTSCR1L purification resolved full ncBAF complexes in Fx 10-11 and subcomplexes in fractions 6-7 (FIG. 12E), highlighting the ncBAF core of SMARCC1, SMARCD1 and GLTSCR1L, the same components identified in the SMARCD1 purification from ΔATPase cells (FIG. 7G). BRD9 purification captured the full ncBAF complex in fractions 9-11, but failed to resolve subcomplexes, indicating that BRD9 functions similarly to BRD7 by forming partial assemblies that result in immediate incorporation of the ATPase module (FIGS. 7G, 11C, and 12F). Loss of BRD9 had no effect on SMARCD1, while BRD9 and GLTSCR1 stability were substantially impacted in SMARCD1 KO cells, substantiating the early assembly order and the critical role for SMARCD1 in the nucleation of all three mSWI/SNF family complexes (FIG. 11I).

Figure 11J:
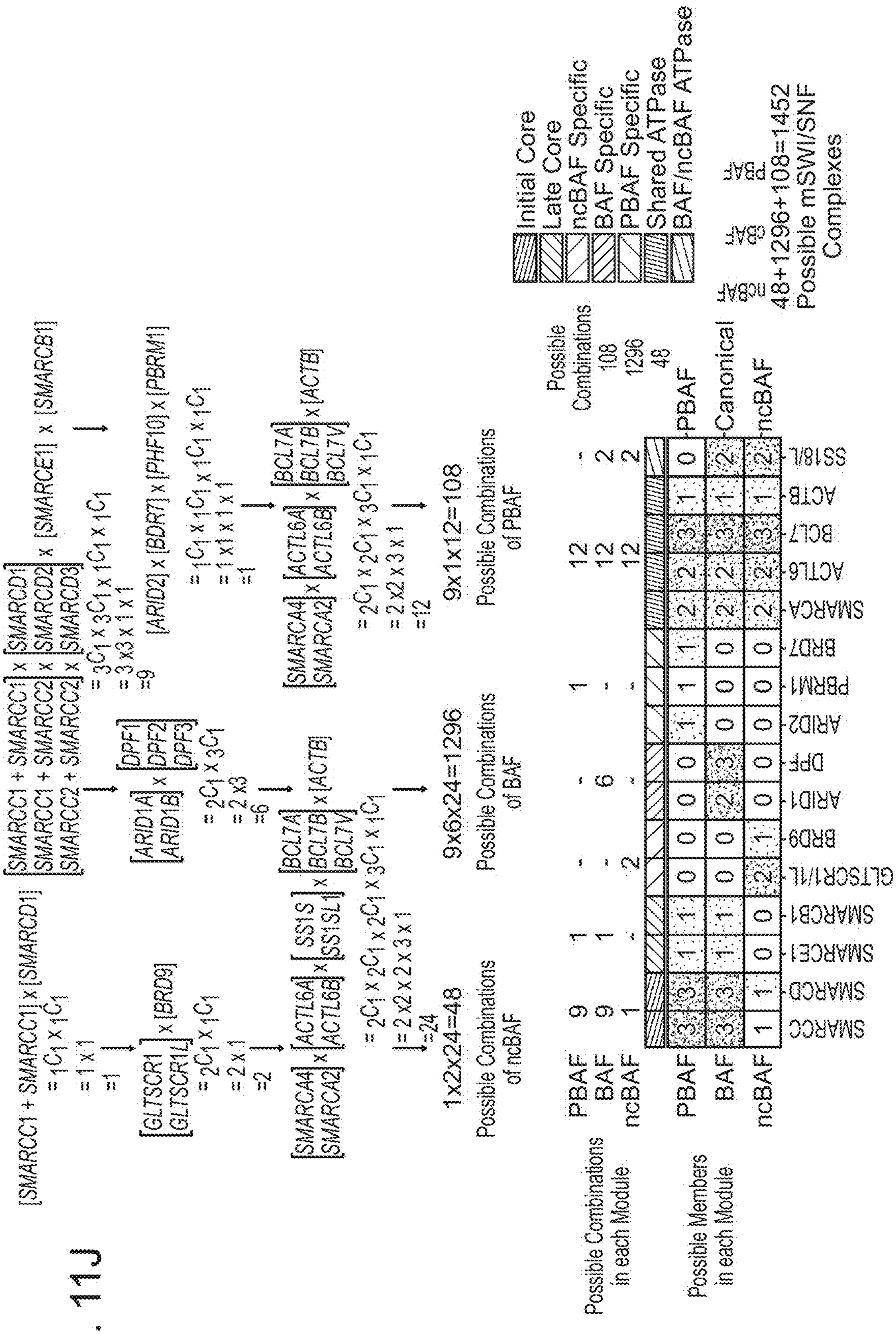
Figure 12G:
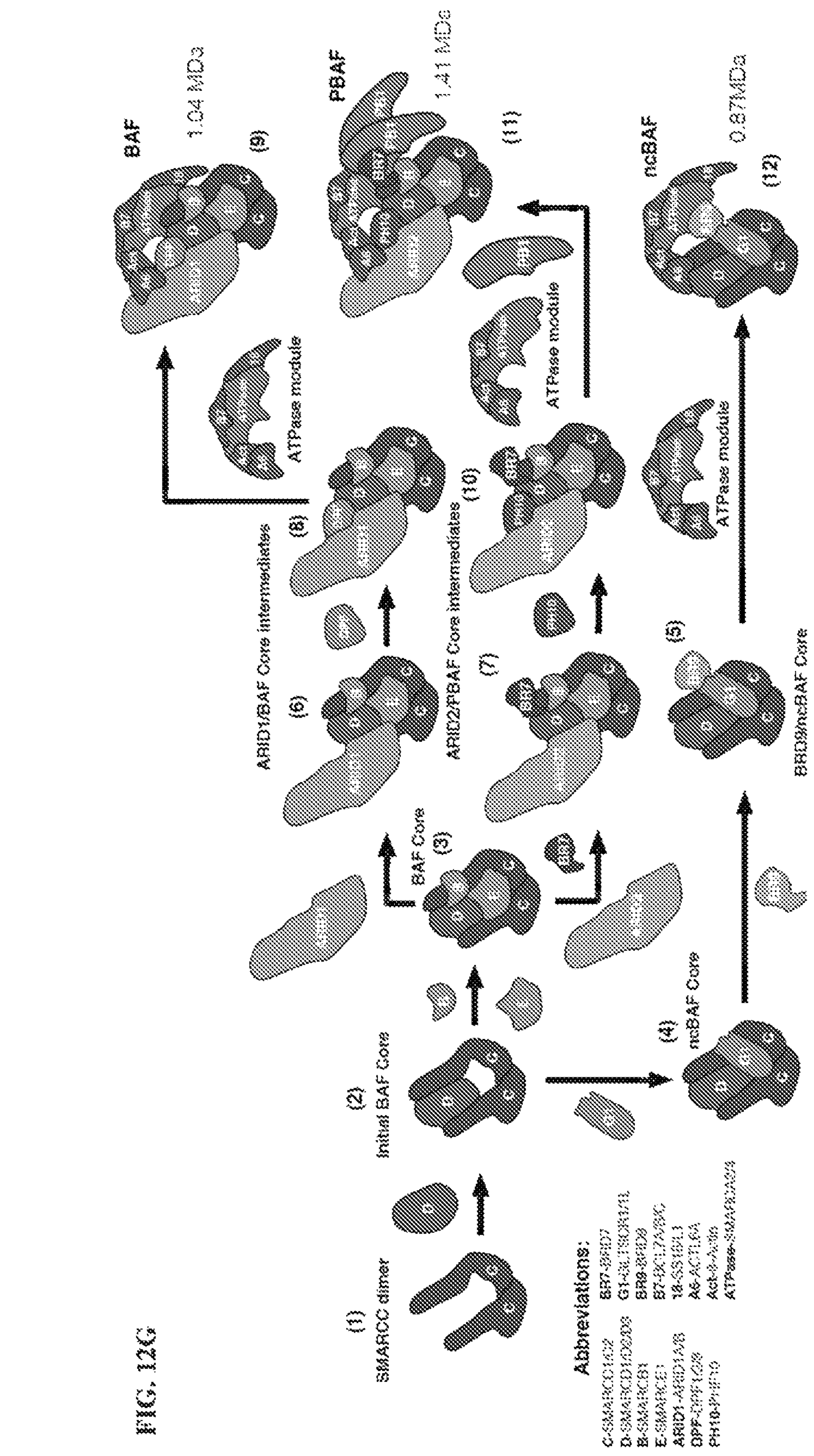

Based on this study, the mammalian SWI/SNF assembly pathway is summarized herein (FIG. 12G). The main steps of complex assembly and branching are: (1) dimerization of SMARCC subunits; (2) formation of the BAF initial core of SMARCC/SMARCD subunits; (3) incorporation of SMARCE1 and SMARCB1 components, forming the BAF core module; or, alternatively, incorporation of GLTSCR1/1L; (4) formation of the ncBAF core module which binds BRD9 (5); canonical BAF core complexes interact with ARID1 (6) or ARID2 (6) subunits and branch into cBAF complexes (containing ARID1) and PBAF complexes (containing ARID2), respectively. (7) ARID1/BAF core intermediates bind DPF2 and (8) incorporate the SS18-containing ATPase module, finalizing cBAF assembly (9). In parallel, the PBAF complex intermediate, ARID2/BAF core, incorporates BRD7 and PHF10, and (10) subsequently recruits the SS18-negative ATPase module, which finalizes its formation by binding PBRM1 (11). The alternative BRD9/ncBAF core finalizes its formation with the integration of an SS18-containing ATPase module to form ncBAF complexes (12). Existence of multiple subunit paralogs across these three distinct mSWI/SNF complexes results in further diversification, for which the full set of possible combinations was calculated (FIG. 11J).

Example 8: Disease-associated Mutations Affect mSWI/SNF Binding Interfaces and Subunit Stability (6677->5099)

Figure 13A:
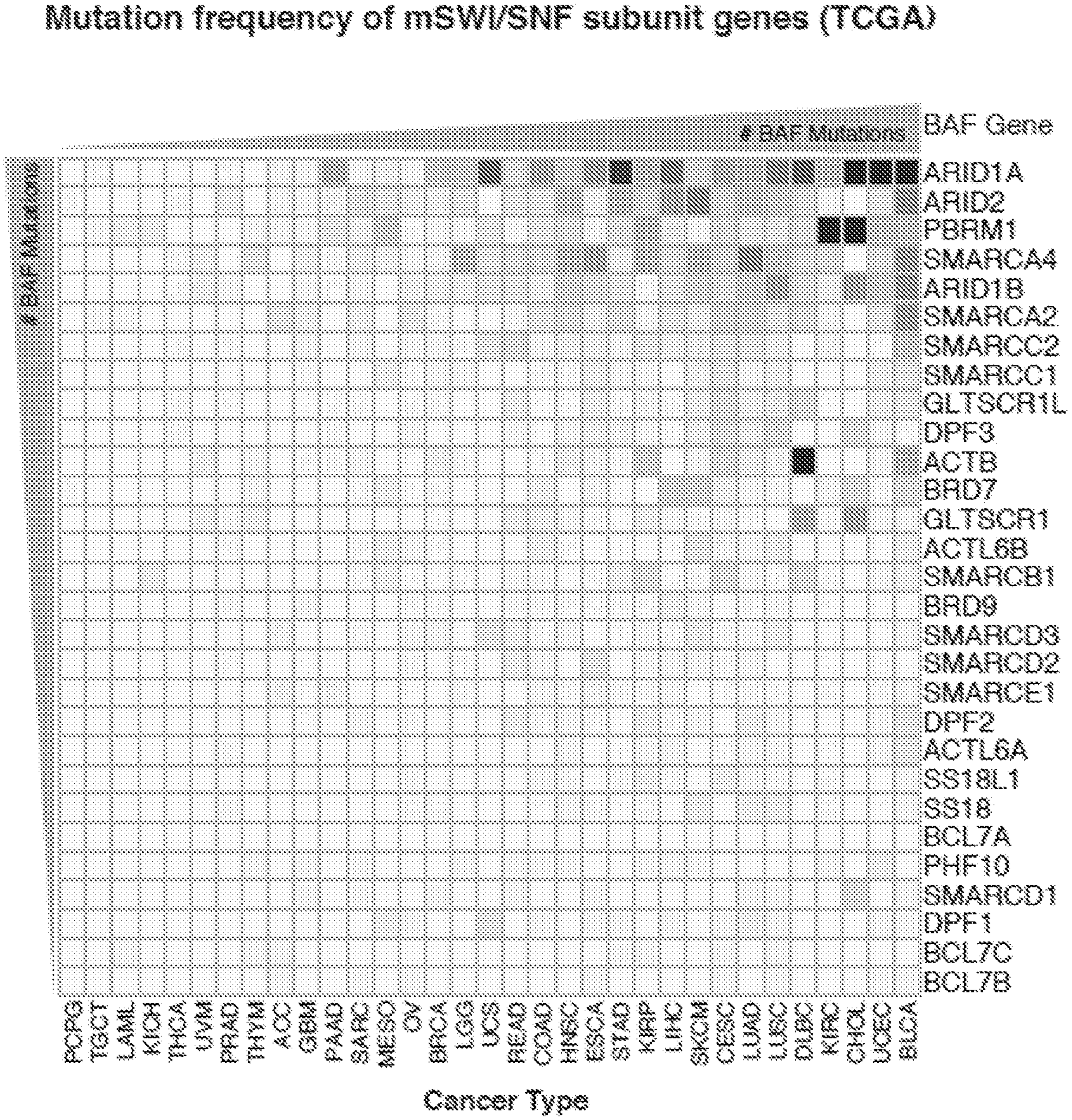
FIG. 13A-FIG. 13J show the disruption of mSWI/SNF complex assembly in human disease.
Figure 13B:
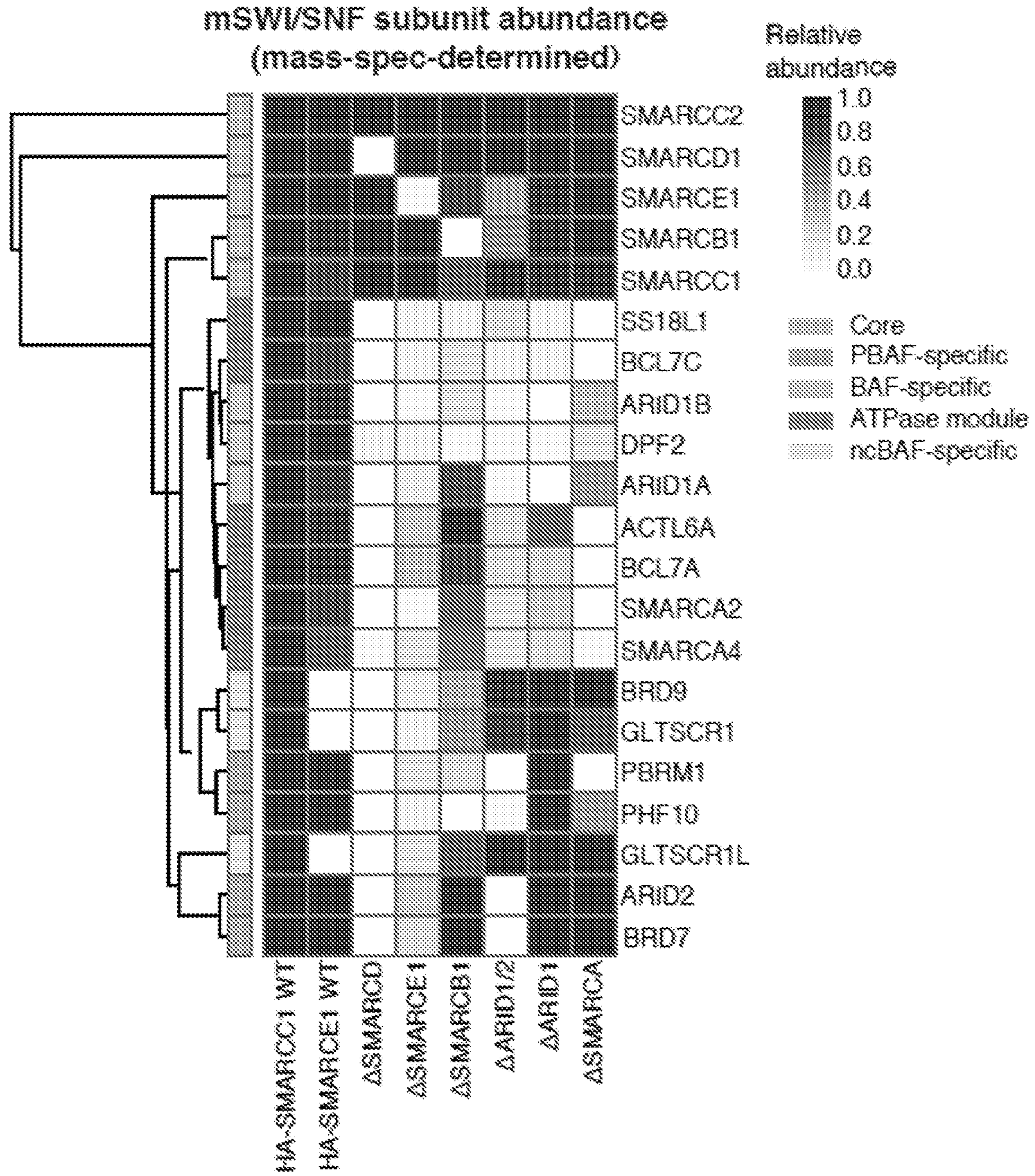
Figure 13C:
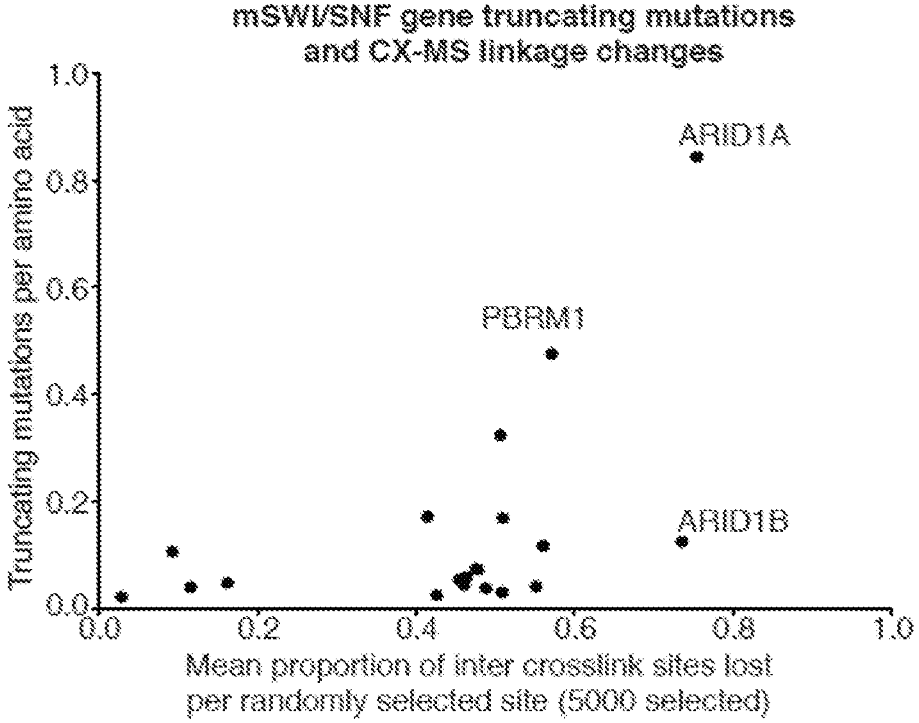

The genes encoding mSWI/SNF complex subunits are widely mutated in human disease, most notably in cancer and intellectual disability syndromes (Bogershausen et al. (2018) *Front Mol Neurosci* 11:252; Kadoch and Crabtree (2015) *Sci. Adv.* 1: e1500447; Kadoch et al. (2013) *Nature Genetics* 45:592-601; Sokpor et al. (2017) *Front Mol Neurosci* 10:243). As the large majority of mSWI/SNF subunit mutations in cancer (FIG. 13A) result in protein loss, complexes purified from KO cell lines were analyzed by MS to assess the global impact of each subunit loss on the relative abundance of other subunits in the complex (FIG. 13B). Subunits which assemble at the earliest stages of BAF assembly are the most critical for complex assembly, with their deletions resulting in profound impacts on complex integrity. This data set excludes SMARCC-deleted cells, as this resulted in near-complete degradation of all mSWI/SNF subunits, further underscoring the important role of this initial subunit dimer as the structural foundation of all mSWI/SNF complexes (FIG. 6M). Notably, it is discovered herein that loss of SMARCB1, a well-known tumor suppressor (Versteege et al. (1998) *Nature* 394:203-206), has minor effects on complex stability relative to other subunits (FIGS. 6M, 6P, and 13B), indicating instead a critical regulatory role exerted by the SMARCB1-containing core module on the ATPase and its associated components. Defining the proportion of crosslinked sites between subunits lost upon gene truncating mutations showed subunits most affected by truncating mutations in cancer are PBRM1 and ARID1A, which interact with complexes primarily via C-terminal binding regions (FIG. 13C).

Figure 14A:
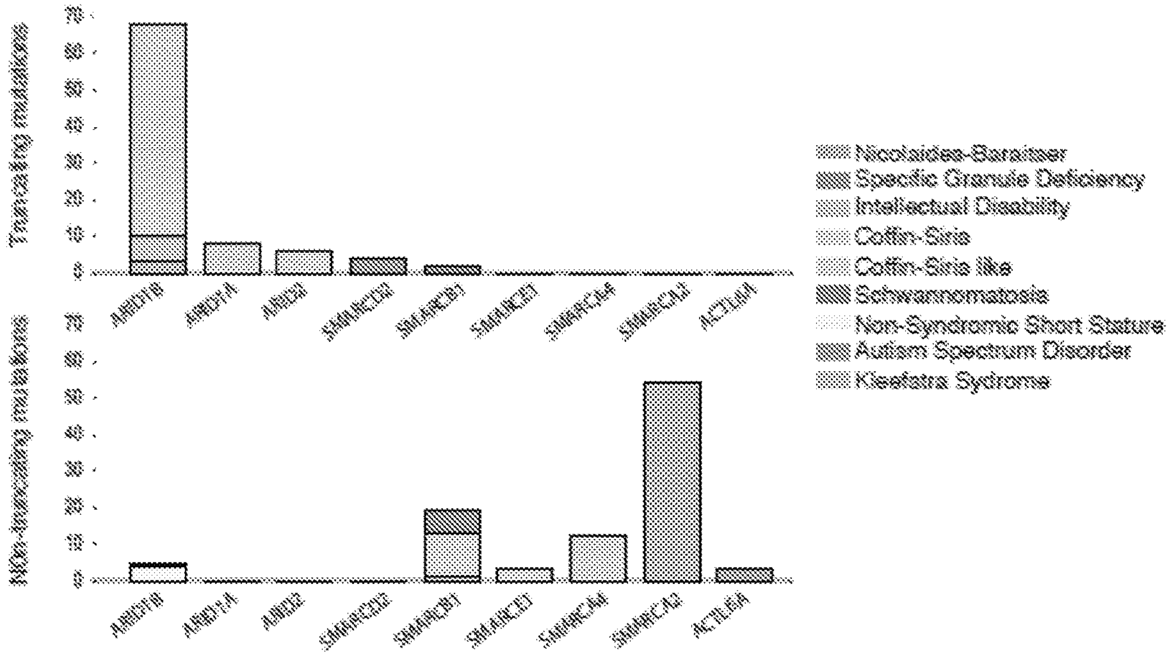
FIG. 14A-FIG. 14G show the Disease-associated perturbations to mSWI/SNF complex assembly.
Figure 14B:
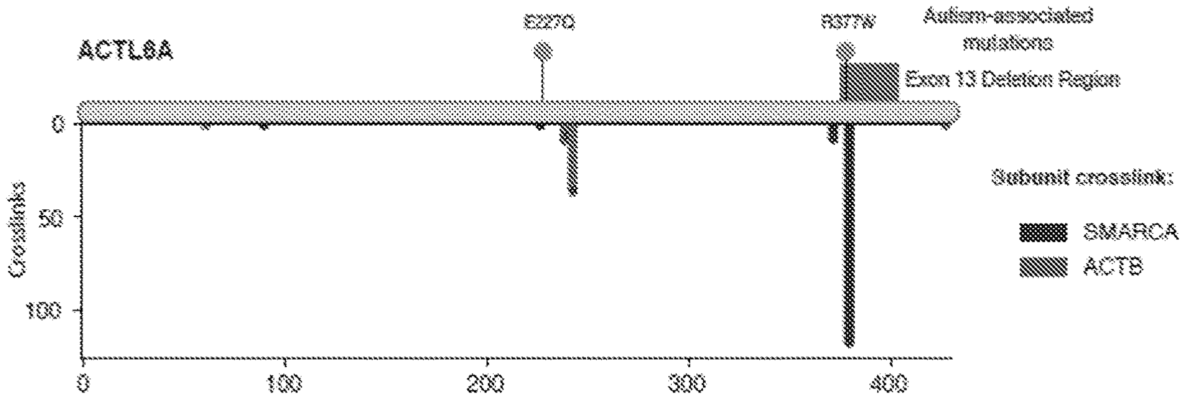
Figure 14C:
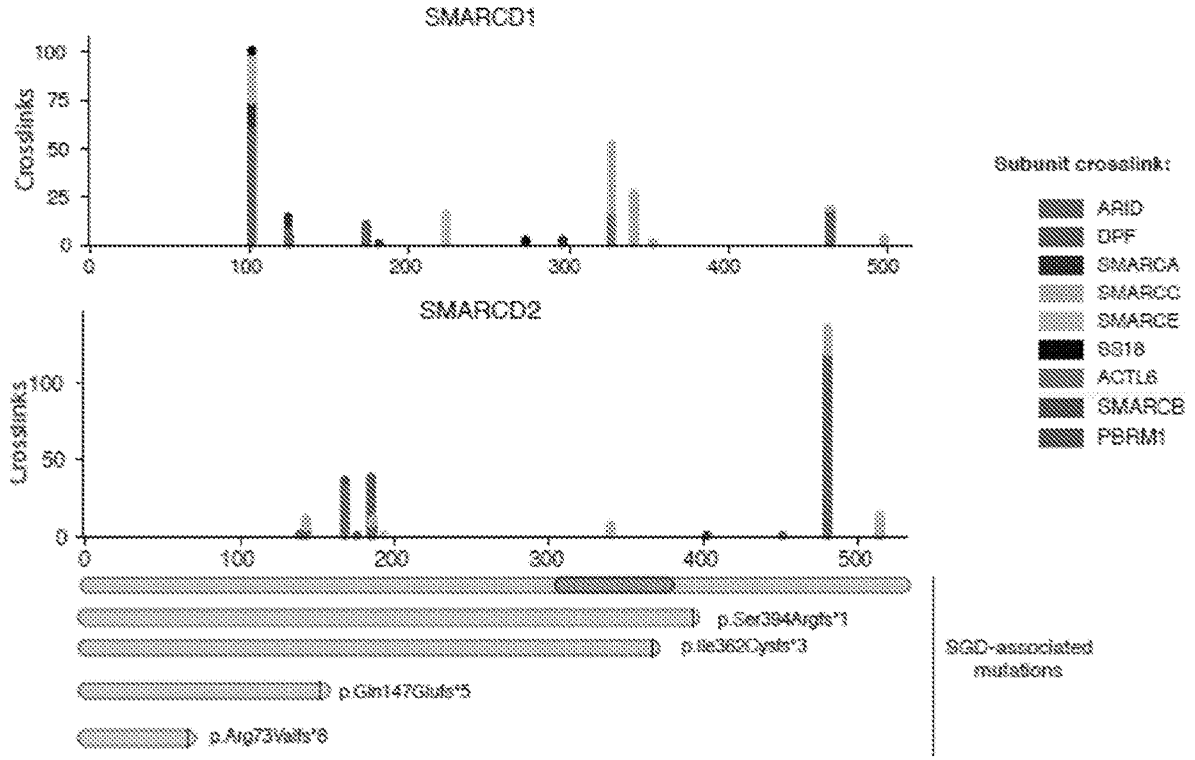

In addition to cancer, mSWI/SNF subunit mutations have been linked to several developmental and neurologic diseases including intellectual disability and autism-spectrum disorders, with additional mutations continuing to emerge in other rare but well-defined conditions (Sokpor et al. (2017) *Front Mol Neurosci* 10:243). For example, heterozygous ARID1B mutations are common in Coffin-Siris syndrome (FIG. 14A) and mutations of ACTL6A were identified in autism and shown to disrupt its interaction with SMARCA4 (Marom et al. (2017) *Hum Mutat* 38:1365-1371). Intriguingly, analyses presented herein revealed that these map to ACTL6A/SMARCA crosslinks (FIG. 14B). Finally, SMARCD2 mutations were reported to drive neutrophil-specific granule deficiency (SGD) (Priam et al. (2017) *Nature genetics* 49:753-764; Witzel et al. (2017) *Nat Genet* 49:742-752). These mutations result in truncation before the C-terminal region, which were demonstrated herein to remove the region containing a significant number of crosslinks to ARID1 CBR B and SMARCC, likely explaining the loss of BAF complex binding (FIG. 14C). Intriguingly, the C-terminal region of the paralog, SMARCD1, contains fewer crosslinks to these subunits, and also failed to rescue SGD phenotypes in in vivo models of SGD (Priam et al. (2017) *Nature genetics* 49:753-764; Witzel et al. (2017) *Nat Genet* 49:742-752), indicating a structural basis for paralog- and tissue-specific function of BAF subunits.

Figure 13D:
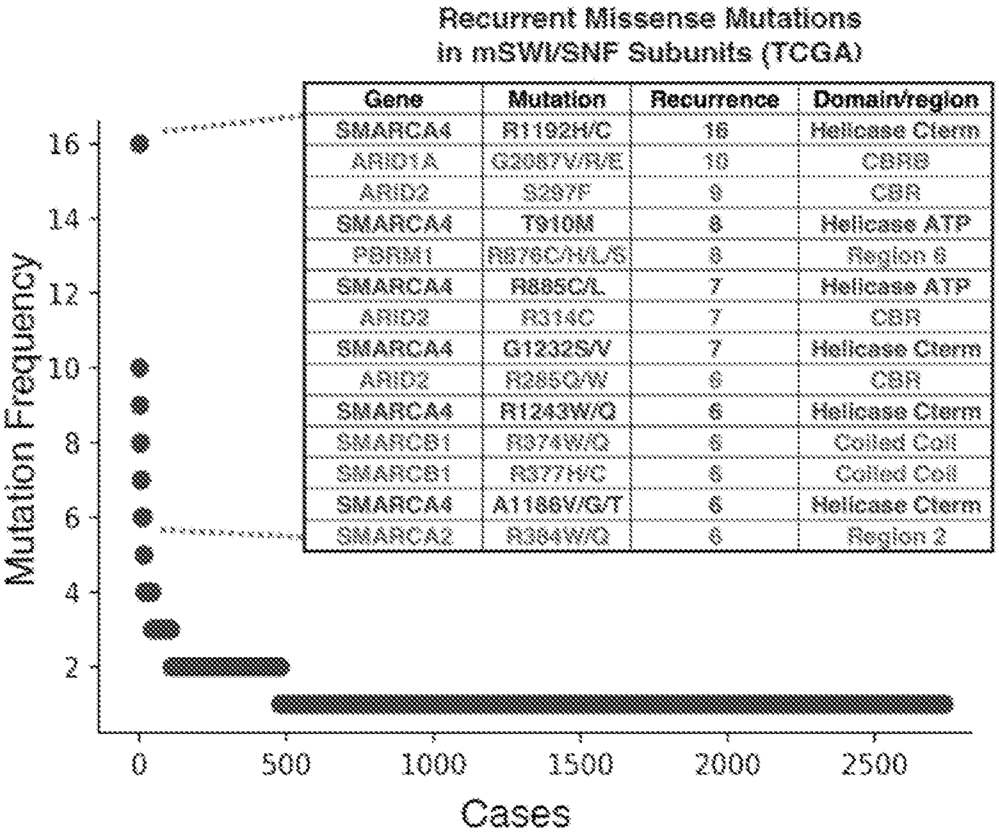
Figure 13E:
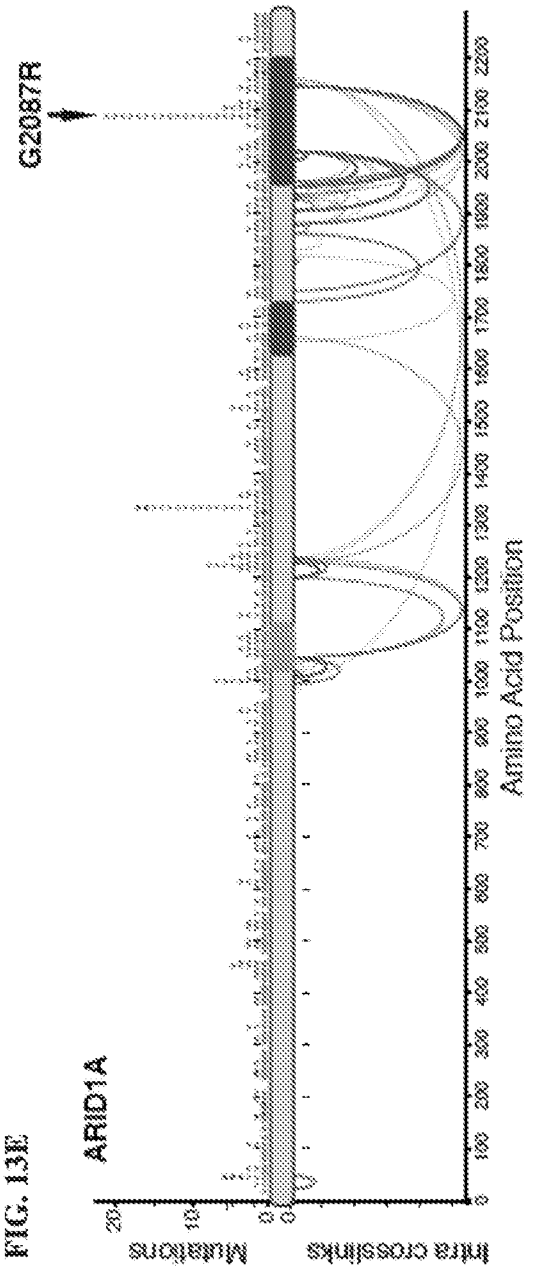
Figure 13F:
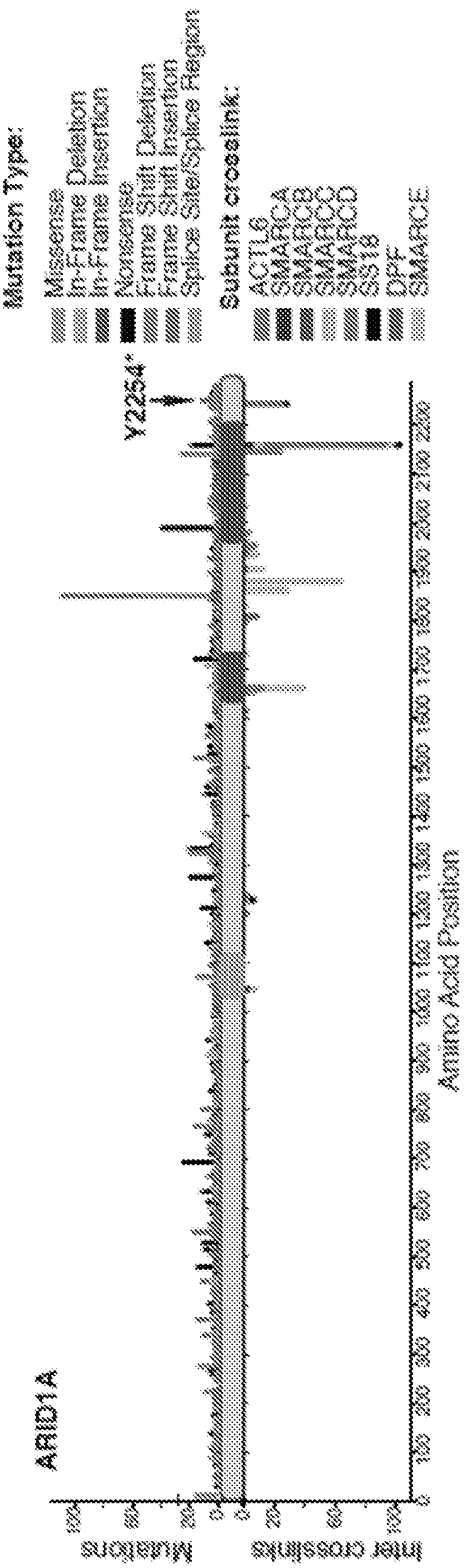
Figure 13G:
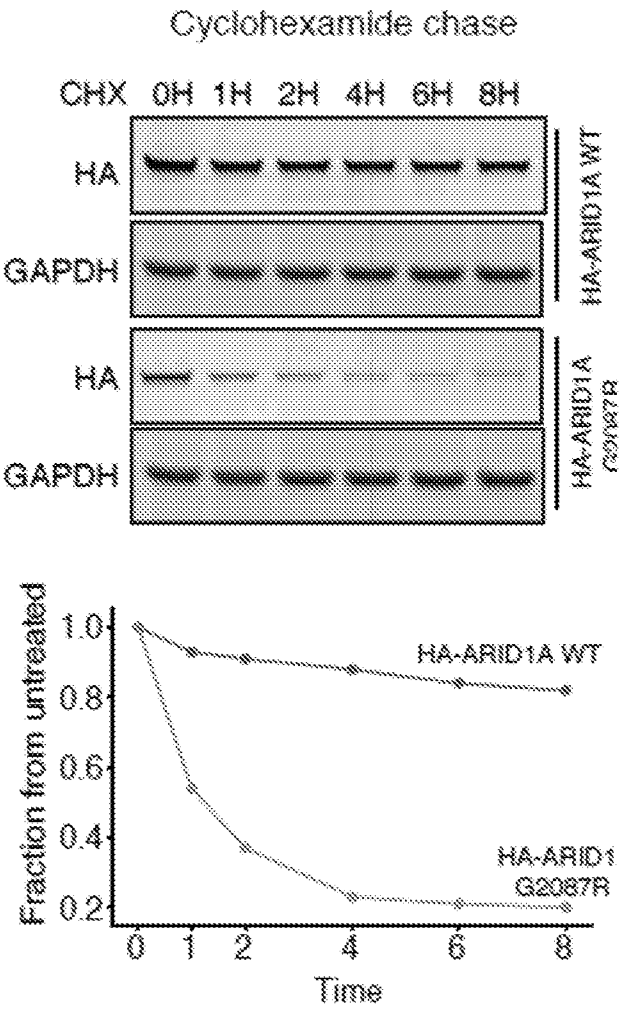
Figure 13H:
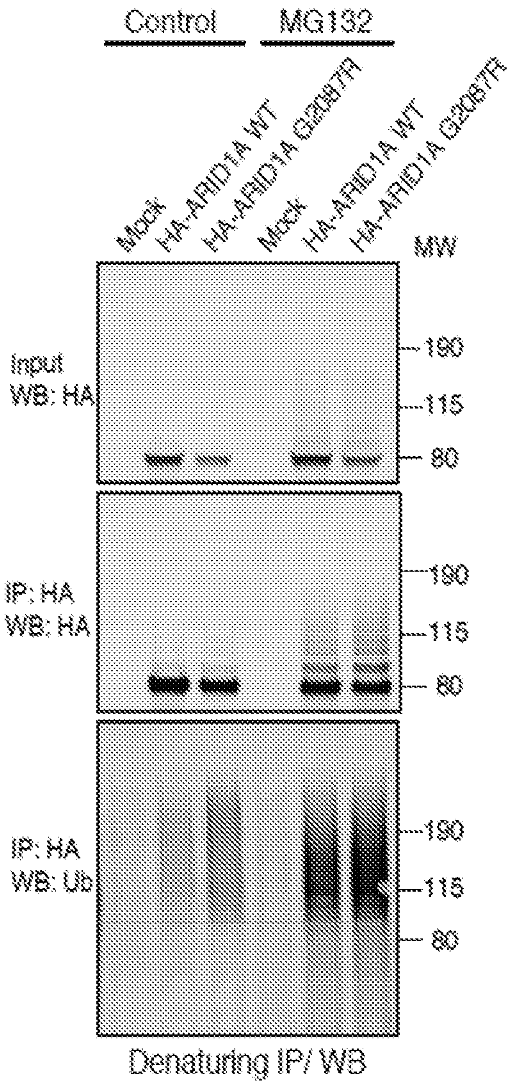
Figure 13I:
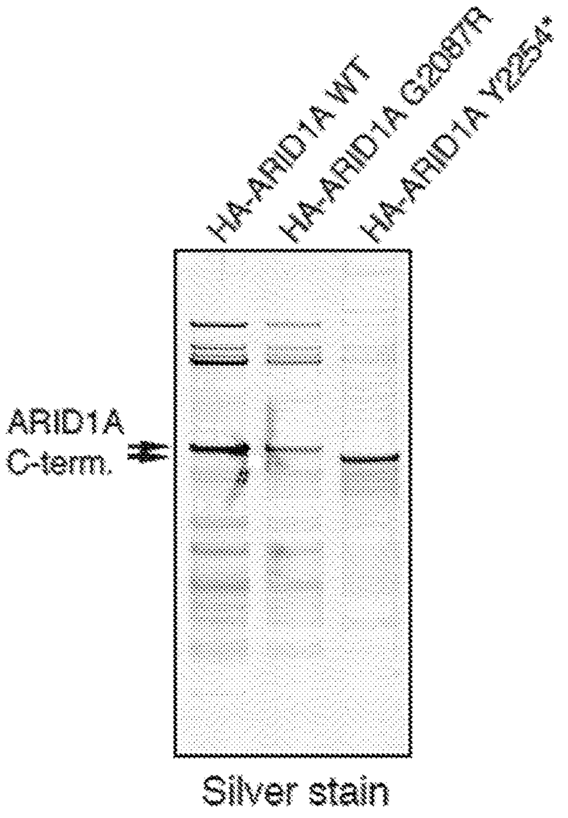
Figure 13J:
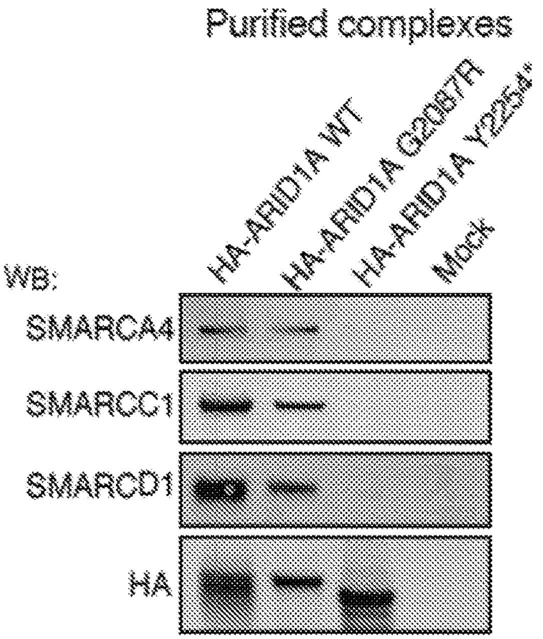
Figure 14D:
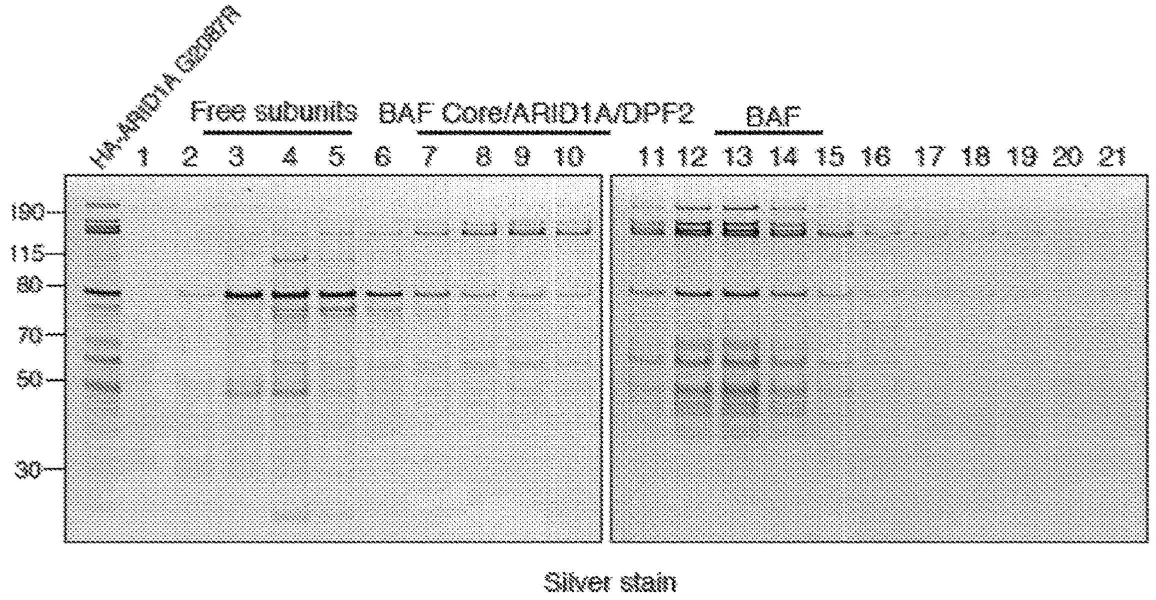
Figure 14E:
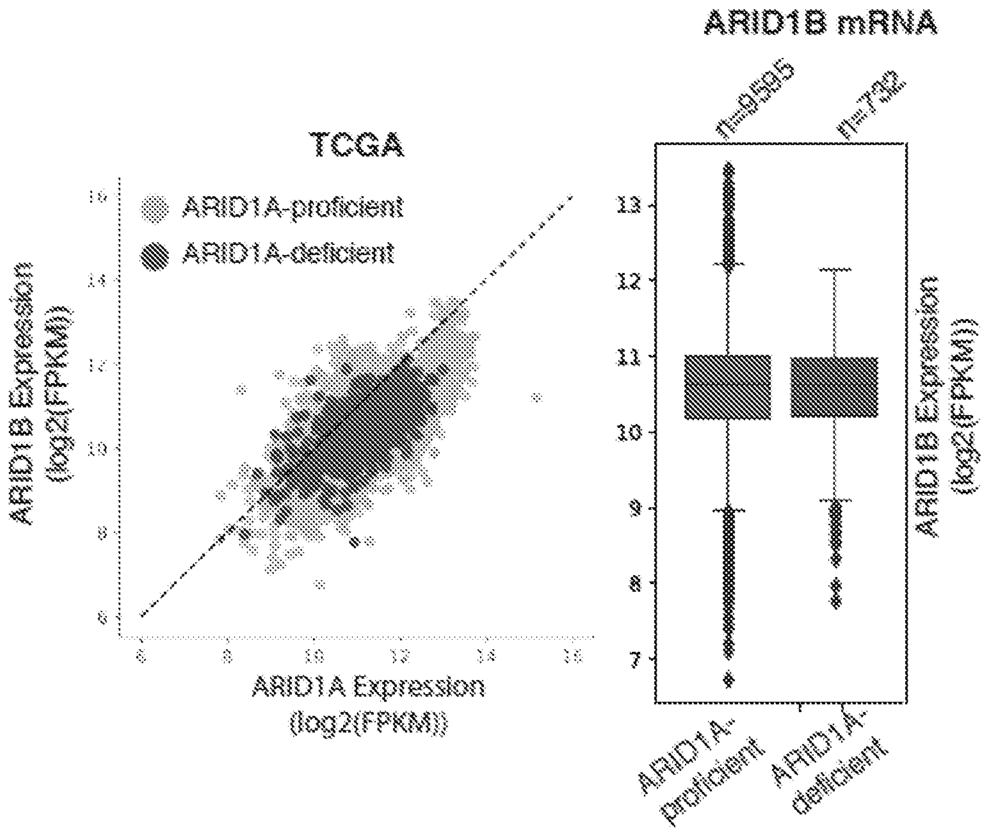
Figure 14F:
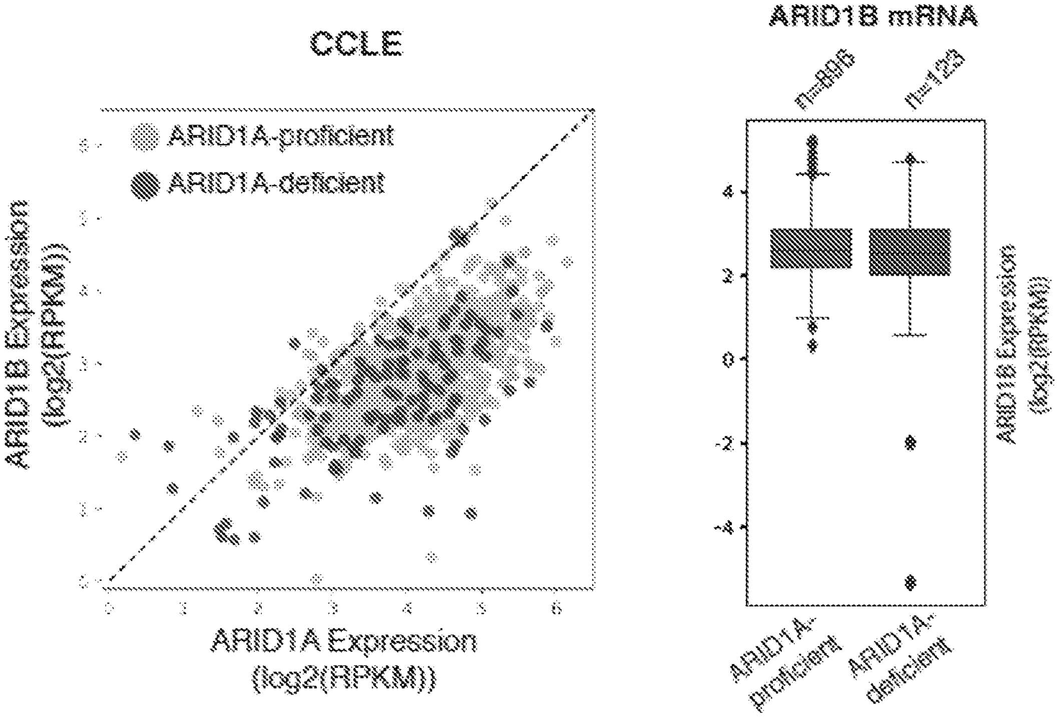
Figure 14G:
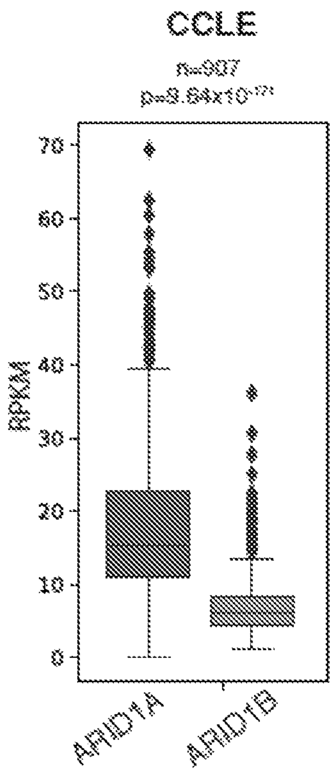

ARID1A, critical for BAF complex specification and assembly of the ATPase module, is the most frequently mutated mSWI/SNF subunit in human cancers (FIG. 13A) (Davoli et al. (2013) *Cell* 155:948-962; Wu et al. (2014) *Cancer Biol Ther* 15:655-664). ARID1A is particularly vulnerable to truncating mutations as these will result in deletion of the C-terminal binding region. However, the impact of recurrent missense mutations and small deletions within the CBR regions of ARID1A remains unknown (FIG. 13D). The most common single missense mutations in mSWI/SNF subunits (second only to mutations in the SMARCA4 helicase) result in substitution of glycine 2087 to valine, arginine or glutamic acid of ARID1A. This region corresponds to the CBRB interacting region of the protein that was identified herein (FIG. 13E). Additional recurrent missense mutations include Y2254*, resulting in a small 31aa deletion in the R4 region of the ARID1A C-terminus involved in anchoring of the ATPase module to the BAF core module (FIG. 13F). It is discovered herein that the C-terminal ARID1A region containing the G2087R mutation did not result in loss of the interaction of ARID1A with BAF complexes (FIG. 14D), but its expression was substantially lower in comparison to WT ARID1A, owing to decreased protein stability as revealed by cyclohexamide chase experiments (FIG. 13G). Further, increased poly-ubiquitin signal in G2087R mutant was observed compared to WT ARID1A C-terminal protein, which further increased upon treatment with MG132, indicating proteasomal-mediated degradation (FIG. 13H). In contrast, Y2254* resulted in complete loss of interaction between ARID1A and BAF complexes (FIGS. 131 and 13J), indicating that any truncating mutations in preceding residues would similarly disrupt binding. Taken together, these studies evaluated different routes toward ARID1A disruption, each of which result in inhibited assembly of fully-formed complexes. Loss of ARID1A is not compensated by increased expression of ARID1B, which also displays lower expression in most tumor samples (FIGS. 14E-14G).

This study presents a comprehensive architectural framework for the mSWI/SNF chromatin remodeler complex family, including the assembly pathways and inter- and intra-module linkages across three distinct complexes. Integrating multiple complex purifications with size fractionation, mutagenesis, and CX-MS, it was defined herein intra-complex modular architecture and stoichiometry, evolutionary relationships, and explored the effects of disease-associated mutations on complex architecture and assembly.

One particularly unexpected result is that the initial core for all three mSWI/SNF family complexes is a heterotrimer consisting of two SMARCC subunits (as a dimer) and one SMARCD subunit. While previous in vitro subunit co-purifications had suggested a 'minimal BAF complex' consisting of SMARCA4, SMARCC1, SMARCC2, and SMARCB1 (Phelan et al. (1999) *Mol Cell.* 3:247-253), it is found herein that neither complex assembly pathways nor CX-MS profiles of full BAF or PBAF complexes implicated this tetramer as a physiologic core in mammalian cells. Indeed, these results may begin to explain the challenges that have been faced in obtaining high-resolution structural information on this complex and in using such minimal complexes for small molecule screening efforts. Importantly, this initial mSWI/SNF core is required for global complex stability and the interaction of the majority of subunits in all three mSWI/SNF complexes (FIG. 5). Notably, the newly-identified ncBAF complex assembles exclusively around a SMARCC1/SMARCD1 initial core and lacks SMARCEL and SMARCB1 subunits, indicating fundamental differences and/or compensation in biochemical activity.

Interestingly, network modularity analyses of CX-MS data place SMARCB1 in the ATPase module, while biochemical purification of SMARCB1 demonstrates its presence in the BAF core module. This demonstrates SMARCB1 is involved in functionally linking the core and ATPase modules, potentially modulating ATPase or remodeling activity. Indeed, SNF5 regulates chromatin remodeling activity of the yeast complex (Sen et al. (2017) *Cell Rep* 18:2135-2147). While SNF5 and SMARCB1 subunits are largely dispensable for complex integrity in both yeast and human settings, respectively, it is observed herein that these orthologs exhibit different module associations in distantly-related eukaryotes, demonstrating that SMARCB1 plays an important role in dynamically regulating SWI/SNF complex activity.

ARID subunits (ARID1A, ARID1B, and ARID2) are among the most frequently mutated subunits in human disease. Importantly, it is demonstrated herein that ARID subunits are the major determinants of assembly pathway branching toward BAF or PBAF complexes. ARID subunits bind the BAF core module through the CBR regions on the C-terminus and N-terminus of ARID1 and ARID2, respectively, likely leading to the formation of a large interaction interface and forging a structurally essential bridge between the core and ATPase modules. SMARCD subunits in particular play a major role in ARID subunit binding, as their loss substantially affects ARID and subsequent ATPase module assembly. The critical role for ARID subunits is further illustrated by their interaction with ATPase module subunits SMARCA and ACTL6A. Finally, the absence of any ARID subunits in the newly-identified ncBAF complex indicate an alternative, ARID-independent mode of binding the ATPase module mediated by GLTSCR1/1L subunits.

The analysis of CX-MS-identified linkages within SWI/SNF complexes of two other eukaryotic species reveals evolutionary conservation of the complex modularity that was herein identified in mammalian cells. Conserved structural properties of these complexes indicate separation and divergence of complex functions.

Finally, the findings presented herein demonstrate that BAF inter- and intra-modular interactions are altered by mutations found in many human cancers and other diseases, and that these mutations disrupt the normal complex assembly pathway or subunit protein stability. A prime example of this lies in the extensively-mutated ARID1A subunit, including both nonsense mutations and missense mutations which are disproportionately skewed to the C-terminal domain that was discovered herein to be required for BAF complex binding.

Taken together, these studies present new opportunities for structural and functional characterization of this family of mammalian chromatin remodeling complexes which exhibit outsized roles in human disease. Understanding of the architecture and modular organization of mSWI/SNF complexes greatly potentiates the ability to assign density to subunits or modules in efforts to achieve 3D structure, to link structure to biochemical activity, and to develop meaningful small-molecule screening strategies, collectively serving as a critical foundation in the quest to define mechanisms of mSWI/SNF-mediated chromatin remodeling in normal and disease states.

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

Also incorporated by reference in their entirety are any polynucleotide and polypeptide sequences which reference an accession number correlating to an entry in a public database, such as those maintained by The Institute for Genomic Research (TIGR) on the world wide web at tigr.org and/or the National Center for Biotechnology Information (NCBI) on the world wide web at ncbi.nlm.nih.gov.

EQUIVALENTS

Those skilled in the art will recognize, or be able to ascertain using no more than routine experimentation, many equivalents to the specific embodiments of the invention described herein. Such equivalents are intended to be encompassed by the following claims.

LENGTHY TABLES

The patent contains a lengthy table section. A copy of the table is available in electronic form from the USPTO web site (https://seqdata.uspto.gov/docdetail?docId=US12473334B2). An electronic copy of the table will also be available from the USPTO upon request and payment of the fee set forth in 37 CFR 1.19(b)(3).

SEQUENCE LISTING (29605 sequences)

SEQ ID NO: 1 - DNA, 7592 bp, Homo sapiens
gcggccgcggccggaggagcaatagcagcagccgtggcggccacggggcggggcgcggcggtcggtgaccgcggccggggctgcaggcggcggagcggctggaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctgaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtgatttggattaaccaggaaaaaaaaaaaaaaaaaa

SEQ ID NO: 2 - protein, 1582 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSESTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 3 - DNA, 7609 bp, Homo sapiens
gcggccggggctgcaggcggcggagcggctggcttgccaacacttggtgtcacatgtgagcctcccacatgtattcactctccattccagctctgtgattgaactctgctcttattgactagggggcagttgggcaggcatgcctcattcctggaattgacagtcattcctaataagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaat

SEQ ID NO: 4 - protein, 1582 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 5 - DNA, 8117 bp, Mus musculus
ggatttacggcagcactgggaggggtgagggcggtgagggcggcgggtgccggagagacggccgcggccagaggagcgctagcagccgtggcggccacggggcggggctcggcggtcggggaccgcagccggggctgcaggcggcggagcggcgggcttgccaacacttggtgtcacatgtgagcctcccacatgtgtgcactctccattccagctctgtgattgaactctgctcttattgactagggggcacttgggcaggcatgcttcattcctggagttgacagtcatttcataagaagttggattccatgggttccaagagaagaagagccacctctccttccagcagtgtcagtggagactttgatgacgggcaccattctgtgcctacaccaggcccaagcaggaaaaggagaagactgtccaatcttccaactgtagatcctattgctgtgtgccatgaactctataacaccatccgagactataaggatgaacagggcagactcctctgtgagctgttcattagggctccaaagcggagaaatcaaccagactattatgaagtggtttctcagcccattgacttgatgaaaatccaacagaaacttaaaatggaagagtatgatgatgttaatctactgactgctgacttccagctgctttttaacaatgcaaaggcctactataagccagattcccctgagtataaagctgcttgtaaactctgggatttgtaccttcgaacaagaaatgagtttgttcagaaaggagaagcagacgatgaagatgatgacgaagatgggcaagacaatcaaggcacactggctgacggctcttctccaggttatctgaaggagatcctggagcagcttcttgaagccatagttgtagccacaaatccatcaggacggctcatcagtgaactttttcagaaactgccttccaaagtgcaatatccagactattatgcaataattaaggaacctatagatctcaagaccattgctcagaggatacagaatggaagctacaaaagtatacacgcaatggccaaagatatagatcttctagcaaaaaatgccaaaacatacaatgagcctgggtctcaagtattcaaggatgccaattcgattaaaaaaatattttatatgaaaaaggcagaaattgaacatcatgaaatgactaaatcaagtcttcgaataaggactgcatcaaatttggctgcagccaggctgacaggtccttcgcacaataaaagcagccttggtgaagaaagaaaccccactagcaagtattaccgtaataaaagagcagtccaagggggtcgcttgtcagcaattaccatggcacttcagtatggatcagagagtgaagaggacgctgctttagctgctgcacgctatgaagaaggggaatctgaagcagagagcatcacttccttcatggacgtttccaacccctttcatcagctttacgacacagttaggagctgtaggaatcaccaagggcagctcatagctgaacctttcttccatttgccttcaaagaaaaaatacccagattattatcagcaaattaaaatgcccatatcacttcaacagatcagaacaaagctaaagaaccaagaatatgaaactttagatcatttggagtgtgatctgaatttaatgtttgaaaatgccaaacgttataacgttcccaattcagccatctataagcgagttctaaaactgcagcaagtcatgcaggcaaagaagaaggagcttgcgaggagagatgacattgaggacggagacagcatgatctcctcagccacttctgacactggtagtgccaaaaggaaaaggaatactcatgacagtgagatgttgggtctcaggaggctatccagtaaaaagaacataagaaaacagcgaatgaaaattttattcaatgttgttcttgaagctcgagagccaggttcaggcagaagactttgcgatctatttatggttaagccatccaagaaggactatcctgattattataaaatcatcttagagccaatggacctgaaaataattgagcataacatccgaaatgacaaatatgcaggtgaagaaggaatgatggaagacatgaaactcatgttccgcaatgccaggcactacaatgaggagggctcccaggtatacaatgatgcccatatcctggagaagttactcaaagataaaaggaaagagctgggccctctgcctgatgatgatgacatggcttctcccaaacttaaattgagtaggaagagtggtgtttctcctaagaaatcaaagtacatgactccaatgcagcagaaactgaatgaagtgtatgaagctgtaaagaactatactgataagaggggtcgccgccttagtgctatatttctaagactcccctctagatcagagctgcctgactactacctgaccattaaaaagcccatggacatggaaaaaattcgaagtcacatgatggcaaacaagtaccaagacatagattctatggtagaggactttgtcatgatgtttaataatgcctgtacctacaatgaaccagagtctttgatctacaaagatgcccttgtactgcataaagtcctccttgagactcggagagacctggagggagatgaggattctcatgtccctaatgtgacgttgctgattcaagagctcatccataacctttttgtgtcagtcatgagtcatcaggatgacgaagggaggtgttacagcgactccttagcagaaattcctgctgtggatcccaactctcccaataaacctccccttacatttgacattatcaggaaaaatgttgaaagtaatcggtatcggcgacttgatttatttcaggagcatatgtttgaagtattggaacgggcaagaaggatgaaccggacagattccgaaatatatgaggatgctgtagaacttcagcagttttttattagaattcgtgatgaactctgcaaaaatggagagatccttctttctccagcactcagctataccacaaaacacttgcataacgatgtggaaaaagaaaaaaaggaaaaattgcctaaagaaatagaggaagataaactaaaacgcgaagaagaaaaaagagaagctgaaaaaagtgaagattcctcaggtactacaggcctctcaggcttacatcgtacatacagccaggactgcagctttaagaacagcatgtatcatgtcggagattatgtctatgttgaacctgcggaggccaatctacaaccacatatagtgtgtattgagagactgtgggaggattcagctggtgaaaaatggttgtacggctgttggttttatcggccaaatgaaacattccatttggctacacgaaaatttctagaaaaagaagtttttaagagtgactactacaataaagtacctgttagtaaaattctaggcaaatgtgtagtcatgtttgtcaaggaatactttaaattatgtccagaaaactttcgcgatgaggatgtttttgtctgtgaatcgaggtattctgccaaaaccaaatcttttaagaaaattaaactgtggaccatgcccatcagttcagttagatttgtccctcgggatgtgcctttgcctgtggtccgagtggcctctgtgtttgcaaatgcagataaaggggatgatgagaagaatacagacaactcagatgacaatagagctgaagacaattttaacttggaaaaggaaaaagaagatgttcctgtggagatgtccaatggtgagccaggttgccactactttgagcagcttcggtacaatgacatgtggctgaaggttggtgattgtgtcttcatcaaatcccacggcttggtgcgccctcgtgtgggcagaattgagaaagtatgggtccgagatggagctgcatatttttatggccctatcttcattcatccagaagaaacagaacatgagcccacaaaaatgttctacaaaaaagaagtgtttctgagtaatctggaagagacctgccctatgagttgtattctggggaaatgtgcagtgctgtcattcaaggacttcctctcctgcaggccaactgaaataccagaaaatgacattctgctttgtgagagccgctataatgagagtgacaagcagatgaagaagttcaagggtttgaagaggttttcactctctgctaaagttgtagatgatgaaatctactacttcagaaaaccaatcattcctcagaaggaaccctcacctttgttagaaaagaagatacaattgctagaagctaaatttgcagagttagaaggaggagatgatgatattgaggagatgggagaagaggatagtgaagtcattgaagctccatctctacctcaactgcagacacccctggccaatgagttggacctcatgccctatacacccccacagtctaccccaaagtctgccaaaggcagtgcaaagaaggaaagttctaaacgaaaaatcaacatgagtggctacattttgttcagcagtgaaatgagagctgtgattaaagcccagcacccagactactcttttggggagctcagcagactggtggggacagaatggagaaaccttgaaacagccaagaaagcagaatatgaagagcgggcagctaaagttgctgagcagcaggagagagagcgagcagcacagcaacagcagccgagtgcttctccccgagcaggcacccctgtgggggctctcatgggggtggtgccaccaccaacaccaatggggatgctcaatcagcagttgacacctgttgcaggcatgatgggtggctatccgccaggccttccacctttgcagggcccagttgatggccttgttagcatgggcagcatgcagccacttcaccctggggggcctccacctcaccatcttccgccaggtgtgcctggcctcccaggcatcccaccaccgggtgtgatgaatcaaggagtagcccccatggtagggactccagcaccaggtggaagtccgtatggacaacaggtaggagttttgggacctccagggcagcaggcaccacctccatatcctggtcctcatccagctggcccccctgtcatacagcagccaacaacgcccatgtttgtggctcccccaccaaagacccaaaggcttctccactcagaggcctacctgaaatacattgaaggactcagtgctgaatccaacagcattagcaagtgggaccaaactttggcagctcgaagacgggatgtccatttgtccaaagaacaggagagccgcctaccttctcactggctcaaaagtaaaggggcacacaccaccatggcagatgccctctggcgcctacgggatttaatgcttcgagacactctcaacatccgacaggcatacaacctagaaaatgtttaatcacatcactgtttcttctgtggaagcaaagagttgtggagcggtagccattttagttactggggtgggagggaggaacaaaggatgataatttttattgcattttattgtacatcacacagccatttttatataaggacacttttaataagctatttcaaatttggttttgttacattaagttgactatcaaatacacaaaagattttttttgcatatgtttcctttgtttaaaaccagtttcataattggttatatatagtaatagttttatctttacttgttaaaggacttaaatcatcaaaggttttggcttggcttagggttttcgttttcttttttataaatatatattatatatatatacacatataaaagaaaaaatgaaaaaaaagtttacaaatttaagttgacaatgaaatgtgaagttggtcctagtttacatcttagaggaatgtatatgtatgttttacatgcctaaatatctgcaggttttcttacaggtaaagcgaagtgctttgaaaagtttagattatacatgtgtgacagatgcggcatatttgctctattaacacagaggcttactatagaaatctaaagtcaatgctgtacatccatccagttagtgtaactgaagggaaatgtaactttgtgctgagttagacatctgtattgtcagtgattcttgtagaatatgtgctcagatctgagttatatttagttttggaaggtaagttgaagagtacttttgatcagtttatgattcagtttatgattttagtttttgccttcatgttatacatttatgatttgaaactgtacatctgttaccttgaaaaacattgaagaaagtactgaagtgtgcatggaggtggtttaagcataatacttaacccaagaaagagtgtaagtggacacaagctgtgcctgcacatagctgtgcagggtagactgcctacatacacatggccgggattctttatttccttgttatcaattatagtgctttgtttgtttcagggttggaattctcaaccagaaataatactttctaaaatattttaaaattcagcttgtgctttggattatagaaggaaattatactttaagaaaatgttcacaaaaaaaaaaaaaaaaaaaggactattacagatcccaatacttggatttggtgaccttgtctttctttcttttcttgagacatggtcctactaccaaccctggctggactggagctcagtgtatagaccaggctagtctcaaactctgcctcttcctcccaagtgctgggattaagggcaggtaccatagtgctcagcaaccacaaccctgtctttccaacacggccctagcgtaagcactgaggcagtgtgcagtgctcaggcagcagcaaacatttcccgggggtggttttgaacctgcttgggtggttgtgtggtgctgacgctgccactgccctgttgttcattgagaatgattgttaaatgacactcttcctttagaatataacggatcagtactcatgtttaattgccatgcttaataaatcatgagaacaaaagagtatagaatggaaagcattccctggtagctactttaaatacaggagccctgtaacttaataccagtagtcaaccactggatctcagttttcatcaagtattttaaataaataatcttaaattttaaaatacgtactgcagagtatgccagtatcttattgttaaaactgaatcaaataaatcttcgattcctggttatttggaccattgactcatcatggactatataatgtaataagattcttttctcttaaggtatccttgaattacaccaaagaaccagaaacttaattttggttaaattatttatttatttcatgcattaattttctttttctttttaaaggtttagatgaggctccttagggagtctctaaaaccgcttcactatcagcaaccaggagtactagaagccagagcactcttcctcctggctcctccccagtgctctagtgctgtaggaaccaagagccagccccaggttccccgaggcagtaaaaatccagcacagggggctgtgtccctaaggcaagccctgattacctttaaaaaaaaccaaaaaaacaaacaaaaaaaaaaaacctaattaactaaagcatttaaggcactatttattttagaatcatgcttttgaagagcatcagtgattacttagggtgtaatatgtaaagatcagacatctccaaaaacagaaaaagtacaagtaaacaacacactttctcatgacttttaagaactgtagtaatgtggcttaggaaatataatggcctaattgttttcaaaatgtaagttcctgtgaagaattttgtttatattgggttggggacctataggtttaaaatagaatgtcagtcagctgacttaaaaaacattggttttactaagtctgccttccccttctaaggaagaactgagtgggtaagggacaggtgtgtaaaatctccaaatggatgttacagctttcagcttgaacgtttgtttccagacctgattaaaatttggtttattctaatttctgtactatatcatctgaggttttaagtggtaactggttctataccatgtatgtatcatatgtttgttcatcaaagctttttaatccaaataaaaacaacagtttgcaaagtga

SEQ ID NO: 6 - protein, 1704 aa, Mus musculus
MGSKRRRATSPSSSVSGDFDDGHHSVPTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKAYYKPDSPEYKAACKLWDLYLRTRNEFVQKGEADDEDDDEDGQDNQGTLADGSSPGYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMTKSSLRIRTASNLAAARLTGPSHNKSSLGEERNPTSKYYRNKRAVQGGRLSAITMALQYGSESEEDAALAAARYEEGESEAESITSFMDVSNPFHQLYDTVRSCRNHQGQLIAEPFFHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKRNTHDSEMLGLRRLSSKKNIRKQRMKILFNVVLEAREPGSGRRLCDLFMVKPSKKDYPDYYKIILEPMDLKIIEHNIRNDKYAGEEGMMEDMKLMFRNARHYNEEGSQVYNDAHILEKLLKDKRKELGPLPDDDDMASPKLKLSRKSGVSPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNSPNKPPLTFDIIRKNVESNRYRRLDLFQEHMFEVLERARRMNRTDSEIYEDAVELQQFFIRIRDELCKNGEILLSPALSYTTKHLHNDVEKEKKEKLPKEIEEDKLKREEEKREAEKSEDSSGTTGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSDDNRAEDNFNLEKEKEDVPVEMSNGEPGCHYFEQLRYNDMWLKVGDCVFIKSHGLVRPRVGRIEKVWVRDGAAYFYGPIFIHPEETEHEPTKMFYKKEVFLSNLEETCPMSCILGKCAVLSFKDFLSCRPTEIPENDILLCESRYNESDKQMKKFKGLKRFSLSAKVVDDEIYYFRKPIIPQKEPSPLLEKKIQLLEAKFAELEGGDDDIEEMGEEDSEVIEAPSLPQLQTPLANELDLMPYTPPQSTPKSAKGSAKKESSKRKINMSGYILFSSEMRAVIKAQHPDYSFGELSRLVGTEWRNLETAKKAEYEERAAKVAEQQERERAAQQQQPSASPRAGTPVGALMGVVPPPTPMGMLNQQLTPVAGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 7 - DNA, 8619 bp, Homo sapiens
ggcccatgactgagccccgccgccgccggccgaggaatgggctccgggctctggtaggaagcgctgggagcggggggcgcttttaaaacaccgatctgggttttttaaaaacctcctttgaaaaaataatggcaaactcgacggggaaggcgcctccggacgagcggagaaagggactcgctttcctggacgagctgcggcagttccaccacagcagagggtcgccttttaaaaaaatccctgcggtgggtgggaaggagctggatcttcacggtctctacaccagagtcactactttaggcggattcgcgaaggtttctgagaagaatcagtggggagaaattgttgaagagttcaactttcccagaagttgttctaacgctgcctttgctttaaaacagtattacttgcgttacctagaaaagtacgagaaagttcatcattttggggaggatgatgatgaggtaccaccaggcaatccaaagccacagcttcctattggtgcaattccatcttcctacaattaccagcaacacagtgtgtcggattatctgcgtcaaagttatgggctgtccatggactttaattcgccaaatgattataataaattggtgctttcactgttatctggactcccaaatgaagtggactttgctattaacgtatgcactctcctatcaaatgaaagcaagcacgtcatgcaacttgaaaaagatcctaaaatcatcactttactacttgctaatgccggggtgtttgacgacactttaggatccttttccactgtatttggagaagaatggaaagagaagactgatagagacttcgttaagttttggaaagacatcgttgatgataatgaagttcgtgacctcatttctgacagaaacaagtctcatgaaggtacatcaggagaatggatttgggagtctttatttcatccacctcgaaagctgggcattaacgatattgaaggacagcgggtacttcagattgcagtgattttgagaaatctttcctttgaggagggcaatgttaagctcttggcagctaatcgtacctgtcttcgtttcctattactttctgcacatagtcattttatttctttaaggcaattaggccttgacacattaggaaatattgcagctgagcttttactggaccctgttgatttcaaaactactcatctgatgtttcatactgttacaaaatgtctaatgtcaagggatagatttttaaagatgagaggcatggaaattttgggaaatctttgcaaagcagaagataatggtgttttaatttgtgaatatgtggatcaggattcctacagagagatcatttgtcatctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcagattgttaaagagacatgaaaataacttatcagtgctagccattagtaacatggaagcttcctccacccttgccaaatgcctttatgaacttaattttacagttcagagtaaggaacaagaaaaagactcagaaatgctgcagtgaaaaataattccacttacacagtgggggactcaaagtcagccacatttcacatactgttactgaagaaagcaccaagtcttaatggaacaaagaccatagaatgaattattttatctcctcccatgatgctgagaggaagcttcgtattctgatctctgagtgaatccctttgttctctgtttaaaaaaatctaaaaagaaaaaggaaaaaaaaaaaagaactgctgtgggattgtcaaccagcttatctgcaggatgtttcagatctgataaatcctgatggaaactggtatgatcagaattcagtaccatccacattggaatatacatggaatattgtaaaacctacatgagcagatgaaatagaagcattaaatatttttatctatatccaaaaaggagcacatttttatatttacaaaaccgtttaagctggtttgaataatttaaaaaagtttcagcacacctatacccccgatctcagagggggccaccaatatctagctatggatcgtgtgttttgtttagaaatcagtagcttggttttcttacttgagccaatatattttcacttatttattatcataaaaatttaccagtctgaatagatcttgtaaatatttgtgaatagaatgaatacctttcatgccactgcagccactggaaatacattctgtggtgtcctagaagcattattggtaggttctaaagttttctagactttcctgtcaattgtaagtaattgtgatatattctatgcagtggatgaatgttctttaaatttgtgtaaatacttctgcaaaggtactgatgctgtaaagtcaaaacagttttgtggaactgtgatttttttttcttttttctttttttttttctttttttttttgtattatacaccttgtagaactcattttgctggctgaaagagtatggaataatatatctcatgtcattttttagaagaaaaactatttgaaggtattttttggttttccttaacatgtatccactgtaaacgtttgtcgtgtacaagctcagagcttggacagaattttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttttcccccagcgtgaaatgtatccatttataactgcctattgcctgttctattagcatccaaaaatgtggaaggcctcccaaccaccatttctgctgtgtccttaggatgtgcagtaaaaaatatagacctaacagtttatgttatagaatggctttatttactttggtgactgtttatagtttttaaataaaagactgaacattttcttgagtccttcatttctgagtatgcttaagacatcttaaaaatatagagagaattctaaattcagctgaaggcaaggtataacggtcacctacctatttgattatatgttgattgataacatattaaatagagaacaaataagagaggtcctttacatgacaaatttgcatgaaataagcagattaaccaagtatttatttttcatcttgttataatgcagagcaaatgtagagaacagcaaatgattgatgcagttaaagctcaatatgcctttttttactggatactgtacatttggctaaaagcttttattgtttgatgttgtgtttcttgactgtttattcagaatcacagtgtatccaaatcttcagcttgaatttggaggcagattcttagagtgaaaaagcctcagtttccatattaaaaatgttttaaatattttgattgaattagtaccaatgtaaaatctagtttcttcctgaaggaggatccctggcgctgtcctgccatgtctcaaaggaatgtttgagaaacttcatctaatattagttataaggttgtggaatttatgcttggcccaccttccaagactggcactgcccaacagacaccgctgaaatcatgtgggtatccctaggatggccttcagagccctcaaacttacaagcacctggtagttgacatcatatggggaattttctattcaccgtacttatccaaaaatctcttttaaaaagtaaatttgtgcaacaacgtttatttgaaagataatgtcttctcaaaatcagaaactgcagtggtaattaaattaatagaaaagagaacaaactgcaggtttagaaaaatggttttcatattcaccattcttccacctcattgaattgcatgctgtagttctagcttttctgctataatatgtaaatatgactgtagccttttaagcttcagtctcagcagagaatttcctaaatgcgtttgacctaatgaaactgatcatggcttcccacttaggtttttcttcttatagctttatagaactatataataatatggacttgctgtgtaatggaattaaagtgcttttgcacaataagttctgcaaaaccctctcattcatgaaaaggtgctccttgctagacagaaacttgctgatttacagtattgttatttttgtctaaagttctgtaaatacatgctttaatgttatctttgagaaatctatgtaaataatatagtctacaacatagagactgtataattctgtgttatatatgtgcctagtgctctgttggcactcaataaattttaagtaacaaaattgataatcatatagcgaaggcatatttttcttccaagctcaagtcaggattgtgactatatattaatgagactcagtaatccaacccacacctgagaactcgtctcattactttatagtcatgtcatgtatgtttttttaaccatgaaatgacaataaaatgatttttaaaatgagaaaaaaaaaaaaaaaaaaaaaaa

SEQ ID NO: 8 - protein, 1835 aa, Homo sapiens
MANSTGKAPPDERRKGLAFLDELRQFHHSRGSPFKKIPAVGGKELDLHGLYTRVTTLGGFAKVSEKNQWGEIVEEFNFPRSCSNAAFALKQYYLRYLEKYEKVHHFGEDDDEVPPGNPKPQLPIGAIPSSYNYQQHSVSDYLRQSYGLSMDFNSPNDYNKLVLSLLSGLPNEVDFAINVCTLLSNESKHVMQLEKDPKIITLLLANAGVFDDTLGSFSTVFGEEWKEKTDRDFVKFWKDIVDDNEVRDLISDRNKSHEGTSGEWIWESLFHPPRKLGINDIEGQRVLQIAVILRNLSFEEGNVKLLAANRTCLRFLLLSAHSHFISLRQLGLDTLGNIAAELLLDPVDFKTTHLMFHTVTKCLMSRDRFLKMRGMEILGNLCKAEDNGVLICEYVDQDSYREIICHLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRRLLKRHENNLSVLAISNMEASSTLAKCLYELNFTVQSKEQEKDSEMLQ

SEQ ID NO: 9 - DNA, 5703 bp, Homo sapiens
ggcccatgactgagccccgccgccgccggccgaggaatgggctccgggctctggtaggaagcgctgggagcggggggcgcttttaaaacaccgatctgggttttttaaaaacctcctttgaaaaaataatggcaaactcgacggggaaggcgcctccggacgagcggagaaagggactcgctttcctggacgagctgcggcagttccaccacagcagagggtcgccttttaaaaaaatccctgcggtgggtgggaaggagctggatcttcacggtctctacaccagagtcactactttaggcggattcgcgaaggtttctgagaagaatcagtggggagaaattgttgaagagttcaactttcccagaagttgttctaacgctgcctttgctttaaaacagtattacttgcgttacctagaaaagtacgagaaagttcatcattttggggaggatgatgatgaggtaccaccaggcaatccaaagccacagcttcctattggtgcaattccatcttcctacaattaccagcaacacagtgtgtcggattatctgcgtcaaagttatgggctgtccatggactttaattcgccaaatgattataataaattggtgctttcactgttatctggactcccaaatgaagtggactttgctattaacgtatgcactctcctatcaaatgaaagcaagcacgtcatgcaacttgaaaaagatcctaaaatcatcactttactacttgctaatgccggggtgtttgacgacactttaggatccttttccactgtatttggagaagaatggaaagagaagactgatagagacttcgttaagttttggaaagacatcgttgatgataatgaagttcgtgacctcatttctgacagaaacaagtctcatgaaggtacatcaggagaatggatttgggagtctttatttcatccacctcgaaagctgggcattaacgatattgaaggacagcgggtacttcagattgcagtgattttgagaaatctttcctttgaggagggcaatgttaagctcttggcagctaatcgtacctgtcttcgtttcctattactttctgcacatagtcattttatttctttaaggcaattaggccttgacacattaggaaatattgcagctgagcttttactggaccctgttgatttcaaaactactcatctgatgtttcatactgttacaaaatgtctaatgtcaagggatagatttttaaagatgagaggcatggaaattttgggaaatctttgcaaagcagaagataatggtgttttaatttgtgaatatgtggatcaggattcctacagagagatcatttgtcatctcactttacctgatgtgctgcttgtaatctcaacactcgaggtgctatacatgctcacggaaatgggagatgttgcttgcacaaaaattgcaaaagtagaaaagagcatagacatgttagtgtgtctggtttctatggatattcagatgtttggccctgatgcactagctgcggtaaaactcattgaacacccaagttccagtcatcaaatgttatctgaaattaggccacaagctatagagcaagtccaaacccagactcatgtagcatctgccccagcttccagagcagttgtagcgcagcatgttgctccacctccaggaatagtggaaatagatagtgagaagtttgcttgtcagtggctaaatgctcattttgaagtaaatccagattgttctgtttctcgagcagaaatgtattctgaatacctctcgacttgcagtaaattagctcgtggtggaatcctaacatcaactggattttataaatgtcttagaacggtctttccaaatcatacagtgaagagagtggaggattccagtagcaatgggcaggcacatattcatgtggtaggagtaaaacggagggctataccacttcccattcagatgtactatcagcagcaaccagtttctacttctgttgttcgtgttgattctgttcctgatgtatctcctgctccttcacctgcaggaatccctcatggatcacaaaccataggaaaccattttcagaggactcctgttgccaaccaatcttcaaatctgactgcaacacaaatgtcttttcctgtacaaggtgttcatactgtggcacaaactgtttcaagaattccacaaaatccttcacctcatacccaccagcaacaaaatgctccagtgactgtcattcaaagtaaagctccaattccttgtgaagttgttaaggctacagttatccagaattccataccccagacaggagttcctgttagtattgctgttggaggaggacctccacagagttctgttgttcagaatcatagtacagggccacaacctgttacagttgtgaattctcagacattgcttcaccatccatctgtaattccacagcagtctccattacacacagtggtaccaggacagatcccttcaggcactcctgttacagtaattcaacaagctgtcccacagagtcatatgtttggcagagtacagaacataccagcatgtacttctacagtttcacagggtcaacagttaatcaccacatcaccccaacctgtgcaaacttcatctcaacagacatcagctggtagccagtcacaagatactgttatcatagcacccccacagtatgtaacaacttctgcatccaatattgtctcagcaacttcagtacagaattttcaggtagctacaggacaaatggttactattgctggtgtcccaagtccacaagcctcaagggtagggtttcagaacattgcaccaaaacctctcccttctcagcaagtttcatctacagtggtacagcagcctattcaacaaccacagcagccaacccaacaaagcgtagtgattgtaagccagccagctcaacaaggtcaaacttatgcaccagccattcaccaaattgttcttgctaatccagcagctcttccagctggtcagacagttcagctaactggacaacctaacataactccatcttcttcaccatcacctgtcccagctactaataaccaagtccctactgccatgtcgtcgtcctctacccctcaatcacagggaccacctcctactgtcagtcaaatgttatctgtgaaaaggcagcaacagcagcaacattcaccagcacccccaccacagcaggtacaagtacaagttcagcagccccaacaagtacagatgcaagttcaacctcaacagtcgaatgcaggagttggtcagcctgcctctggtgagtcgagtctgattaaacagcttctgcttccgaaacgtggtccttcaacaccaggtggtaagcttattctcccagctccacagattcctccccctaataatgcaagagctcctagccctcaggtggtctatcaggtggccagtaaccaagccgcaggttttggagtgcaggggcaaactccagctcagcagctattggttgggcagcaaaatgttcagttggtcccaagtgcaatgccaccctcagggggagtacaaactgtgcccatttcgaacttacaaatattgccaggtccactgatctcaaatagcccagcaaccattttccaagggacttctggcaaccaggtaaccataacagttgtgccaaatacgagttttgcacctgcaactgtgagtcagggaaatgcaactcagctcattgctccagcaggaattaccatgagcggaacgcagacaggagttggacttccagtacaaacgcttccagccactcaagcatctcctgctggacaatcatcatgtactactgctactcccccattcaaaggtgataaaataatttgccaaaaggaggaggaagcaaaggaagcaacaggtttacatgttcatgaacgtaaaattgaagtcatggagaacccgtcctgccgacgaggagccacaaacaccagcaatggggatacaaaggaaaatgaaatgcatgtgggaagtcttttaaatgggagaaagtacagtgactcaagtctacctccttcaaactcagggaaaattcaaagtgagactaatcagtgctcactaatcagtaatgggccatcattggaattaggtgagaatggagcatctgggaaacagaactcagaacaaatagacatgcaagatatcaaaagtgatttgagaaaaccgctagttaatggaatctgtgattttgataaaggagatggttctcatttaagcaaaaacattccaaatcataaaacttccaatcatgtaggaaatggtgagatatctccaatggaaccacaagggactttagatatcactcagcaagatactgccaaaggtgatcaactagaaagaatttctaatggacctgtattaactttgggtggttcatctgtgagcagtatacaggaggcttcaaatgcggcaacacagcaatttagtggtactgatttgcttaatggacctctagcttcaagtttgaattcagatgtgcctcagcaacgcccaagtgtagttgtctcaccacattctacaacctctgttatacagggacatcaaatcatagcagttcccgactcaggatcaaaagtatcccattctcctgccctatcatctgacgttcggtctacaaatggcacagcagaatgcaaaactgtaaagaggccagcagaggatactgatagggaaacagtcgcaggaattccaaataaagtaggagttagaattgttacaatcagtgaccccaacaatgctggctgcagcgcaacaatggttgctgtgccagcaggagcagatccaagcactgtagctaaagtagcaatagaaagtgctgttcagcaaaagcaacagcatccaccaacatatgtacagaatgtggtcccgcagaacactcctatgccaccttcaccagctgtacaagtgcagggccagcctaacagttctcagccttctccattcagtggatccagtcagcctggagatccaatgagaaaacctggacagaacttcatgtgtctgtggcagtcttgtaaaaagtggtttcagacaccctcacaggttttctaccatgcagcaactgaacatggaggaaaagatgtatatccagggcagtgtctttgggaaggttgtgagccttttcagcgacagcggttttcttttattacccacttgcaggataagcactgttcaaaggatgccctacttgcaggattaaaacaagatgaaccaggacaagcaggaagtcagaagtcttctaccaagcagccaactgtagggggcacaagctcaactcctagagcacaaaaggccattgtgaatcatcccagtgctgcacttatggctctgaggagaggatcaagaaaccttgtctttcgagattttacagatgaaaaagagggaccaataactaaacacatccgactaacagctgccttaatattaaaaaatattggtaaatattcagaatgtggtcgcaggtgagtaatatgttttctgtagccaaagtgaatttagtttattttatttttacatataagttaataaaattagataactgtattttcttcattgtttttctcatcaattttgcaaatacatccaaaagtttatgcctaggtcaggccatgatgagctcttaaaagtcaaaaataaatagaagttaaaacaaccaaaaaaaaaaaaaaaaaaa

SEQ ID NO: 10 - protein, 1788 aa, Homo sapiens
MANSTGKAPPDERRKGLAFLDELRQFHHSRGSPFKKIPAVGGKELDLHGLYTRVTTLGGFAKVSEKNQWGEIVEEFNFPRSCSNAAFALKQYYLRYLEKYEKVHHFGEDDDEVPPGNPKPQLPIGAIPSSYNYQQHSVSDYLRQSYGLSMDFNSPNDYNKLVLSLLSGLPNEVDFAINVCTLLSNESKHVMQLEKDPKIITLLLANAGVFDDTLGSFSTVFGEEWKEKTDRDFVKFWKDIVDDNEVRDLISDRNKSHEGTSGEWIWESLFHPPRKLGINDIEGQRVLQIAVILRNLSFEEGNVKLLAANRTCLRFLLLSAHSHFISLRQLGLDTLGNIAAELLLDPVDFKTTHLMFHTVTKCLMSRDRFLKMRGMEILGNLCKAEDNGVLICEYVDQDSYREIICHLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSVPDVSPAPSPAGIPHGSQTIGNHFQRTPVANQSSNLTATQMSFPVQGVHTVAQTVSRIPQNPSPHTHQQQNAPVTVIQSKAPIPCEVVKATVIQNSIPQTGVPVSIAVGGGPPQSSVVQNHSTGPQPVTVVNSQTLLHHPSVIPQQSPLHTVVPGQIPSGTPVTVIQQAVPQSHMFGRVQNIPACTSTVSQGQQLITTSPQPVQTSSQQTSAGSQSQDTVIIAPPQYVTTSASNIVSATSVQNFQVATGQMVTIAGVPSPQASRVGFQNIAPKPLPSQQVSSTVVQQPIQQPQQPTQQSVVIVSQPAQQGQTYAPAIHQIVLANPAALPAGQTVQLTGQPNITPSSSPSPVPATNNQVPTAMSSSSTPQSQGPPPTVSQMLSVKRQQQQQHSPAPPPQQVQVQVQQPQQVQMQVQPQQSNAGVGQPASGESSLIKQLLLPKRGPSTPGGKLILPAPQIPPPNNARAPSPQVVYQVASNQAAGFGVQGQTPAQQLLVGQQNVQLVPSAMPPSGGVQTVPISNLQILPGPLISNSPATIFQGTSGNQVTITVVPNTSFAPATVSQGNATQLIAPAGITMSGTQTGVGLPVQTLPATQASPAGQSSCTTATPPFKGDKIICQKEEEAKEATGLHVHERKIEVMENPSCRRGATNTSNGDTKENEMHVGSLLNGRKYSDSSLPPSNSGKIQSETNQCSLISNGPSLELGENGASGKQNSEQIDMQDIKSDLRKPLVNGICDFDKGDGSHLSKNIPNHKTSNHVGNGEISPMEPQGTLDITQQDTAKGDQLERISNGPVLTLGGSSVSSIQEASNAATQQFSGTDLLNGPLASSLNSDVPQQRPSVVVSPHSTTSVIQGHQIIAVPDSGSKVSHSPALSSDVRSTNGTAECKTVKRPAEDTDRETVAGIPNKVGVRIVTISDPNNAGCSATMVAVPAGADPSTVAKVAIESAVQQKQQHPPTYVQNVVPQNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRR

SEQ ID NO: 11 - DNA, 9029 bp, Mus musculus
gcgccgccgccgccgccgccgccgccgccgccgccgccaccgccggcccatgactgagccccgccaccgccggccgaggaatgggctccgggcgctggtagggagcgcggggagcgggggccgcgtttgaaccgcgatctgggttttttcgggagacctcctttggcaaaataatggcaaactcgacggggaaggcgcctccggacgagcggaggaagggactggctttcctggacgagctgcggcagttccaccacagcagagggtcgccgtttaagaagatccctgcggtgggtgggaaggagctggatcttcacgggctctacaccagagtcactactttaggcggattcgcgaaggtttctgagaagaatcagtggggagaaattgttgaagagttcaactttcccagaagttgttccaacgctgcctttgctttaaaacagtattacttgcgttatctagaaaagtacgagaaagttcatcattttggggaagatgatgatgaggtaccaccaggcaatccaaagccacagcttcctattggtgcaatcccatcttcctacaattaccagcaacacagcgtgtcagattatctacgtcaaagttatgggttatctatggattttaattcgccaaatgattataataaactggtgctttcactgttatctggactcccaaatgaagtggacttcgctattaatgtgtgcactctcctatcaaatgaaagcaagcacgtcatgcagcttgagaaggatcccaaaatcatcactttactgctcgctaatgcgggggtgttcgatgacactttaggatcattctcttctgtctttggagaagagtggcgagagaagactgatagagactttgttaagttttggaaagacattgttgatgacaatgaagtgcgagatctcatttctgacagaaacaaggctcatgaagatacaccaggagaatggatttgggaatctttatttcatccacctcgaaagctgggcattaatgacatcgaaggccagcgggttctgcagatcgcagtgatcttgcggaacctctcctttgaggagagcaatgttaagctcttggcagctaatcgcacctgtctgcgtttcctgttgctctctgcacacagtcattttatttcattaaggcagctaggcctggacaccttagggaatatcgcagctgagcttttactggaccctgtggatttcagaaccactcatctgatgtttcacactgttacaaaatgcctgatgtcaagggataggtttttaaagatgaggggcatggaaattttgggaaatctctgcaaagcagaggataacggtgttttgatttgtgaatatgtggatcaagattcctatagagagataatttgtcacctcactctgcccgatgtgctgctggtgacctcaaccctggaggtgctgtacatgctcactgaaatgggggacgtggcctgcacaaagatcgcgaaagtggagaagagcatagacgtgctggtgtgtctggtctctatggacgctcagatgtttggacctgacgcacttgctgccgtgaagctcattgagcatccgagctccagtcaccaagtgttatcagagattaggccgcaagccatagagcaggtccaaacccagacccacatagcctccggtccagcttccagagcagttgtagcacagcatgctgccccccctccaggaatcgtggaaatagacagtgagaagttcgcttgtcagtggctaaatgctcattttgaagtaaatccagactgttccgtctctcgggcagaaatgtattcagagtacctctcaacttgcagtaaattagctcgcggtggcatcctcacatcaactgggttttataagtgtcttagaacagtttttccaaatcatacagtgaagagggtagaagattccactagcagtgggcaggcgcatatccatgtcataggagtgaagcggcgggctctcccgctccccatccagatgtactatcagcagcagccaatttccactcctgttgtccgtgttgatgctgttgctgatctatctccaactccttcacctgcaggaatccctcatggaccacaggctgcagggaatcattttcagaggactcctgtcaccaatcaatcttcaaatttgactgcaacacaaatgtcttttccggtacaaggcattcatactgtggcacagactgtttccagaattccaccaaatccttcagttcatacccaccagcaacaaaattctccagtaactgtcattcagaataaagctccaattccttgtgaagtcgttaaggcaacagtaatccagaactctgtgccccagacggcagttcctgtgagtatctctgttggaggagcacctgcacagaattctgtgggtcagaaccatagtgcagggccacagcctgttacagttgtaaattctcagacattacttcaccatccttctgtgatgccacagccatctccactacacacagtggtgcccggacaggtcccttcaggcactcctgtcacagtaatccagcagactgtaccgcagagtcgtatgtttggacgagtacagagcataccagcgtgtacatctaccgtctcacagggtcagcagttaatcaccacatcaccacagcctatgcacacttcatctcaacagacagcagctggtagccagccacaagacactgttatcatagcacccccacagtacgtaacaacttctgcatccaatatcgtctcagcgacttcagtacagaatttccaggtagctacaggacaggtggttaccatagctggtgtcccgagcccacagccctccagggtaggattccagaacattgcgcccaagccacttccttctcagcaagtttcaccatcagtggtccagcagcctattcaacaaccacagcagcctgctcagcagagtgtagtgattgtgagccagccagcacagcaaggccaggcgtacgcaccagccattcaccagatcgttctcgctaacccggcagctctccctgccggtcagacggttcagctaactggacaaccaaacataactccatcgtcatcaccatcacctgtcccgcctactaataaccaagtccctactgccatgtcatcttcttccacccttcagtcacagggaccccctcctactgtcagtcagatgctctctgtgaagaggcagcagcagcagcagcactcaccagcagcgccagcacagcaggtccaggtccaggttcagcagccgcagcaggtccaggtgcaagttcagccgcagcaaccgagtgctggggtcggtcagcctgctcccaacgagtctagtctcatcaagcagctgctgctgccaaagcggggcccttcaaccccagggggcaagcttatcctcccagcccctcagattcctccccctaacaatgcaagagctcctagccctcaggtggtctatcaggtggccaataaccaagcagctggttttggagtgcaggggcaaactccggctcagcagctattggttgggcagcaaaatgttcagttggtccaaagtgcaatgccacccgcagggggagtgcaaaccgtgcccatttcgaacttacaaatattgccgggtccgctgatctcaaacagcccagcaaccattttccaagggacttctggcaaccaggtaactataacagttgtgccaaataccagttttgcaactgcgactgtgagtcagggaaacgctgctcagctcattgcgccagccggtcttagcatgagcggagcgcaggcaagcgctggacttcaggtgcagacgcttccagccggacaatcagcgtgtaccactgctcccctcccgttcaaaggcgacaagatcatttgccaaaaggaggaggaggcaaaggaagcaacaggtctacatgttcatgaacggaagattgaggtcatggagaatccttcctgtcggcgaggaaccacaaacaccagcaacggggatacaagtgagagtgaactccaggtgggaagtcttttaaatgggagaaagtatagtgactcaagtctacctccttcaaactcagggaaacttcagagtgagacgagccagtgctcactaatcagcaatgggccatcgttggaactaggtgagaatggagcgcctggaaaacagaactcagaaccagtagacatgcaggatgtcaaaggtgatctgaaaaaagccctcgtcaatggaatctgtgattttgataaaggagatggttctcatttaagcaaaaacattccaaatcacaaaacttctaatcatgtaggaaatggtgagatatctccagtagaaccacaagggacttcgggtgccactcagcaagatactgccaaaggtgaccaactagaaagagtttctaatggacctgtgttaactctgggtgggtcaccgtccacaagcagtatgcaagaagccccgagtgtggcgacaccgccgttgagtggtactgacctgcctaacggacctctagcttcaagtttgaattcagatgtgcctcagcaacgcccaagtgtagttgtctcaccacattctacagcccctgtcatacaggggcatcaagtcatagcagttccccactcaggacctagagtgaccccttctgctctatcatctgatgctcggtctacaaacggcacagccgagtgcaaaactgtaaagaggccggcagaggataatgatagggacactgtcccgggaatcccaaataaagtaggggttagaattgttacaatcagcgaccccaacaatgctggctgcagtgcaaccatggttgcggtcccagctggagcggacccaagcactgtagcgaaagtagcaatagaaagtgctgctcagcaaaagcagcagcatccaccgacctacatgcagagtgtggccccacagaacactcctatgccaccttcaccagctgtacaagtgcagggccagcctagcagttctcagccttctccagtcagtgcgtccagtcagcatgcagatccagtgagaaaacctgggcagaacttcatgtgtctgtggcagtcttgtaaaaagtggtttcagactccctcacaagtgttctatcatgcagctactgaacatggaggaaaagatgtgtatccggggcagtgtctttgggaaggctgtgagcctttccaacggcagaggttctctttcattacccacttacaggataagcactgttcaaaggatgccctgcttgcaggattaaagcaagatgaaccaggacaagtggcaaatcaaaaatcttctaccaagcagcccaccgtggggggcacaggctctgcgcccagagcccagaaggccattgcaagccaccccagtgctgcactcatggctctgcggagaggctcaaggaacctcgtcttccgggacttcacagatgaaaaagagggaccaataactaaacacatccgactaacagctgccttaatattaaaaaatattggtaaatactcagagtgtgggcgcagattgttaaagagacatgaaaacaacttatcagtgctcgccattagtaacatggaagcttcctctacccttgccaaatgcctttatgaacttaattttacagttcagagtaaagaacaagaaaaagactcagaaatgctgtagtgaatcctaccccactgacacagtggggtctcaaagtcaaatacatttcacatactgttactgaagaaagcaccaagtcttaatggagcagagaccatagaatgaattattttgtgtcctccatgatgctgagaggaaacttcgtattctgatctctgaacgaatccctttcttttctgttaaaaaaaaaaaatctaaaaaggaaaaaaaaaaaaaaaaaaacaaaaactgctgtgggattgtcaaccagcttatctgcaggatgtctcggatctggccaatcctgatggaaactggtgtgatcagaattctgtaccatccacattggaatatacatggaatagtgtaaaacctacgtgagcagatgaaatagaagcattaaatatttttatctatatccaaaaaggagcacatttttatatttacagaaccatttaagctggtttgaataacgacagagtttgagcacacctatcccccagcttcagaggggccaccaatatctagctgtggattgtgtgttttgtttagaatcagtagcttggttttcttacttgagccaatatattttcacttatttattatcataaaaatttaccagtctgaatagatcttgtaaatatttgtgaatagaatgaacactgttcataccactgcagccactggagatacatcctgtggtgtcctagaagcattatcggtaggctctaaagttttctagactttgctgtcaactgtaagtaattgtgatatattctacgcagtggatggatattctttaaatctgtgtaaatacttctgcaaaggtactgatgctgtaaagtcaaacagttttgtggaactgtgattttttttttcctccttttttggtttccttggcccccacttgggtttggtggggttttgtttttgttttgttttgtattatacaccttgtagaactcattttgctggctgaaagagtatggaataatatatctcatatgtcatttttgtagaagagaaactatttggatttcctttttgttggtttggttttccctaacacgtgtccgctgtacgcattcgtcacgtgcaagctcagcttgtgcagggttttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttcccccaagcgtgaaatgtatccacttataactgcctattgcctgttctattagcatccaaaaatgtggaaggcctcccaaccaccatttctgctgtgtccttaggatgtgcagtaaaaaaatatagacctgacagtttatgttatagaatggctttatttactttggtgactgtttatagtttttaaataaaagactgaacattttcttgagtcctttatttctgagtatgcttaagacattctaaaatttaaagtctagctgaaggcaaggtcaaacggtcacctacttactttatactttgtgattgtagagaacagaaaggtgcatcatgtgataggacaccatggtcacggtaggaaggagaccaggagaccaaatgttttgtttacagtagtatgagtagtagccccagagagcgagagacagttagggctcggttgccttactgtgtgtcccgcatctatctgactgagagctttgtttaccattcgactctaggtttcagtttaactaattcaggggcagcttcttggcaatgagcttcagtctggacagttcaaatatcttgattaatttagtaccaaaaagtaatttctccccaggggtctctgtgctctcagctctaactgtaagaaatgtgtggcgacacccagaacttggtattctcaggttggtggcgtttgacttcttcgccttagcctggggctgcccagcagacaccctgagtccaggtaccttactgtatccctcaaatatcgccagactaaaggtttctaagggcagatagttgtagaaatttatattcactgtgtttatctaaaaaaattgaggtttttgaaataatttttgtaacatcactgtttgcttgtcctcaaggtacctttttccttccaaagcaggaaattaccatggtggttagcctttagtagcagaaacgacaggcttaagaaagtggcttccatagtcaccatcctgtcacctcactgaattgcatcctgtagatgtagatttttgtgttaaaatgtataaatgtgtctttagtgcttttaagcaatggtctcagcagaattttctaaatgtatctgacctgacgaaaccaatttctagctccccttaggcttcccctccggcagctttacctgactaatggataagacttggtgggtaacgcggttgaagtgctcttgcagtccagggcctgcagaaccctcgcagtcacgaaaaggtgctccttgctagacagaaacttgctgacttccagtattgttatttttgtctaaagttctgtaaatacaagctttaatgttatctttgagagatctatgtaaataatagtcaagaacatagagactgtacaattctgtgttatatatgtgcctagtgctctgttggcacttaataaattttaagtaacaaaactgatgatcatatagtgaaggcatatttttcttccgacttgagacaggatatgactatatattaatgagactcaataaaccaagccacacatgaaaacttgtctcattactttatagccatgccatgtatgttttttaaactataaaatgacaataaaactgatttttgaaatgagtgttttggataagtgacttctgtcctgatcttataccataaataaagtactgaagacgaaatatgaagctcttacccaaaggagtagctgcttagaaacaagagtgaagcttgaagatcagccacacaggccacctcacactttgttcctgtttatcttacgatacagtaagggaaggcaccatttagagccagcttgtgttagttaaccactctcatactgcccaactcttgactgaactctggcactcaaatacttggagtgagcttccttccaaggccacagaacagagaccaaccgaattaccagctggttccatcatagctagtaaactttatctagcaacaatttccactccctgcattggtttgaaaaaaaaaatgcaaagagacagtatcaatgtatgtaagtggattcactaataatacaaccacactttaagtattaaagtggggtgagatggcttggtct

SEQ ID NO: 12 - protein, 1828 aa, Mus musculus
MANSTGKAPPDERRKGLAFLDELRQFHHSRGSPFKKIPAVGGKELDLHGLYTRVTTLGGFAKVSEKNQWGEIVEEFNFPRSCSNAAFALKQYYLRYLEKYEKVHHFGEDDDEVPPGNPKPQLPIGAIPSSYNYQQHSVSDYLRQSYGLSMDFNSPNDYNKLVLSLLSGLPNEVDFAINVCTLLSNESKHVMQLEKDPKIITLLLANAGVFDDTLGSFSSVFGEEWREKTDRDFVKFWKDIVDDNEVRDLISDRNKAHEDTPGEWIWESLFHPPRKLGINDIEGQRVLQIAVILRNLSFEESNVKLLAANRTCLRFLLLSAHSHFISLRQLGLDTLGNIAAELLLDPVDFRTTHLMFHTVTKCLMSRDRFLKMRGMEILGNLCKAEDNGVLICEYVDQDSYREIICHLTLPDVLLVTSTLEVLYMLTEMGDVACTKIAKVEKSIDVLVCLVSMDAQMFGPDALAAVKLIEHPSSSHQVLSEIRPQAIEQVQTQTHIASGPASRAVVAQHAAPPPGIVEIDSEKFACQWLNAHFEVNPDCSVSRAEMYSEYLSTCSKLARGGILTSTGFYKCLRTVFPNHTVKRVEDSTSSGQAHIHVIGVKRRALPLPIQMYYQQQPISTPVVRVDAVADLSPTPSPAGIPHGPQAAGNHFQRTPVTNQSSNLTATQMSFPVQGIHTVAQTVSRIPPNPSVHTHQQQNSPVTVIQNKAPIPCEVVKATVIQNSVPQTAVPVSISVGGAPAQNSVGQNHSAGPQPVTVVNSQTLLHHPSVMPQPSPLHTVVPGQVPSGTPVTVIQQTVPQSRMFGRVQSIPACTSTVSQGQQLITTSPQPMHTSSQQTAAGSQPQDTVIIAPPQYVTTSASNIVSATSVQNFQVATGQVVTIAGVPSPQPSRVGFQNIAPKPLPSQQVSPSVVQQPIQQPQQPAQQSVVIVSQPAQQGQAYAPAIHQIVLANPAALPAGQTVQLTGQPNITPSSSPSPVPPTNNQVPTAMSSSSTLQSQGPPPTVSQMLSVKRQQQQQHSPAAPAQQVQVQVQQPQQVQVQVQPQQPSAGVGQPAPNESSLIKQLLLPKRGPSTPGGKLILPAPQIPPPNNARAPSPQVVYQVANNQAAGFGVQGQTPAQQLLVGQQNVQLVQSAMPPAGGVQTVPISNLQILPGPLISNSPATIFQGTSGNQVTITVVPNTSFATATVSQGNAAQLIAPAGLSMSGAQASAGLQVQTLPAGQSACTTAPLPFKGDKIICQKEEEAKEATGLHVHERKIEVMENPSCRRGTTNTSNGDTSESELQVGSLLNGRKYSDSSLPPSNSGKLQSETSQCSLISNGPSLELGENGAPGKQNSEPVDMQDVKGDLKKALVNGICDFDKGDGSHLSKNIPNHKTSNHVGNGEISPVEPQGTSGATQQDTAKGDQLERVSNGPVLTLGGSPSTSSMQEAPSVATPPLSGTDLPNGPLASSLNSDVPQQRPSVVVSPHSTAPVIQGHQVIAVPHSGPRVTPSALSSDARSTNGTAECKTVKRPAEDNDRDTVPGIPNKVGVRIVTISDPNNAGCSATMVAVPAGADPSTVAKVAIESAAQQKQQHPPTYMQSVAPQNTPMPPSPAVQVQGQPSSSQPSPVSASSQHADPVRKPGQNFMCLWQSCKKWFQTPSQVFYHAATEHGGKDVYPGQCLWEGCEPFQRQRFSFITHLQDKHCSKDALLAGLKQDEPGQVANQKSSTKQPTVGGTGSAPRAQKAIASHPSAALMALRRGSRNLVFRDFTDEKEGPITKHIRLTAALILKNIGKYSECGRRLLKRHENNLSVLAISNMEASSTLAKCLYELNFTVQSKEQEKDSEML

SEQ ID NO: 13 - DNA, 2330 bp, Homo sapiens
gagaggggcatcgcgccgcccggcgcgcgccgcccccctgcctcgcggcgcggggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagcagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgaaaaaaaaaaaaaaaaaa

SEQ ID NO: 14 - protein, 652 aa, Homo sapiens
MGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDRVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEQITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 15 - DNA, 2327 bp, Homo sapiens
gagaggggcatcgcgccgcccggcgcgcgccgcccccctgcctcgcggcgcggggtctcgcgggccccgctcccgccctccgctcgcctggcccggaccggaagcggcgccgcacggcctgggcctggcgcggggggcgggcaccggggcccggtcggacatgggcaagaagcacaagaagcacaagtcggacaaacacctctacgaggagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggaggataaaaagaagcgagatcgagaccgggtggagaatgaggcagaaaaagatctccagtgtcacgcccctgtgagattagacttgcctcctgagaagcctctcacaagctctttagccaaacaagaagaagtagaacagacaccccttcaagaagctttgaatcaactgatgagacaattgcagagaaaagatccaagtgctttcttttcatttcctgtgactgattttattgctcctggctactccatgatcattaaacacccaatggattttagtaccatgaaagaaaagatcaagaacaatgactatcagtccatagaagaactaaaggataacttcaaactaatgtgtactaatgccatgatttacaataaaccagagaccatttattataaagctgcaaagaagctgttgcactcaggaatgaaaattcttagccaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagaaagacaaagatatgcttgaagataagtttaaaagcaataatttagagagagagcaggagcagcttgaccgcatcgtgaaggaatctggaggaaagctgaccaggcggcttgtgaacagtcagtgcgaatttgaaagaagaaaaccagatggaacaacgacgttgggacttctccatcctgtggatcccattgtaggagagccaggctactgccctgtgagactgggaatgacaactggaagacttcagtctggagtgaatactttgcaggggttcaaagaggataaaaggaacaaagtcactccagtgttatatttgaattatgggccctacagttcttatgcaccgcattatgactccacatttgcaaatatcagcaaggatgattctgatttaatctattcaacctatggggaagactctgatcttccaagtgatttcagcatccatgagtttttggccacgtgccaagattatccgtatgtcatggcagatagtttactggatgttttaacaaaaggagggcattccaggaccctacaagagatggagatgtcattgcctgaagatgaaggccatactaggacacttgacacagcaaaagaaatggagattacagaagtagagccaccagggcgtttggactccagtactcaagacaggctcatagcgctgaaagcagtaacaaattttggcgttccagttgaagtttttgactctgaagaagctgaaatattccagaagaaacttgatgagaccaccagattgctcagggaactccaggaagcccagaatgaacgtttgagcaccagaccccctccgaacatgatctgtctcttgggtccctcatacagagaaatgcatcttgctgaacaagtgaccaataatcttaaagaacttgcacagcaagtaactccaggtgatatcgtaagcacgtatggagttcgaaaagcaatggggatttccattccttcccccgtcatggaaaacaactttgtggatttgacagaagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgaaaaaaaaaaaaaaaaaa

SEQ ID NO: 16 - protein, 651 aa, Homo sapiens
MGKKHKKHKSDKHLYEEYVEKPLKLVLKVGGNEVTELSTGSSGHDSSLFEDKNDHDKHKDRKRKKRKKGEKQIPGEEKGRKRRRVKEDKKKRDRDRVENEAEKDLQCHAPVRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMADLQKTRKQKDGTDTSQSGEDGGCWQREREDSGDAEAHAFKSPSKENKKKDKDMLEDKFKSNNLEREQEQLDRIVKESGGKLTRRLVNSQCEFERRKPDGTTTLGLLHPVDPIVGEPGYCPVRLGMTTGRLQSGVNTLQGFKEDKRNKVTPVLYLNYGPYSSYAPHYDSTFANISKDDSDLIYSTYGEDSDLPSDFSIHEFLATCQDYPYVMADSLLDVLTKGGHSRTLQEMEMSLPEDEGHTRTLDTAKEMEITEVEPPGRLDSSTQDRLIALKAVTNFGVPVEVFDSEEAEIFQKKLDETTRLLRELQEAQNERLSTRPPPNMICLLGPSYREMHLAEQVTNNLKELAQQVTPGDIVSTYGVRKAMGISIPSPVMENNFVDLTEDTEEPKKTDVAECGPGGS

SEQ ID NO: 17 - DNA, 2370 bp, Mus musculus
ggtttgccggcctctcgccctctcgccactggtgtcgcgcttcggtcgcgtcccgcgcgtggttttttttttttctcgtgagggacctcgcgccgccgggcgcgtgccgtccccctgcctcgcggcgcgggctctcgcgggccccgctcccgccctccgctcgcctggcccggaccggaagcggcgccgcacggcctgggcctggcgcggggggcgggctctggggcccggtcggacatgggcaagaagcacaagaagcacaagtcggaccgccacttctacgaggagtacgtggagaagcccctgaagctggtcctcaaagtcggggggagcgaggtcaccgagctctccacgggcagctccgggcacgactccagcctcttcgaagacagaagcgaccatgacaaacacaaggacagaaaacggaaaaagaggaagaaaggcgagaagcaggctccgggggaagagaaggggagaaaacggagaagagtcaaggaggataaaaagaagcgggatcgagaccgtgcagagaatgaggtggacagagatctccagtgtcatgtccctataagattagacttacctcctgagaagcctcttacaagctcgttagccaaacaagaagaagtagaacagacaccccttcaggaagctttgaatcagctcatgagacaattgcaaagaaaagacccaagtgctttcttttcatttcctgtgacggattttattgcgcctggctactccatgattattaaacacccaatggattttagtaccatgaaagaaaagatcaagaataacgactaccagtccatagaagaactaaaggataacttcaagctaatgtgtactaatgcaatgatttacaataagccagagaccatttattataaagctgcaaagaagctgttgcactcagggatgaaaattctcagtcaggagagaattcagagcctgaagcagagtatagacttcatgtcagacttgcagaaaactcggaagcagaaagaacgaacagatgcctgtcagagtggggaggacagcggctgctggcagcgcgagagggaagactctggagatgctgaaacacaggccttcagaagccccgctaaggacaataaaaggaaagacaaagatgtgcttgaagacaaatggagaagcagcaactcagaaagggagcatgagcagattgagcgcgttgtccaggagtcaggaggcaagctaacacggcggctggcaaacagtcagtgtgaatttgaaagaagaaaaccagatgggacaacaacactggggcttctccatcctgtggatcccattgtgggagagccaggctactgccctgtgagattggggatgacaactggaagactgcagtctggagtgaacactctgcaggggttcaaagaggataaaaggaacagagtaaccccagtattatacttgaattatggaccctacagttcttatgccccacattatgactctacatttgccaatattagcaaagatgattctgatttaatctactcaacatatggggaagactctgaccttccaaacaatttcagcatctctgagtttttggccacatgccaagattacccgtatgttatggcagatagtttactggatgttctaacaaaaggaggacattccaggagcctgcaggacttggacatgtcatctcctgaagatgaaggccagaccagagcattggacacagcaaaagaagcagagattacacaaatagagccaacagggcgtttggagtccagcagtcaggacaggctcacagcactgcaagctgtaacaacctttggtgctccagctgaagtctttgactccgaagaggctgaggtgttccagaggaagcttgatgagacgacaagattgctcagggagctccaggaggcacagaatgagcgactgagcactaggcctcctcccaatatgatctgtctcctgggtccttcttacagagaaatgtaccttgctgaacaagtgaccaataacctcaaagaactcacacagcaagtgactccaggtgatgttgtaagcatacacggagtgcgaaaagcaatggggatttctgttccttcccccatcgtgggaaacagcttcgtagatttgacaggagagtgtgaagaacctaaggagaccagcactgctgagtgtgggcctgacgcgagctgaactagcctggtatttgattctattatgtacatagtttttcattctgaacttggaggtgcttttcagaagatattaactatttgtaaattgtgttttaattaagctttgggacagttccttttaatgttccaaagattggccttgtattaggaaataaagctgaacctgggactgtga

SEQ ID NO: 18 - protein, 651 aa, Mus musculus
MGKKHKKHKSDRHFYEEYVEKPLKLVLKVGGSEVTELSTGSSGHDSSLFEDRSDHDKHKDRKRKKRKKGEKQAPGEEKGRKRRRVKEDKKKRDRDRAENEVDRDLQCHVPIRLDLPPEKPLTSSLAKQEEVEQTPLQEALNQLMRQLQRKDPSAFFSFPVTDFIAPGYSMIIKHPMDFSTMKEKIKNNDYQSIEELKDNFKLMCTNAMIYNKPETIYYKAAKKLLHSGMKILSQERIQSLKQSIDFMSDLQKTRKQKERTDACQSGEDSGCWQREREDSGDAETQAFRSPAKDNKRKDKDVLEDKWRSSNSEREHEQIERVVQESGGKLTRRLANSQCEFERRKPDGTTTLGLLHPVDPIVGEPGYCPVRLGMTTGRLQSGVNTLQGFKEDKRNRVTPVLYLNYGPYSSYAPHYDSTFANISKDDSDLIYSTYGEDSDLPNNFSISEFLATCQDYPYVMADSLLDVLTKGGHSRSLQDLDMSSPEDEGQTRALDTAKEAEITQIEPTGRLESSSQDRLTALQAVTTFGAPAEVFDSEEAEVFQRKLDETTRLLRELQEAQNERLSTRPPPNMICLLGPSYREMYLAEQVTNNLKELTQQVTPGDVVSIHGVRKAMGISVPSPIVGNSFVDLTGECEEPKETSTAECGPDAS

SEQ ID NO: 19 - DNA, 1692 bp, Homo sapiens
ggcggcggcggcagcggcggcggcggccgggacaaggcggaggcgacggcggcggcggcggcgcggggcgctcgggctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagatttagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaaaaaaaaaaaaaaaaaaaa

SEQ ID NO: 20 - protein, 498 aa, Homo sapiens
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 21 - DNA, 1686 bp, Homo sapiens
ggcggcggcggcagcggcggcggcggccgggacaaggcggaggcgacggcggcggcggcggcgcggggcgctcgggctgatggcggcggcggccgggcccggggctgcgctgtccccgcggccgtgcgacagcgacccagccacccccggagcgcagtccccgaaggatgataatgaagataattcaaatgatgggacccagccatccaaaaggaggcgaatgggctcaggagatagttctaggagttgtgaaacttcaagtcaagatcttggttttagttactatccagcagaaaacttgatagagtacaaatggccacctgatgaaacaggagaatactatatgcttcaagaacaagtcagtgaatatttgggtgtgacctcctttaaaaggaaatatccagagcgacgagatttgtctcacaaggagaaactctacctgagagagctaaatgtcattactgaaactcagtgcactctaggcttaacagcattgcgcagtgatgaagtgattgatttaatgataaaagaatatccagccaaacatgctgagtattctgttattctacaagaaaaagaacgtcaacgaattacagaccattataaagagtattcccaaatgcaacaacagaatactcagaaagttgaagccagtaaagtgcctgagtatattaagaaagctgccaaaaaagcagcagaatttaatagcaacttaaaccgggaacgcatggaagaaagaagagcttattttgacttgcagacacatgttatccaggtacctcaagggaagtacaaagttttgccaacagagcgaacaaaggtcagttcttacccagtggctctcatccccggacagttccaggaatattataagaggtactcaccagatgagctgcggtatctgccattaaacacagccctgtatgagccccctctggatcctgagctccctgctctagacagtgatggtgattcagatgatggcgaagatggtcgaggtgatgagaaacggaaaaataaaggcacttcggacagctcctctggcaatgtatctgaaggggaaagccctcctgacagccaggaggactctttccagggaagacagaaatcaaaagacaaagctgccactccaagaaaagatggtcccaaacgttctgtactgtccaagtcagttcctgggtacaagccaaaggtcattccaaatgctatatgtggaatttgtctgaagggtaaggagtccaacaagaaaggaaaggctgaatcacttatacactgctcccaatgtgagaatagtggccatccttcttgcctggatatgacaatggagcttgtttctatgattaagacctacccatggcagtgtatggaatgtaaaacatgcattatatgtggacaaccccaccatgaagaagaaatgatgttctgtgatatgtgtgacagaggttatcatactttttgtgtgggccttggtgctattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgcaaaaaaaaaaaaaaaaaaaaa

SEQ ID NO: 22 - protein, 496 aa, Homo sapiens
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 23 - DNA, 1665 bp, Mus musculus
gcggcggcggccgctgggactaggcgaaggcggcgacgacgacggaggcgcggggcgcttgggctgatggcagcggccgggcccggggcggcgctgtccccggggcggtgcgacagcgacccggcctcccccggagcgcagtccccaaaggatgataatgaagataactcaaatgatgggacccatccatgtaaaaggaggcgaatgggctcaggagacagctcaagaagttgtgagacttcaagtcaagatcttagcttcagttactacccagcagaaaacttaatcgaatacaaatggccacctgatgaaacaggagaatactatatgcttcaggagcaagtcagtgaatatctgggtgtgacctccttcaagcggaaatatccagatttagagcgacgagatttatctcacaaggagaaactatacctgagagaattaaacgtcatcacggaaacacagtgcacactgggtttaacagcattgcgcagtgatgaagtgattgacttaatgataaaagaatatccagctaaacacgctgaatattcggttatcctacaagaaaaggaacgtcagagaattacagatcattataaagagtattctcaaatgcaacaacagagtactcagaaagtcgaagccagcaaagtacctgagtacattaagaaagcagccaagaaggcagctgagttcaacagcaacttaaaccgggagcgcatggaagaaagaagagcctattttgacttacagacacatgttatccaagtgcctcaaggaaagtacaaagtgttgccgacagaccgaacgaaggtcagttcctacccagtggctctcatcccgggacagttccaggagtattataagaggtactcaccagatgagcttcggtacttgccattaaacacagccctgtatgagccgcccctggacccagagctcccggcactagatagtgatggagactcagatgatggcgaagatggcggaggggatgagaagcggaagaataaaggcacttcggacagctcctcaggcaatgtgtctgaaggagacagcccccctgacagccaggaggacaccttccacggaagacagaaatcaaaagacaaaatggccactccaagaaaagacggctccaaacgttctgtactgtccaaatcagctcctgggtacaagccaaaggtcattccaaatgctctatgtggaatttgtctgaagggtaaggagtccaacaagaaaggaaaggctgaatcacttatacactgctcccagtgtgataacagtggccacccttcttgcttggatatgaccatggagcttgtttctatgattaagacctacccatggcagtgtatggaatgtaagacatgcattatatgtggacagccccaccatgaagaagaaatgatgttctgtgatgtgtgtgacagaggttatcatactttttgtgtgggccttggtgctattccttcaggtcgctggatttgtgactgttgtcagcgagctcccccaacacccaggaaagtgggcagaagggggaaaaacagcaaagaggggtaaaataggctttgaccctcatgtttgggatatttggtgccaatttatttacaacactttcatttttatgccaataaaaacttttttgaaattaacgatgaccttaaa

SEQ ID NO: 24 - protein, 497 aa, Mus musculus
MAAAGPGAALSPGRCDSDPASPGAQSPKDDNEDNSNDGTHPCKRRRMGSGDSSRSCETSSQDLSFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQSTQKVEASKVPEYIKKAAKKAAEFNSNLNRERMEERRAYFDLQTHVIQVPQGKYKVLPTDRTKVSSYPVALIPGQFQEYYKRYSPDELRYLPLNTALYEPPLDPELPALDSDGDSDDGEDGGGDEKRKNKGTSDSSSGNVSEGDSPPDSQEDTFHGRQKSKDKMATPRKDGSKRSVLSKSAPGYKPKVIPNALCGICLKGKESNKKGKAESLIHCSQCDNSGHPSCLDMTMELVSMIKTYPWQCMECKTCIICGQPHHEEEMMFCDVCDRGYHTFCVGLGAIPSGRWICDCCQRAPPTPRKVGRRGKNSKEG

SEQ ID NO: 25 - DNA, 8585 bp, Homo sapiens
cagaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgccgcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgccgccgccgccgccctcggagctgaagaaagccgagcagcagcagcgggaggaggcggggggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcagaattacaagcggccaatggatggcacatatggccctcctgccaagcggcacgaaggggagatgtacagcgtgccatacagcactgggcaggggcagcctcagcagcagcagttgcccccagcccagccccagcctgccagccagcaacaagctgcccagccttcccctcagcaagatgtatacaaccagtatggcaatgcctatcctgccactgccacagctgctactgagcgccgaccagcaggcggcccccagaaccaatttccattccagtttggccgagaccgtgtctctgcaccccctggcaccaatgcccagcaaaacatgccaccacaaatgatgggcggccccatacaggcatcagctgaggttgctcagcaaggcaccatgtggcaggggcgtaatgacatgacctataattatgccaacaggcagagcacgggctctgccccccagggccccgcctatcatggcgtgaaccgaacagatgaaatgctgcacacagatcagagggccaaccacgaaggctcgtggccttcccatggcacacgccagcccccatatggtccctctgcccctgtgccccccatgacaaggccccctccatctaactaccagcccccaccaagcatgcagaatcacattcctcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaagacttt

SEQ ID NO: 26 - protein, 2285 aa, Homo sapiens
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQNYKRPMDGTYGPPAKRHEGEMYSVPYSTGQGQPQQQQLPPAQPQPASQQQAAQPSPQQDVYNQYGNAYPATATAATERRPAGGPQNQFPFQFGRDRVSAPPGTNAQQNMPPQMMGGPIQASAEVAQQGTMWQGRNDMTYNYANRQSTGSAPQGPAYHGVNRTDEMLHTDQRANHEGSWPSHGTRQPPYGPSAPVPPMTRPPPSNYQPPPSMQNHIPQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 27 - DNA, 7874 bp, Homo sapiens
cagaaagcggagagtcacagcggggccaggccctggggagcggagcctccaccgcccccctcattcccaggcaagggcttggggggaatgagccgggagagccgggtcccgagcctacagagccgggagcagctgagccgccggcgcctcggccgccgccgccgcctcctcctcctccgccgccgccagcccggagcctgagccggcggggcgggggggagaggagcgagcgcagcgcagcagcggagccccgcgaggcccgcccgggcgggtggggagggcagcccgggggactgggccccggggcggggtgggagggggggagaagacgaagacagggccgggtctctccgcggacgagacagcggggatcatggccgcgcaggtcgcccccgccgccgccagcagcctgggcaacccgggcgaggcggcggcggcggcagcggccgagcgcggggaaatgaaggcagccgccgggcaggaaagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcacggagccgcccggcggcggcggtggcggcagcagcgatggggtgggggcgcctcctcactcagccgcggccgccttgccgcccccagcctacggcttcgggcaaccctacggccggagcccgtctgccgtcgccgccgccgcggccgccgtcttccaccaacaacatggcggacaacaaagccctggcctggcagcgctgcagagcggcggcggcgggggcctggagccctacgcggggccccagcagaactctcacgaccacggcttccccaaccaccagtacaactcctactaccccaaccgcagcgcctaccccccgcccgccccggcctacgcgctgagctccccgagaggtggcactccgggctccggcgcggcggcggctgccggctccaagccgcctccctcctccagcgcctccgcctcctcgtcgtcttcgtccttcgctcagcagcgcttcggggccatggggggaggcggcccctccgcggccggcgggggaactccccagcccaccgccacccccaccctcaaccaactgctcacgtcgcccagctcggcccggggctaccagggctaccccgggggcgactacagtggcgggccccaggacgggggcgccggcaagggcccggcggacatggcctcgcagtgttggggggctgcggcggcggcagctgcggcggcggccgcctcgggaggggcccaacaaaggagccaccacgcgcccatgagccccgggagcagcggcggcggggggcagccgctcgcccggacccctcagccatccagtccaatggatcagatgggcaagatgagacctcagccatatggcgggactaacccatactcgcagcaacagggacctccgtcaggaccgcagcaaggacatgggtacccagggcagccatacgggtcccagaccccgcagcggtacccgatgaccatgcagggccgggcgcagagtgccatgggcggcctctcttatacacagcagattcctccttatggacaacaaggccccagcgggtatggtcaacagggccagactccatattacaaccagcaaagtcctcaccctcagcagcagcagccaccctactcccagcaaccaccgtcccagacccctcatgcccaaccttcgtatcagcagcagccacagtctcaaccaccacagctccagtcctctcagcctccatactcccagcagccatcccagcctccacatcagcagtccccggctccatacccctcccagcagtcgacgacacagcagcacccccagagccagcccccctactcacagccacaggctcagtctccttaccagcagcagcaacctcagcagccagcaccctcgacgctctcccagcaggctgcgtatcctcagccccagtctcagcagtcccagcaaactgcctattcccagcagcgcttccctccaccgcaggagctatctcaagattcatttgggtctcaggcatcctcagccccctcaatgacctccagtaagggagggcaagaagatatgaacctgagccttcagtcaagaccctccagcttgcctgatctatctggttcaatagatgacctccccatggggacagaaggagctctgagtcctggagtgagcacatcagggatttccagcagccaaggagagcagagtaatccagctcagtctcctttctctcctcatacctcccctcacctgcctggcatccgaggcccttccccgtcccctgttggctctcccgccagtgttgctcagtctcgctcaggaccactctcgcctgctgcagtgccaggcaaccagatgccacctcggccacccagtggccagtcggacagcatcatgcatccttccatgaaccaatcaagcattgcccaagatcgaggttatatgcagaggaacccccagatgccccagtacagttccccccagcccggctcagccttatctccgcgtcagccttccggaggacagatacacacaggcatgggctcctaccagcagaactccatggggagctatggtccccaggggggtcagtatggcccacaaggtggctaccccaggcagccaaactataatgccttgcccaatgccaactaccccagtgcaggcatggctggaggcataaaccccatgggtgccggaggtcaaatgcatggacagcctggcatcccaccttatggcacactccctccagggaggatgagtcacgcctccatgggcaaccggccttatggccctaacatggccaatatgccacctcaggttgggtcagggatgtgtcccccaccagggggcatgaaccggaaaacccaagaaactgctgtcgccatgcatgttgctgccaactctatccaaaacaggccgccaggctaccccaatatgaatcaagggggcatgatgggaactggacctccttatggacaagggattaatagtatggctggcatgatcaaccctcagggacccccatattccatgggtggaaccatggccaacaattctgcagggatggcagccagcccagagatgatgggccttggggatgtaaagttaactccagccaccaaaatgaacaacaaggcagatgggacacccaagacagaatccaaatccaagaaatccagttcttctactacaaccaatgagaagatcaccaagttgtatgagctgggtggtgagcctgagaggaagatgtgggtggaccgttatctggccttcactgaggagaaggccatgggcatgacaaatctgcctgctgtgggtaggaaacctctggacctctatcgcctctatgtgtctgtgaaggagattggtggattgactcaggtcaacaagaacaaaaaatggcgggaacttgcaaccaacctcaatgtgggcacatcaagcagtgctgccagctccttgaaaaagcagtatatccagtgtctctatgcctttgaatgcaagattgaacggggagaagaccctcccccagacatctttgcagctgctgattccaagaagtcccagcccaagatccagcctccctctcctgcgggatcaggatctatgcaggggccccagactccccagtcaaccagcagttccatggcagaaggaggagacttaaagccaccaactccagcatccacaccacacagtcagatccccccattgccaggcatgagcaggagcaattcagttgggatccaggatgcctttaatgatggaagtgactccacattccagaagcggaattccatgactccaaaccctgggtatcagcccagtatgaatacctctgacatgatggggcgcatgtcctatgagccaaataaggatccttatggcagcatgaggaaagctccagggagtgatcccttcatgtcctcagggcagggccccaacggcgggatgggtgacccctacagtcgtgctgccggccctgggctaggaaatgtggcgatgggaccacgacagcactatccctatggaggtccttatgacagagtgaggacggagcctggaatagggcctgagggaaacatgagcactggggccccacagccgaatctcatgccttccaacccagactcggggatgtattctcctagccgctaccccccgcagcagcagcagcagcagcagcaacgacatgattcctatggcaatcagttctccacccaaggcaccccttctggcagccccttccccagccagcagactacaatgtatcaacagcaacagcaggtatccagccctgctcccctgccccggccaatggagaaccgcacctctcctagcaagtctccattcctgcactctgggatgaaaatgcagaaggcaggtcccccagtacctgcctcgcacatagcacctgcccctgtgcagccccccatgattcggcgggatatcaccttcccacctggctctgttgaagccacacagcctgtgttgaagcagaggaggcggctcacaatgaaagacattggaaccccggaggcatggcgggtaatgatgtccctcaagtctggtctcctggcagagagcacatgggcattagataccatcaacatcctgctgtatgatgacaacagcatcatgaccttcaacctcagtcagctcccagggttgctagagctccttgtagaatatttccgacgatgcctgattgagatctttggcattttaaaggagtatgaggtgggtgacccaggacagagaacgctactggatcctgggaggttcagcaaggtgtctagtccagctcccatggagggtggggaagaagaagaagaacttctaggtcctaaactagaagaggaagaagaagaggaagtagttgaaaatgatgaggagatagccttttcaggcaaggacaagccagcttcagagaatagtgaggagaagctgatcagtaagtttgacaagcttccagtaaagatcgtacagaagaatgatccatttgtggtggactgctcagataagcttgggcgtgtgcaggagtttgacagtggcctgctgcactggcggattggtgggggggacaccactgagcatatccagacccacttcgagagcaagacagagctgctgccttcccggcctcacgcaccctgcccaccagcccctcggaagcatgtgacaacagcagagggtacaccagggacaacagaccaggaggggcccccacctgatggacctccagaaaaacggatcacagccactatggatgacatgttgtctactcggtctagcaccttgaccgaggatggagctaagagttcagaggccatcaaggagagcagcaagtttccatttggcattagcccagcacagagccaccggaacatcaagatcctagaggacgaaccccacagtaaggatgagaccccactgtgtacccttctggactggcaggattctcttgccaagcgctgcgtctgtgtgtccaataccattcgaagcctgtcatttgtgccaggcaatgactttgagatgtccaaacacccagggctgctgctcatcctgggcaagctgatcctgctgcaccacaagcacccagaacggaagcaggcaccactaacttatgaaaaggaggaggaacaggaccaaggggtgagctgcaacaaagtggagtggtggtgggactgcttggagatgctccgggaaaacaccttggttacactcgccaacatctcggggcagttggacctatctccataccccgagagcatttgcctgcctgtcctggacggactcctacactgggcagtttgcccttcagctgaagcccaggaccccttttccaccctgggccccaatgccgtcctttccccgcagagactggtcttggaaaccctcagcaaactcagcatccaggacaacaatgtggacctgattctggccacaccccccttcagccgcctggagaagttgtatagcactatggtgcgcttcctcagtgaccgaaagaacccggtgtgccgggagatggctgtggtactgctggccaacctggctcagggggacagcctggcagctcgtgccattgcagtgcagaagggcagtatcggcaacctcctgggcttcctagaggacagccttgccgccacacagttccagcagagccaggccagcctcctccacatgcagaacccaccctttgagccaactagtgtggacatgatgcggcgggctgcccgcgcgctgcttgccttggccaaggtggacgagaaccactcagagtttactctgtacgaatcacggctgttggacatctcggtatcaccgttgatgaactcattggtttcacaagtcatttgtgatgtactgtttttgattggccagtcatgacagccgtgggacacctcccccccccgtgtgtgtgtgcgtgtgtggagaacttagaaactgactgttgccctttatttatgcaaaaccacctcagaatccagtttaccctgtgctgtccagcttctcccttgggaaaaagtctctcctgtttctctctcctccttccacctcccctccctccatcacctcacgcctttctgttccttgtcctcaccttactcccctcaggaccctaccccaccctctttgaaaagacaaagctctgcctacatagaagactttttttattttaaccaaagttactgttgtttacagtgagtttggggaaaaaaaataaaataaaaatggctttcccagtccttgcatcaacgggatgccacatttcataactgtttttaatggtaaaaaaaaaaaaaaaaaatacaaaaaaaaattctgaaggacaaaaaaggtgactgctgaactgtgtgtggtttattgttgtacattcacaatcttgcaggagccaagaagttcgcagttgtgaacagaccctgttcactggagaggcctgtgcagtagagtgtagaccctttcatgtactgtactgtacacctgatactgtaaacatactgtaataataatgtctcacatggaaacagaaaacgctgggtcagcagcaagctgtagtttttaaaaatgtttttagttaaacgttgaggagaaaaaaaaaaaaggcttttcccccaaagtatcatgtgtgaacctacaacaccctgacctctttctctcctccttgattgtatgaataaccctgagatcacctcttagaactggttttaacctttagctgcagcggctacgctgccacgtgtgtatatatatgacgttgtacattgcacatacccttggatccccacagtttggtcctcctcccagctacccctttatagtatgacgagttaacaagttggtgacctgcacaaagcgagacacagctatttaatctcttgccagatatcgcccctcttggtgcgatgctgtacaggtctctgtaaaaagtccttgctgtctcagcagccaatcaacttatagtttatttttttctgggtttttgttttgttttgttttctttctaatcgaggtgtgaaaaagttctaggttcagttgaagttctgatgaagaaacacaattgagattttttcagtgataaaatctgcatatttgtatttcaacaatgtagctaaaacttgatgtaaattcctcctttttttccttttttggcttaatgaatatcatttattcagtatgaaatctttatactatatgttccacgtgttaagaataaatgtacattaaatcttggtaagacttt

SEQ ID NO: 28 - protein, 2068 aa, Homo sapiens
MAAQVAPAAASSLGNPPPPPPSELKKAEQQQREEAGGEAAAAAAAERGEMKAAAGQESEGPAVGPPQPLGKELQDGAESNGGGGGGGAGSGGGPGAEPDLKNSNGNAGPRPALNNNLTEPPGGGGGGSSDGVGAPPHSAAAALPPPAYGFGQPYGRSPSAVAAAAAAVFHQQHGGQQSPGLAALQSGGGGGLEPYAGPQQNSHDHGFPNHQYNSYYPNRSAYPPPAPAYALSSPRGGTPGSGAAAAAGSKPPPSSSASASSSSSSFAQQRFGAMGGGGPSAAGGGTPQPTATPTLNQLLTSPSSARGYQGYPGGDYSGGPQDGGAGKGPADMASQCWGAAAAAAAAAAASGGAQQRSHHAPMSPGSSGGGGQPLARTPQPSSPMDQMGKMRPQPYGGTNPYSQQQGPPSGPQQGHGYPGQPYGSQTPQRYPMTMQGRAQSAMGGLSYTQQIPPYGQQGPSGYGQQGQTPYYNQQSPHPQQQQPPYSQQPPSQTPHAQPSYQQQPQSQPPQLQSSQPPYSQQPSQPPHQQSPAPYPSQQSTTQQHPQSQPPYSQPQAQSPYQQQQPQQPAPSTLSQQAAYPQPQSQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYSSPQPGSALSPRQPSGGQIHTGMGSYQQNSMGSYGPQGGQYGPQGGYPRQPNYNALPNANYPSAGMAGGINPMGAGGQMHGQPGIPPYGTLPPGRMSHASMGNRPYGPNMANMPPQVGSGMCPPPGGMNRKTQETAVAMHVAANSIQNRPPGYPNMNQGGMMGTGPPYGQGINSMAGMINPQGPPYSMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFNDGSDSTFQKRNSMTPNPGYQPSMNTSDMMGRMSYEPNKDPYGSMRKAPGSDPFMSSGQGPNGGMGDPYSRAAGPGLGNVAMGPRQHYPYGGPYDRVRTEPGIGPEGNMSTGAPQPNLMPSNPDSGMYSPSRYPPQQQQQQQQRHDSYGNQFSTQGTPSGSPFPSQQTTMYQQQQQVSSPAPLPRPMENRTSPSKSPFLHSGMKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 29 - DNA, 8175 bp, Mus musculus
atggccgcgcaggtcgcccccgccgccgccagcagcctgggcaacccgccgccgccgccctcggagctgaagaaagccgagcagcaacagcgggaggaggcggggggcgaggcggcggcggcagcggccgagcgcggggaaatgaaggcagccgccgggcaggagagcgagggccccgccgtggggccgccgcagccgctgggaaaggagctgcaggacggggccgagagcaatgggggtggcggcggcggcggagccggcagcggcggcgggcccggcgcggagccggacctgaagaactcgaacgggaacgcgggccctaggcccgccctgaacaataacctcccggagccgcccggcggcggcggcggcggcggcagcagcagcagcgacggggtgggggcgcctcctcactcggccgcggccgccctgccgcccccagcctacggcttcgggcaagcctacggccggagcccgtctgccgtcgccgccgcggcggccgccgtcttccaccaacaacatggcggacaacaaagccctggcctggcagcgctgcagagcggcggcggcgggggcttggagccctacgccgggccccagcagaactcgcacgaccacggcttccccaaccaccagtacaactcctactaccccaaccgcagcgcctaccccccgcctccccaggcctacgcgctgagctccccgagaggtggcactccgggctccggcgcggcggcggccgccggctccaagccgcctccctcctccagcgcctctgcctcctcgtcgtcttcgtccttcgcacagcagcgcttcggggccatggggggaggcggcccctcagcggccggcgggggaactccccagcccaccgccacccccaccctcaaccaactgctcacgtcgcccagctcggcccgtggctaccagggctaccccgggggcgactacggcggcgggccccaggacgggggcgcgggcaaaggcccggcggacatggcctcgcagtgctggggggctgcggcggcggcggcggcggcggcagcggccgtctcgggaggggcccaacaaaggagccaccacgcgcccatgagccccgggagcagcggcggcggggggcagccgctcgcccggacccctcagtcatccagtccaatggatcagatgggaaagatgagacctcagccgtatggtgggactaacccatactcgcaacaacagggacctccttcaggaccgcaacaaggacatgggtacccagggcagccatatgggtcccagactccacagcggtaccccatgaccatgcagggccgggctcagagtgccatgggcagcctctcttatgcacagcagattccaccttatggccagcaaggccccagtgcgtatggccagcagggccagactccatactataaccagcaaagtcctcatccccagcagcagccaccttacgcccagcaaccaccatcccagacccctcatgcccagccttcgtatcagcagcagccgcagactcagcaaccacagcttcagtcctctcagcctccatattcccagcagccatcccagcctccacatcagcagtccccaactccatatccctcccagcagtccaccacacaacagcatccccagagccagcccccctactcacaaccacaggcacagtctccctaccagcagcagcaacctcagcagccagcatcctcgtcgctctcccagcaggctgcatatcctcagccccagcctcagcagtcccagcaaactgcctattcccagcagcgcttccctccaccacaggagctttctcaagattcatttgggtctcaggcatcctcagccccctcaatgacctccagtaagggagggcaagaagatatgaacctgagtcttcagtcaaggccctccagcttgcctgatctgtctggttcaatcgatgatctccccatggggacagaaggagctctgagtcctggcgtgagcacatcagggatttccagcagccaaggagagcagagcaatccagctcagtctcccttttctcctcacacctcccctcacctgcctggcatccgaggcccgtccccgtcccctgttggctctcctgccagtgtcgcgcagtctcgctcaggaccactctcgcctgctgcagtgccaggcaaccagatgccacctcggccacccagtggccagtcagacagcatcatgcacccttccatgaaccaatcaagcattgcccaagatcgaggttatatgcagaggaacccccagatgccccagtacacttcccctcagcctggctcggccttatccccacgtcagccgtctggaggacagatgcactcgggcgtgggctcctaccagcagaactccatggggagctacggcccccagggcagtcagtatggcccacaaggaggctatcctaggcagcctaactataatgccttgcccaacgccaactaccccaatgcaggcatggccggaagtatgaaccctatgggtgctggaggtcagatgcatgggcagcctggaatcccaccttacggcacactccctccagggagaatggctcatgcgtctatgggcaacaggccctatggccctaatatggccaatatgccacctcaggttgggtcagggatgtgtcctccaccagggggaatgaacaggaaaactcaagagtctgctgttgccatgcatgttgctgccaactctatccaaaacaggccaccaggctacccaaatatgaatcaagggggcatgatgggaactggacctccctatggacaggggatcaatagtatggctggcatgatcaaccctcagggacccccatatcctatgggtggaaccatggccaacaattcagcagggatggcagccagcccagagatgatgggccttggggatgttaagttaactcccgccacaaaaatgaacaacaaggcagatggaacacccaagacagaatccaaatctaagaaatccagttcttctaccaccaccaatgagaagatcaccaaattgtatgagttgggtggtgagcccgagaggaagatgtgggtggaccggtacctggccttcacagaggagaaggccatgggcatgacaaatctgcctgctgtggggaggaagcctctggacctctatcgcctctatgtgtctgtgaaggagattggtgggttgactcaggtcaacaagaacaaaaaatggcgggaacttgcaaccaacctcaatgtgggtacatcaagcagtgctgccagctcactgaaaaagcagtatatccaatgtctctatgcctttgagtgcaagatcgagcgtggagaagaccctccccccgatatcttcgcagctgctgactccaagaagtcccaacccaagatccagcccccctctcctgcgggatcagggtctatgcaggggccacaaactcctcagtcaaccagcagttctatggcagaaggaggagacctgaagccaccaactccagcatccacaccacatagtcaaattccccccttaccaggcatgagcaggagcaactcagtcggaatccaggatgcctttcctgatggaagtgaccccacattccagaagcggaattccatgactccaaaccctgggtaccagcccagtatgaatacctctgacatgatggggcgcatgtcctatgagccaaataaggatccttatggcagcatgaggaaagcgccaggaagtgatcccttcatgtcctcagggcagggccccaatggcgggatgggtgatccctacagccgtgctgctggccctgggctgggaagtgtggcgatgggaccacggcagcactatccctatggaggtccttacgacagagtgaggacggagcctggaatcgggcctgaaggaaatatgggcactggagcccctcagccaaatctcatgccttccaccccagattcggggatgtattctcctagccgctaccccccgcagcagcagcagcaacagcagcaacaacatgattcctatggcaatcaattctctacccaaggcaccccttccagcagccccttccccagccagcagaccacaatgtatcagcagcagcagcagaattataagaggccaatggatggcacatatggcccccctgccaagcggcatgaaggggagatgtacagtgtgccgtacagcgctgggcaaggccagcctcaacagcagcagttgcctgcagctcagtcccagcctgccagccagccacaagctgcccagccttcccctcagcaggacgtgtacaaccagtacagcaatgcctaccctgcctccgccaccgctgctactgatcgccgaccagcaggcggcccccagaaccaatttccattccagtttggccgagaccgagtctctgcacctcctggttccagtgcccagcagaacatgccaccacaaatgatgggtggccccatacaggcatcagctgaggttgctcagcagggcaccatgtggcaggggcgaaatgacatgacctacaattatgccaacaggcagaacacaggctctgccacccagggccctgcgtatcatggtgtgaaccgaacagatgaaatgctccacacagatcagagggccaaccatgaaggcccatggccttcccatggcacacgccagcctccgtatggtccttcagcccctgttccccccatgacaaggccccctccatctaactaccagcccccaccaagcatgccgaatcacattcctcaggtatccagccccgctcccctcccccggcccatggagaaccgtacttctcctagcaagtctccattcctgcactctgggatgaaaatgcaaaaggcgggtccaccggtgcctgcttcgcacatagcgcctacccctgtgcagccgcctatgattcggcgggatatcaccttcccacctggctctgtagaggccactcagcctgtgttgaagcagagaaggcggctcacaatgaaagacattggaaccccggaggcatggcgggtaatgatgtccctcaagtccgggctcctggcagagagcacgtgggcgttagacaccattaacattctactgtatgatgacaacagcattatgaccttcaacctcagccagctcccaggcttgctagagctccttgtggaatatttccgtagatgcctaattgaaatctttggcattttaaaggagtatgaggtaggggacccaggacagagaacattactagaccctgggagattcaccaaggtgtatagtccagcccatacagaggaagaagaggaagaacaccttgatcctaaactggaggaggaagaggaagaaggggttggaaatgatgaggagatggcctttttgggcaaggacaagccatcttcagagaataatgaggagaagctagtcagtaagtttgacaagcttccggtaaagatcgtgcagaggaatgacccatttgtggtggactgctcagataagcttgggcgcgtgcaggagtttgacagtggcctgctacactggcggattggtggtggggataccactgagcatatccagacccactttgagagcaagatagagctgctgccttcccggccttatgtgccctgcccaacgccccctcggaaacacctcacaacagtagagggcacaccagggacaacggagcaggagggccccccgcccgatggccttccagagaaaaggatcacagccaccatggatgacatgttgtctacccggtctagcacattgactgatgagggggcaaagagtgcagaggccaccaaggaaagcagcaagtttccatttggcattagcccagcacagagccaccggaacatcaaaattttagaggatgaaccccatagtaaggatgagaccccactgtgtacccttctggactggcaggattcccttgctaagcgctgtgtctgtgtctccaataccatccggagcctgtcgtttgtgccaggcaacgactttgagatgtccaaacacccagggctgctgcttatcctgggcaagctgatcctgctgcaccacaagcacccagagcggaagcaggcaccactaacttatgagaaggaggaggaacaggaccaaggggtgagctgtgacaaagtggagtggtggtgggactgcttggagatgctccgagaaaacacgctggtcaccctcgccaacatctcggggcaattggacctatccccatatcctgagagcatctgcctgcctgtcctggacggactcctacactgggcagtttgcccttcagctgaagcccaggaccccttctcaaccctaggccccaatgccgtcctctccccccagagattggtcttggaaaccctcagcaaactcagcatccaggacaacaatgtggacctgatcctggccactcccccttttagccgcctggagaagttgtatagtaccatggtgcgcttcctcagtgaccgaaagaacccagtgtgccgggagatggccgtggtactgctggcaaatctggcccagggggacagcctggcagcccgggccattgcagtgcagaagggcagcatcggcaacctcctgggtttcctggaggacagccttgctgccacacagttccagcagagccaggcaagcctcctgcatatgcagaatccaccctttgaaccaactagtgtggacatgatgcggcgggctgcccgagcactgcttgccctggccaaggtggatgagaaccactcagagttcactctgtatgagtcacggctgttggacatctccgtgtcaccactgatgaactcattggtttcacaagtcatttgtgatgtactgtttttgattggccagtcatgacagccgtgggacacctcccctccccgtgtgtgtgtgagtgtgtggagaacttagaaactgactgttgccctttatttatgcaaaaccacctcagaatccagtttaccctgtgctgtccagcttctcccttgggaaagcctctcctgttctctctcctccccaccctcactccctcacacctttctgttccccatcctcacctgcttccctcaggaccccaccctatttgaaaagacaaagctctgcctacatagaagacttttttattttaaccaaagttactgttgtttacagtgagtttggggaaaaaaatggctttcccagtccttgcatcaacgggatgccacatttcataactgtttttaatggttaaaaaaaaaaaaaaaaaaaggaaaaaaaatacaaaaaaaccctgaaggacaaaggtgactgctgagctgtgtggtttgtcgctgtccattcacaatctcgcaggagccgagaagttcgcagttgtgagcagaccctgttcactggagaggcctgtgcagtagagtgtagatcctttcatgtactgtactgtacacctgatactgtaaacatactgtaataataatgtctcacatggaaacgagagaagacgctgggtcagcagcaagctgtagtttttaaaaatgtttttagttaaatgttgaggagaaaaaaaatggctttccccccaaagtatcctgtgtgaacctacaacgccctgacctctttctctcctccttgattgtatgaatagccctgagatcacctcttagacctggttttaacctttagctgcagcggctgcgctgccacgtgtgtatatatatgatgttgtacattgcacatacccttgaatctccacagtttggtccccttcccagctacccctttatagtatggcgagttaacaagttggtgacctgcacaaagcgagacacagctatttaatctcttgccagacattgcccctcttggtgcagtgctctacaggtctctgtaaaaagcccttgctgtctcagcagccaatcaacttacagtttatttttttctgggtttttgttttgttttgtttcatttctaatcgaggtgtgaaaaagttctaggttcagttgaagttcctgatgaagaaacacaattgagattttttcagtgataaaatctgcatatttgtatttcaacaatgtagctaaaaacttgatgtaaattcctccttttttttccttttttggcttaatgaatatcatttattcagtatgaaatctttatactatatgttccacgtgttaagaataaatgtacattaaatcttggtaa

SEQ ID NO: 30 - protein, 2283 aa, Mus musculus
MAAQVAPAAASSLGNPPPPPSELKKAEQQQREEAGGEAAAAAAERGEMKAAAGQESEGPAVGPPQPLGKELQDGAESNGGGGGGGAGSGGGPGAEPDLKNSNGNAGPRPALNNNLPEPPGGGGGGGSSSSDGVGAPPHSAAAALPPPAYGFGQAYGRSPSAVAAAAAAVFHQQHGGQQSPGLAALQSGGGGGLEPYAGPQQNSHDHGFPNHQYNSYYPNRSAYPPPPQAYALSSPRGGTPGSGAAAAAGSKPPPSSSASASSSSSSFAQQRFGAMGGGGPSAAGGGTPQPTATPTLNQLLTSPSSARGYQGYPGGDYGGGPQDGGAGKGPADMASQCWGAAAAAAAAAAAVSGGAQQRSHHAPMSPGSSGGGGQPLARTPQSSSPMDQMGKMRPQPYGGTNPYSQQQGPPSGPQQGHGYPGQPYGSQTPQRYPMTMQGRAQSAMGSLSYAQQIPPYGQQGPSAYGQQGQTPYYNQQSPHPQQQPPYAQQPPSQTPHAQPSYQQQPQTQQPQLQSSQPPYSQQPSQPPHQQSPTPYPSQQSTTQQHPQSQPPYSQPQAQSPYQQQQPQQPASSSLSQQAAYPQPQPQQSQQTAYSQQRFPPPQELSQDSFGSQASSAPSMTSSKGGQEDMNLSLQSRPSSLPDLSGSIDDLPMGTEGALSPGVSTSGISSSQGEQSNPAQSPFSPHTSPHLPGIRGPSPSPVGSPASVAQSRSGPLSPAAVPGNQMPPRPPSGQSDSIMHPSMNQSSIAQDRGYMQRNPQMPQYTSPQPGSALSPRQPSGGQMHSGVGSYQQNSMGSYGPQGSQYGPQGGYPRQPNYNALPNANYPNAGMAGSMNPMGAGGQMHGQPGIPPYGTLPPGRMAHASMGNRPYGPNMANMPPQVGSGMCPPPGGMNRKTQESAVAMHVAANSIQNRPPGYPNMNQGGMMGTGPPYGQGINSMAGMINPQGPPYPMGGTMANNSAGMAASPEMMGLGDVKLTPATKMNNKADGTPKTESKSKKSSSSTTTNEKITKLYELGGEPERKMWVDRYLAFTEEKAMGMTNLPAVGRKPLDLYRLYVSVKEIGGLTQVNKNKKWRELATNLNVGTSSSAASSLKKQYIQCLYAFECKIERGEDPPPDIFAAADSKKSQPKIQPPSPAGSGSMQGPQTPQSTSSSMAEGGDLKPPTPASTPHSQIPPLPGMSRSNSVGIQDAFPDGSDPTFQKRNSMTPNPGYQPSMNTSDMMGRMSYEPNKDPYGSMRKAPGSDPFMSSGQGPNGGMGDPYSRAAGPGLGSVAMGPRQHYPYGGPYDRVRTEPGIGPEGNMGTGAPQPNLMPSTPDSGMYSPSRYPPQQQQQQQQQHDSYGNQFSTQGTPSSSPFPSQQTTMYQQQQQNYKRPMDGTYGPPAKRHEGEMYSVPYSAGQGQPQQQQLPAAQSQPASQPQAAQPSPQQDVYNQYSNAYPASATAATDRRPAGGPQNQFPFQFGRDRVSAPPGSSAQQNMPPQMMGGPIQASAEVAQQGTMWQGRNDMTYNYANRQNTGSATQGPAYHGVNRTDEMLHTDQRANHEGPWPSHGTRQPPYGPSAPVPPMTRPPPSNYQPPPSMPNHIPQVSSPAPLPRPMENRTSPSKSPFLHSGMKMQKAGPPVPASHIAPTPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFTKVYSPAHTEEEEEEHLDPKLEEEEEEGVGNDEEMAFLGKDKPSSENNEEKLVSKFDKLPVKIVQRNDPFVVDCSDKLGRVQEFDSGLLHWRIGGGDTTEHIQTHFESKIELLPSRPYVPCPTPPRKHLTTVEGTPGTTEQEGPPPDGLPEKRITATMDDMLSTRSSTLTDEGAKSAEATKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCDKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 31 - DNA, 9609 bp, Homo sapiens
atggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagccgcaacatggaggcgccaaggacagtgctgcgggcggccaggccgaccccccgggcccgccgctgctgagcaagccgggcgacgaggacgacgcgccgcccaagatgggggagccggcgggcggccgctacgagcacccgggcttgggcgccctgggcacgcagcagccgccggtcgccgtgcccgggggcggcggcggcccggcggccgtcccggagtttaataattactatggcagcgctgcccctgcgagcggcggccccggcggccgcgctgggccttgctttgatcaacatggcggacaacaaagccccgggatggggatgatgcactccgcctccgccgccgccgccggggcccccggcagcatggaccccctgcagaactcccacgaagggtaccccaacagccagtgcaaccattatccgggctacagccggcccggcgcgggcggcggcggcggcggcggcggcggaggaggaggaggcagcggaggaggaggaggaggaggaggagcaggagcaggaggagcaggagcgggagctgtggcggcggcggccgcggcggcggcggcagcagcaggaggcggcggcggcggcggctatgggggctcgtccgcggggtacggggtgctgagctccccccggcagcagggcggcggcatgatgatgggccccgggggcggcggggccgcgagcctcagcaaggcggccgccggctcggcggcggggggcttccagcgcttcgccggccagaaccagcacccgtcgggggccaccccgaccctcaatcagctgctcacctcgcccagccccatgatgcggagctacggcggcagctaccccgagtacagcagccccagcgcgccgccgccgccgccgtcgcagccccagtcccaggcggcggcggcgggggcggcggcgggcggccagcaggcggccgcgggcatgggcttgggcaaggacatgggcgcccagtacgccgctgccagcccggcctgggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaagaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatcttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaatggtgctataaagttgaaaaaaaaaaaa

SEQ ID NO: 32 - protein, 2236 aa, Homo sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 33 - DNA, 9648 bp, Homo sapiens
atggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagccgcaacatggaggcgccaaggacagtgctgcgggcggccaggccgaccccccgggcccgccgctgctgagcaagccgggcgacgaggacgacgcgccgcccaagatgggggagccggcgggcggccgctacgagcacccgggcttgggcgccctgggcacgcagcagccgccggtcgccgtgcccgggggcggcggcggcccggcggccgtcccggagtttaataattactatggcagcgctgcccctgcgagcggcggccccggcggccgcgctgggccttgctttgatcaacatggcggacaacaaagccccgggatggggatgatgcactccgcctccgccgccgccgccggggcccccggcagcatggaccccctgcagaactcccacgaagggtaccccaacagccagtgcaaccattatccgggctacagccggcccggcgcgggcggcggcggcggcggcggcggcggaggaggaggaggcagcggaggaggaggaggaggaggaggagcaggagcaggaggagcaggagcgggagctgtggcggcggcggccgcggcggcggcggcagcagcaggaggcggcggcggcggcggctatgggggctcgtccgcggggtacggggtgctgagctccccccggcagcagggcggcggcatgatgatgggccccgggggcggcggggccgcgagcctcagcaaggcggccgccggctcggcggcggggggcttccagcgcttcgccggccagaaccagcacccgtcgggggccaccccgaccctcaatcagctgctcacctcgcccagccccatgatgcggagctacggcggcagctaccccgagtacagcagccccagcgcgccgccgccgccgccgtcgcagccccagtcccaggcggcggcggcgggggcggcggcgggcggccagcaggcggccgcgggcatgggcttgggcaaggacatgggcgcccagtacgccgctgccagcccggcctgggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcaggactctggagatgccacatggaaagaaacattctggttgatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaagaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatcttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaatggtgctataaagttgaaaaaaaaaaaa

SEQ ID NO: 34 - protein, 2249 aa, Homo sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQDSGDATWKETFWLMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 35 - DNA, 9833 bp, Homo sapiens
gggggcggcggcgacggcggcggcggcctgaacagtgtgcaccaccaccccctgctcccccgtcacgaactcaacatggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagccgcaacatggaggcgccaaggacagtgctgcgggcggccaggccgaccccccgggcccgccgctgctgagcaagccgggcgacgaggacgacgcgccgcccaagatgggggagccggcgggcggccgctacgagcacccgggcttgggcgccctgggcacgcagcagccgccggtcgccgtgcccgggggcggcggcggcccggcggccgtcccggagtttaataattactatggcagcgctgcccctgcgagcggcggccccggcggccgcgctgggccttgctttgatcaacatggcggacaacaaagccccgggatggggatgatgcactccgcctccgccgccgccgccggggcccccggcagcatggaccccctgcagaactcccacgaagggtaccccaacagccagtgcaaccattatccgggctacagccggcccggcgcgggcggcggcggcggcggcggcggcggaggaggaggaggcagcggaggaggaggaggaggaggaggagcaggagcaggaggagcaggagcgggagctgtggcggcggcggccgcggcggcggcggcagcagcaggaggcggcggcggcggcggctatgggggctcgtccgcggggtacggggtgctgagctccccccggcagcagggcggcggcatgatgatgggccccgggggcggcggggccgcgagcctcagcaaggcggccgccggctcggcggcggggggcttccagcgcttcgccggccagaaccagcacccgtcgggggccaccccgaccctcaatcagctgctcacctcgcccagccccatgatgcggagctacggcggcagctaccccgagtacagcagccccagcgcgccgccgccgccgccgtcgcagccccagtcccaggcggcggcggcgggggcggcggcgggcggccagcaggcggccgcgggcatgggcttgggcaaggacatgggcgcccagtacgccgctgccagcccggcctgggcggccgcgcaacaaaggagtcacccggcgatgagccccggcacccccggaccgaccatgggcagatcccagggcagcccaatggatccaatggtgatgaagagacctcagttgtatggcatgggcagtaaccctcattctcagcctcagcagagcagtccgtacccaggaggttcctatggccctccaggcccacagcggtatccaattggcatccagggtcggactcccggggccatggccggaatgcagtaccctcagcagcagatgccacctcagtatggacagcaaggtgtgagtggttactgccagcagggccaacagccatattacagccagcagccgcagcccccgcacctcccaccccaggcgcagtatctgccgtcccagtcccagcagaggtaccagccgcagcaggacatgtctcaggaaggctatggaactagatctcaacctcctctggcccccggaaaacctaaccatgaagacttgaacttaatacagcaagaaagaccatcaagtttaccagatctgtctggctccattgatgacctccccacgggaacggaagcaactttgagctcagcagtcagtgcatccgggtccacgagcagccaaggggatcagagcaacccggcgcagtcgcctttctccccacatgcgtcccctcatctctccagcatcccggggggcccatctccctctcctgttggctctcctgtaggaagcaaccagtctcgatctggcccaatctctcctgcaagtatcccaggtagtcagatgcctccgcagccacccgggagccagtcagaatccagttcccatcccgccttgagccagtcaccaatgccacaggaaagaggttttatggcaggcacacaaagaaaccctcagatggctcagtatggacctcaacagacaggaccatccatgtcgcctcatccttctcctgggggccagatgcatgctggaatcagtagctttcagcagagtaactcaagtgggacttacggtccacagatgagccagtatggaccacaaggtaactactccagacccccagcgtatagtggggtgcccagtgcaagctacagcggcccagggcccggtatgggtatcagtgccaacaaccagatgcatggacaagggccaagccagccatgtggtgctgtgcccctgggacgaatgccatcagctgggatgcagaacagaccatttcctggaaatatgagcagcatgacccccagttctcctggcatgtctcagcagggagggccaggaatggggccgccaatgccaactgtgaaccgtaaggcacaggaggcagccgcagcagtgatgcaggctgctgcgaactcagcacaaagcaggcaaggcagtttccccggcatgaaccagagtggacttatggcttccagctctccctacagccagcccatgaacaacagctctagcctgatgaacacgcaggcgccgccctacagcatggcgcccgccatggtgaacagctcggcagcatctgtgggtcttgcagatatgatgtctcctggtgaatccaaactgcccctgcctctcaaagcagacggcaaagaagaaggcactccacagcccgagagcaagtcaaaggatagctacagctctcagggtatttctcagcccccaaccccaggcaacctgccagtcccttccccaatgtcccccagctctgctagcatctcctcatttcatggagatgaaagtgatagcattagcagcccaggctggccaaagactccatcaagccctaagtccagctcctccaccactactggggagaagatcacgaaggtgtacgagctggggaatgagccagagagaaagctctgggtcgaccgatacctcaccttcatggaagagagaggctctcctgtctcaagtctgcctgccgtgggcaagaagcccctggacctgttccgactctacgtctgcgtcaaagagatcgggggtttggcccaggttaataaaaacaagaagtggcgtgagctggcaaccaacctaaacgttggcacctcaagcagtgcagcgagctccctgaaaaagcagtatattcagtacctgtttgcctttgagtgcaagatcgaacgtggggaggagcccccgccggaagtcttcagcaccggggacaccaaaaagcagcccaagctccagccgccatctcctgctaactcgggatccttgcaaggcccacagaccccccagtcaactggcagcaattccatggcagaggttccaggtgacctgaagccacctaccccagcctccacccctcacggccagatgactccaatgcaaggtggaagaagcagtacaatcagtgtgcacgacccattctcagatgtgagtgattcatccttcccgaaacggaactccatgactccaaacgccccctaccagcagggcatgagcatgcccgatgtgatgggcaggatgccctatgagcccaacaaggacccctttgggggaatgagaaaagtgcctggaagcagcgagccctttatgacgcaaggacagatgcccaacagcagcatgcaggacatgtacaaccaaagtccctccggagcaatgtctaacctgggcatggggcagcgccagcagtttccctatggagccagttacgaccgaaggcatgaaccttatgggcagcagtatccaggccaaggccctccctcgggacagccgccgtatggagggcaccagcccggcctgtacccacagcagccgaattacaaacgccatatggacggcatgtacgggcccccagccaagcgccacgagggcgacatgtacaacatgcagtacagcagccagcagcaggagatgtacaaccagtatggaggctcctactcgggcccggaccgcaggcccatccagggccagtacccgtatccctacagcagggagaggatgcagggcccggggcagatccagacacacggaatcccgcctcagatgatgggcggcccgctgcagtcgtcctccagtgaggggcctcagcagaatatgtgggcagcacgcaatgatatgccttatccctaccagaacaggcagggccctggcggccctacacaggcgcccccttacccaggcatgaaccgcacagacgatatgatggtacccgatcagaggataaatcatgagagccagtggccttctcacgtcagccagcgtcagccttatatgtcgtcctcagcctccatgcagcccatcacacgcccaccacagccgtcctaccagacgccaccgtcactgccaaatcacatctccagggcgcccagcccagcgtccttccagcgctccctggagaaccgcatgtctccaagcaagtctccttttctgccgtctatgaagatgcagaaggtcatgcccacggtccccacatcccaggtcaccgggccaccaccccaaccacccccaatcagaagggagatcacctttcctcctggctcagtagaagcatcacaaccagtcttgaaacaaaggcgaaagattacctccaaagatatcgttactcctgaggcgtggcgtgtgatgatgtcccttaaatcaggtcttttggctgagagtacgtgggctttggacactattaatattcttctgtatgatgacagcactgttgctactttcaatctctcccagttgtctggatttctcgaacttttagtcgagtactttagaaaatgcctgattgacatttttggaattcttatggaatatgaagtgggagaccccagccaaaaagcacttgatcacaacgcagcaaggaaggatgacagccagtccttggcagacgattctgggaaagaggaggaagatgctgaatgtattgatgacgacgaggaagacgaggaggatgaggaggaagacagcgagaagacagaaagcgatgaaaagagcagcatcgctctgactgccccggacgccgctgcagacccaaaggagaagcccaagcaagccagtaagttcgacaagctgccaataaagatagtcaaaaagaacaacctgtttgttgttgaccgatctgacaagttggggcgtgtgcaggagttcaatagtggccttctgcactggcagctcggcgggggtgacaccaccgagcacattcagactcactttgagagcaagatggaaattcctcctcgcaggcgcccacctccccccttaagctccgcaggtagaaagaaagagcaagaaggcaaaggcgactctgaagagcagcaagagaaaagcatcatagcaaccatcgatgacgtcctctctgctcggccaggggcattgcctgaagacgcaaaccctgggccccagaccgaaagcagtaagtttccctttggtatccagcaagccaaaagtcaccggaacatcaagctgctggaggacgagcccaggagccgagacgagactcctctgtgtaccatcgcgcactggcaggactcgctggctaagcgatgcatctgtgtgtccaatattgtccgtagcttgtcattcgtgcctggcaatgatgccgaaatgtccaaacatccaggcctggtgctgatcctggggaagctgattcttcttcaccacgagcatccagagagaaagcgagcaccgcagacctatgagaaagaggaggatgaggacaagggggtggcctgcagcaaagatgagtggtggtgggactgcctcgaggtcttgagggataacacgttggtcacgttggccaacatttccgggcagctagacttgtctgcttacacggaaagcatctgcttgccaattttggatggcttgctgcactggatggtgtgcccgtctgcagaggcacaagatccctttccaactgtgggacccaactcggtcctgtcgcctcagagacttgtgctggagaccctctgtaaactcagtatccaggacaataatgtggacctgatcttggccactcctccatttagtcgtcaggagaaattctatgctacattagttaggtacgttggggatcgcaaaaacccagtctgtcgagaaatgtccatggcgcttttatcgaaccttgcccaaggggacgcactagcagcaagggccatagctgtgcagaaaggaagcattggaaacttgataagcttcctagaggatggggtcacgatggcccagtaccagcagagccagcacaacctcatgcacatgcagcccccgcccctggaaccacctagcgtagacatgatgtgcagggcggccaaggctttgctagccatggccagagtggacgaaaaccgctcggaattccttttgcacgagggccggttgctggatatctcgatatcagctgtcctgaactctctggttgcatctgtcatctgtgatgtactgtttcagattgggcagttatgacataagtgagaaggcaagcatgtgtgagtgaagattagagggtcacatataactggctgttttctgttcttgtttatccagcgtaggaagaaggaaaagaaaatctttgctcctctgccccattcactatttaccaattgggaattaaagaaataattaatttgaacagttatgaaattaatatttgctgtctgtgtgtataagtacatcctttggggttttttttttctcttttttttaaccaaagttgctgtctagtgcattcaaaggtcactttttgttcttcacagatctttttaatgttctttcccatgttgtattgcatttttgggggaagcaaattgactttaaagaaaaaagttgtggcaaaagatgctaagatgcgaaaatttcaccacactgagtcaaaaaggtgaaaaattatccatttcctatgcgttttactcctcagagaatgaaaaaaactgcatcccatcacccaaagttctgtgcaatagaaatttctacagatacaggtataggggctcaaggaggtatgtcggtcagtagtcaaaactatgaaatgatactggtttctccacaggaatatggttccattaggctgggagcaaaaacaatgttttttaagattgagaatacatacctgacaacgatccggaaactgctcctcaccactcccgtcatgcctgctgtcggcgtttgaccttccacgtgacagttcttcacaattcctttcatcattttttaaatattttttttactgcctatgggctgtgatgtatatagaagttgtacattaaacataccctcatttttttcttttcttttttttttttttttttagtacaaagttttagtttctttttcatgatgtggtaactacgaagtgatggtagatttaaataattttttatttttattttatatattttttcattagggccatatctccaaaaaaagaaagaaaaaatacaaaaaacaaaaacaaaaaaaaaagagggtaatgtacaagtttctgtatgtataaagtcatgctcgatttcaggagagcagctgatcacaatttgcttcatgaatcaaggtgtggaaatggttatatatggattgatttagaaaatggttaccagtacagtcaaaaaagagaaaatgaaaaaaatacaactaaaaggaagaaacacaacttcaaagatttttcagtgatgagaatccacatttgtatttcaagataatgtagtttaaaaaaaaaaaaaagaaaaaaacttgatgtaaattcctccttttcctctggcttaatgaatatcatttattcagtataaaatctttatatgttccacatgttaagaataaatgtacattaaatcttgttaagcactgtgatgggtgttcttgaatactgttctagtttccttaaagtggtttcctagtaatcaagttatttacaagaaataggggaatgcagcagtgtattcacattataaaaccctacatttggaagagacctttaggggttacctactttagagtggggagcaacagtttgattttctcaaattacttagctaattagtctttctttgaagcaattaactctaacgacattgaggtatgatcattttcagtatttatgggaggtggctgctgacccacttgaggtgagatctcagaagcttaactggcctgaaaatgtaacattctgccttttactaactccatcttagtttaatcaaagttcaatctattccttgtttcttctgtgtgcctcagagttattttgcatttagtttactccaccgtgtataatatttatactgtgcaatgttaaaaaagaatctgttatattgtatgtggtgtacatagtgcaaagtgatgatttctatttcagggcatattatggttctcatattccttcctacctggtgcacagtagctttttaatactagtcacttctaatttaaactttctcttcctgggtcattgactgttactgtgtaataatcgatttctttgaaactgctgcataattatgctgttagtggacctctacctcttctcttccctctcccaatcacagtatactcagaatccccagcccctcgcatacattgtgtcggttcacattactcacagtaatatatggaagagttagacaagaacatgcagttacagtcattgtgagacgtgactctccagtgtcacgaggaaaaaaatcatcttttctgcaaacagtctctcatctgtcaactcccacattactgagtcaaacagtcttcttacataacaatgcaaccaaatatatgttgaattaaagacccatttataattctgctttaaatacatctgcttgctaagaacagatttcagtgctccaagcttcaaatatggagatttgtaagagggaattcaatattattctaatttctctcttacagagtacaaataaaaggtgtatacaaactccgaacatatccagtattccaattcctttgtcaatcagaagagtaaaataattaacaaaagactgttgttatggtttgcattgtaaccgatacgcagagtctgaccgttgggcaacaagtttttctatcctgatgcgcaacacagtctctagagactaatccaggaagactttagcctcctttccatattctcacccccgaatcaagatttacagaagcccacgaagaatttacagcctgcttgagatcatcttgcctataaactgagttattgctttgtcctaaaaattagtcggtttttttttttctatgaggcttttcagaaatttacaggatgcccagactttacatgtgtaccaaaaaaaaaaaaaagataaaaaataaaggtgcaaagaaagtttagtattttggaatggtgctataaagttgaa

SEQ ID NO: 36 - protein, 2289 aa, Homo sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQHGGQQSPGMGMMHSASAAAAGAPGSMDPLQNSHEGYPNSQCNHYPGYSRPGAGGGGGGGGGGGGGSGGGGGGGGAGAGGAGAGAVAAAAAAAAAAAGGGGGGGYGGSSAGYGVLSSPRQQGGGMMMGPGGGGAASLSKAAAGSAAGGFQRFAGQNQHPSGATPTLNQLLTSPSPMMRSYGGSYPEYSSPSAPPPPPSQPQSQAAAAGAAAGGQQAAAGMGLGKDMGAQYAAASPAWAAAQQRSHPAMSPGTPGPTMGRSQGSPMDPMVMKRPQLYGMGSNPHSQPQQSSPYPGGSYGPPGPQRYPIGIQGRTPGAMAGMQYPQQQMPPQYGQQGVSGYCQQGQQPYYSQQPQPPHLPPQAQYLPSQSQQRYQPQQDMSQEGYGTRSQPPLAPGKPNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMAGTQRNPQMAQYGPQQTGPSMSPHPSPGGQMHAGISSFQQSNSSGTYGPQMSQYGPQGNYSRPPAYSGVPSASYSGPGPGMGISANNQMHGQGPSQPCGAVPLGRMPSAGMQNRPFPGNMSSMTPSSPGMSQQGGPGMGPPMPTVNRKAQEAAAAVMQAAANSAQSRQGSFPGMNQSGLMASSSPYSQPMNNSSSLMNTQAPPYSMAPAMVNSSAASVGLADMMSPGESKLPLPLKADGKEEGTPQPESKSKDSYSSQGISQPPTPGNLPVPSPMSPSSASISSFHGDESDSISSPGWPKTPSSPKSSSSTTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKIERGEEPPPEVFSTGDTKKQPKLQPPSPANSGSLQGPQTPQSTGSNSMAEVPGDLKPPTPASTPHGQMTPMQGGRSSTISVHDPFSDVSDSSFPKRNSMTPNAPYQQGMSMPDVMGRMPYEPNKDPFGGMRKVPGSSEPFMTQGQMPNSSMQDMYNQSPSGAMSNLGMGQRQQFPYGASYDRRHEPYGQQYPGQGPPSGQPPYGGHQPGLYPQQPNYKRHMDGMYGPPAKRHEGDMYNMQYSSQQQEMYNQYGGSYSGPDRRPIQGQYPYPYSRERMQGPGQIQTHGIPPQMMGGPLQSSSSEGPQQNMWAARNDMPYPYQNRQGPGGPTQAPPYPGMNRTDDMMVPDQRINHESQWPSHVSQRQPYMSSSASMQPITRPPQPSYQTPPSLPNHISRAPSPASFQRSLENRMSPSKSPFLPSMKMQKVMPTVPTSQVTGPPPQPPPIRREITFPPGSVEASQPVLKQRRKITSKDIVTPEAWRVMMSLKSGLLAESTWALDTINILLYDDSTVATFNLSQLSGFLELLVEYFRKCLIDIFGILMEYEVGDPSQKALDHNAARKDDSQSLADDSGKEEEDAECIDDDEEDEEDEEEDSEKTESDEKSSIALTAPDAAADPKEKPKQASKFDKLPIKIVKKNNLFVVDRSDKLGRVQEFNSGLLHWQLGGGDTTEHIQTHFESKMEIPPRRRPPPPLSSAGRKKEQEGKGDSEEQQEKSIIATIDDVLSARPGALPEDANPGPQTESSKFPFGIQQAKSHRNIKLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDALAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 37 - DNA, 11325 bp, Mus musculus
tcggcgggccccggctcgaccatggagaccgggctgctccccaaccacaaactgaaagccgttggcgaggcccccgctgcaccgccccatcagcagcaccaccaccaccatgcccaccaccaccaccaccaccatgcccaccacctccaccacctccaccaccaccacgcactacagcagcagctaaaccagttccagcagccgcagccgccgcagccacagcagcagcagccgccgccaccgccgcagcagcagcatcccactgccaacaacagcctgggcggtgcgggcggcggcgcgcctcagcccggcccggacatggagcagccgcaacatggaggcgccaaggacagtgtcgcgggcaatcaggctgacccgcagggccagcctctgctgagcaaaccgggcgacgaggacgacgcgccgcccaagatgggggagccggcgggcagccgctatgagcacccgggcctgggcgcgcagcagcagcccgcgccggtcgccgtgcccgggggcggcggcggcccagcggccgtctcggagtttaataattactatggcagcgctgcccctgctagcggcggccccggcggccgcgctgggccttgctttgatcaacatggcggacaacaaagccccgggatggggatgatgcactccgcctctgccgccgccggggcccccagcagcatggaccccctgcagaactcccacgaagggtaccccaacagccagtacaaccattatccgggctacagccggcccggcgcgggcggcggcggcggcggcggcggaggaggaggaggcagcggaggaggtggaggaggaggaggagcaggaggagcaggaggagcagcggcagcggcagcaggagccggagctgtggcggcggcggccgcggcggcggcggcagcagcagcagcagcaggaggaggcggtggcggcggctatgggagctcgtcctcggggtacggggtgctgagctccccgcggcagcagggcggcggcatgatgatgggccccgggggcggcggggccgcgagcctcagcaaggcggccgccggcgcggcggcggcggcggggggcttccagcgcttcgccggccagaaccagcacccgtcgggggctacaccgaccctcaaccagctgctcacctcacccagccccatgatgaggagctacggcggtagctaccccgactacagcagctccagcgcgccgccgccgccgtcgcagccccagtcccaggcggcggcgggggcggcggcgggtggccagcaggcggccgcgggcatgggcttgggcaaggacctaggcgcccagtacgccgctgccagcccggcctgggcggccgcgcaacaaaggagtcacccggcgatgagccccggcacccccggaccgaccatgggcagatcccagggcagcccgatggacccaatggtgatgaagagacctcagttgtatgggatgggtactcacccccactcccagccacagcagagcagcccatacccaggaggctcctacggtcccccaggtgcacagcggtatccccttggcatgcagggccgggctccaggggccctgggaggcttgcagtacccgcagcagcagatgccaccgcagtacggacagcaagctgtgagtggctactgccagcaaggccagcagccatactacaaccagcagccgcagccctcgcacctcccgccccaggcacagtacctgcagccggcggcggcgcagtcccagcagaggtaccagccacagcaggacatgtctcaagaaggctatggaactagatctcagcctcctctggcccctggaaaatccaaccatgaagacttgaatttaattcaacaggaaagaccatcgagtctaccagacctgtctggctccatcgatgacctccccacgggaacagaagcaactctgagctcagcagtcagtgcatccgggtctacaagcagccagggagatcagagcaacccagcgcagtctcctttctccccacatgcatcacctcacctctccagcatccctggagggccgtcaccttctcctgttggctctcctgtgggaagcaaccaatcgaggtctggtccgatctcccctgcgagtattccaggtagccagatgcctccgcaaccacctggaagccagtcagaatccagttcccatcctgccttgagccagtcaccaatgccacaggaaagaggttttatgacaggcactcagagaaaccctcagatgtctcagtacggacctcagcagacaggaccatccatgtcgcctcacccatctcctgggggccagatgcatcctgggatcagtaactttcagcagagtaactcaagtggcacgtacggcccacagatgagccagtatggaccccaaggcaactactccagaaccccaacatatagcggggtacccagtgcaagctacagcggcccagggcccggtatgggcatcaatgccaacaaccagatgcatggacaagggccagcccagccatgtggtgctatgcccctgggacgaatgccttcagctgggatgcagaacagaccatttcctggaaccatgagcagcgtcacccccagttctcctggcatgtctcaacagggagggccaggaatgggcccaccaatgcccactgtgaaccggaaggcccaggaagctgccgcagctgtgatgcaggctgctgcaaactcagcacaaagcaggcaaggcagttttcctggcatgaaccagagtggcctggtggcctccagctctccctacagccagtccatgaacaacaactccagcctgatgagcacccaggcccagccctacagcatgacgcccacaatggtgaacagctccacagcatctatgggtcttgcagatatgatgtctcccagtgagtccaaattgtctgtgcctcttaaagcagatggtaaagaagaaggcgtgtcccagcctgagagcaagtcaaaggacagctatggctctcagggcatttcccagcctccaaccccaggcaacctgcctgtcccttccccaatgtctcccagctctgccagcatctcctcctttcatggagatgagagtgacagcattagcagcccaggctggcccaagacaccatcaagccctaagtccagctcttcctccaccactggggagaagatcacgaaggtctatgagctggggaatgagccggagaggaagctgtgggtcgaccgttacctaacgttcatggaagagaggggctccccggtgtccagtctgccagcagtgggcaagaagcccctggacctgttccgactgtatgtctgcgtcaaggagattggaggtttggcgcaggttaataaaaacaagaagtggcgtgagctggcaaccaacctgaacgttggcacttccagcagcgcagccagctctctgaaaaagcagtatattcagtacctgttcgcctttgagtgcaaaactgagcgcggggaggagcccccacctgaagtcttcagcaccggggattcgaagaagcagccaaagctccagccgccatctcctgctaactcaggatccttacaaggcccacagactccacagtcaactgggagcaattcgatggcagaggttccaggtgacctgaagccaccaaccccagcctctacccctcatggacagatgactcccatgcaaagcggaagaagcagtacagtcagtgtgcatgacccgttctcagacgtgagtgactcagcgtacccaaaacggaactccatgactccaaacgccccataccagcagggcatgggcatgccagacatgatgggcaggatgccctatgaacccaacaaggaccctttcagtggaatgagaaaagtgcctggaagtagtgagccctttatgacacaaggacaggtgcccaacagcggcatgcaggacatgtacaaccagagcccctcaggggccatgtccaatctgggcatgggacagcggcagcagtttccctatggaaccagttatgaccgaaggcatgaggcttacggacagcagtacccaggccaaggccctcccacaggacagccaccgtatggaggacaccagcctggcctgtacccacagcagccgaattacaaacgtcatatggatggcatgtacgggcctccagccaagcggcacgagggagacatgtacaacatgcagtatggcagccagcagcaggagatgtataaccagtatggaggctcctactctggcccggacagaaggcccatccagggacaatatccctacccctacaacagagaaaggatgcagggcccaggccagatgcagccacacggaatcccacctcagatgatggggggccccatgcagtcatcctccagcgaggggcctcagcagaacatgtgggctacacgcaacgatatgccttatccctaccagagcaggcaaggcccgggcggccctgcacaggcccccccttacccaggcatgaaccgcacagatgatatgatggtacctgagcagaggatcaatcacgagagccagtggccttctcacgtcagccagcgccagccttacatgtcatcttcggcctccatgcagcccatcacgcgcccacctcagtcatcctaccagacgccgccgtcactgccaaaccacatctccagggcacccagccccgcctccttccagcgctccctggagagtcgcatgtctccaagcaagtctcccttcctgcccaccatgaagatgcagaaggtcatgcccacagtccccacatcccaggtcaccgggccccccccacagcctccaccaatcagaagggagattacctttcctcctggctccgtagaagcatcacagccaatcctgaaacaaaggcgaaagattacctcaaaagatattgttactcccgaggcgtggcgtgtgatgatgtcccttaaatcgggtctgttggctgagagcacgtgggctctggacaccatcaatattctcctctatgatgacagcaccgtcgccaccttcaatctttcccagctgtctggattcctggaactattagtagagtactttcgaaaatgcctaattgacattttcggaattcttatggaatatgaagtgggtgaccccagccaaaaggctcttgatcaccgttcagggaagaaagatgacagccagtccctggaagatgattctgggaaggaagacgatgatgctgagtgtcttgtggaagaggaggaggaggaagaggaggaggaggaagacagtgaaaagatagagtcagaggggaagagcagccctgccctagctgctccagatgcctccgtggaccccaaggagacgccaaagcaggccagtaagtttgacaagctgcccataaagattgtcaaaaagaacaagctgtttgtggtggaccggtccgacaagctgggccgagtgcaggagttcagcagcgggctcctccactggcagctgggtggtggcgacactaccgagcacatccagactcacttcgagagcaagatggagatccctcctcgcaggcgtccacctccgcctctaagctccacgggtaagaagaaagagctggaaggcaaaggtgattctgaagagcagccagagaaaagtatcatagccaccatcgatgacgtcttgtctgcccggccaggggctctgcctgaagacaccaacccaggaccccagaccgacagcggcaagtttccctttggaatccagcaggccaaaagccaccggaacatcaggctcctggaagacgagcccaggagccgagacgagacgccgctgtgcaccatcgcgcactggcaggactcactggccaagcgctgcatctgtgtgtcgaacatcgtgcggagcttgtctttcgtgcctggcaacgacgcagagatgtccaaacacccgggcttggtgctgatcctgggaaagctgattctgctgcatcacgagcatccggagagaaagcgggcgccacagacctatgagaaggaggaggacgaggacaagggggtggcctgcagcaaagatgagtggtggtgggactgcctcgaggtcttgcgggataacaccctggtcacgttggcgaacatttccgggcagctagacttgtctgcttacacagagagcatctgcttgccgatcctggacggcttgctacactggatggtgtgcccgtccgcagaggctcaggacccctttcccactgtggggcccaactcagtcctgtcgccgcagagacttgtgctggagaccctgtgtaaactcagtatccaggacaacaacgtggacctgatcttggccacgcctccatttagtcgtcaggagaaattttatgctacattagttaggtacgttggggatcgcaaaaatccagtctgtcgagaaatgtccatggcgcttttatcgaaccttgcccagggggacacactggcggcgagggcaatagctgtgcagaaaggaagcattggtaacttgataagcttcctagaggacggggtgacgatggcgcagtaccagcagagccagcataaccttatgcacatgcagcccccacctctggaaccccctagtgtagacatgatgtgccgggcggccaaagctctgctggccatggccagagtggacgagaaccgctcggagttccttttgcacgagggtcggttgctggatatctcaatatcagctgtcctgaactctctggttgcatctgtcatctgtgatgtactgtttcagattgggcagttatgacatccgtgaaggcacacatgtgtgagtgaacattagagggtcacatataactggctgttttctgttctcgtttatccagtgtaagaagaaggaaaagaaaaatctttgctcctctgccccgtttactatttaccaattgggaattaaatcattaatttgaacagttataaaattaatatttgctgtctgtgtgtataagtacatcctctggcggttttctgtttcttttttttttaaccaaagttgccgtctagtgcattcaaaggtcacaatttttgtttgtttgtttgtttgtttgttttttcataatttttttcatgttgtattgcagtctttgggaagtgaattgactttataaagaaaaacgttttggcaaaaagtgctaagatagaaaaatgtcaccacactgggtcaaaaacgtgaaaggaaaaattgattcttaaattgatttcctatgaattttattcttcacagaatgataaaagctaaactgcaccccgtcacccaaagctctgtgcaatagaaacttctagagatatagtgtaggggctgaaggaggtatggcagcagtagtcagggtcaatgatactgctttctccaccggaaagtggttacgttaggcctcgagcaaaaaacagcgctctcagataggtgcaaaaatccactcctagcagccaacagcaggatcgcttcctcaccacgaccgccatgtctgctgtggctcagcctccacgggacaaagcttcaagatttctttcatcatttttttaaatattttttttactgcctatgggctgtgatgtatatagaagttgtacattaaacataccctcatttttttcttcttttctttttttctttttttctttttctttttttttttttttagtacaaagtttttagtttctttttcatgatgtggtaactacgaagtgatggtagatttaaataattttttatttttattttatatattttttcattaggaccatatctccaaaaaacaagaaaaagaaacaaaaaatacaaaaaataaaaacaaacaaaaaaagagggtaatgtacaagtttctgtatgtataaagtcatgctctgttgggagagcggctgatcccagtttgcttcatgaatcaaagtgtggaaatggttgcatacagattgatttagaaaatggacaccagtacatacaaaaaaagaaaaaagaaagaaaaccaactaaatggaagaaacacaacttcaaagatttttctgtgacaagaatccacatttgtatttcaagataatgtagtttaagaaaagaaaaaaaagaaaaaaaaagaaaaaaacttgatgtaaattcctccttttcctctggcttaatgaatatcatttattcagtataaaatctttatatgtcccacatgttaagaataaatgtacattaaatcttgttacgcactgtgatgggtgttcttgaatgctgttctagtttgcctagcatggttgccatagtaaccaagttatttacaggaaatagggaagatgtaacaactgcttcctggtaatgatgcccaaaggccagaagggactttcagggtttcctacttgagagtgggagcaacaatttgattttctcagattgtttagctaattaggtcttctttgaagcaattaactctggtgacattgagaagtggtaattccctcatggatgggtggtggctgccaacccactgtgacatggggccctgcaagctaactggcctgaaaccacgaccttctgcctctcactactgatttaacccaagtctgcacccgtcatgtttcttctgtgtgcctccaagttactctgcgttagtttgctccagcgtgtataatatttatattgtgcaatgttaaagagaacgtgtcatattgtatgccgtgtgtatagtgccaagtgatgattctgtttcagagcataccttccttcctgcccagtccctggctctctaataccccaccctgatggaaagtgcttcttcctgggtaattgactgttactgtgtaacgctcagtctcattgaaacttacataaccatgctgctggtgccccttcctaccctacctctctcagcactcttcagttgacacttcccacacctgtcactgtggcccaccttgctcacgctgacatctggaagagttagacaggagcacacacttacaacactaggagatgttattctggtgtcacgagaaagaaattggtttttcctgcaaacagtcccatcaccaagcagcccccacatcaggtcagcaaaaagatctgtgttgaatcaaaactccatttataattctactagatgggaatacatctgcttacaaaggacagattttagtgttctgtgatgaaaatatggagagtgcaagagagagttcaatggaatcctaatcttgctcttgcagacaatgaatgaaaggtatagacaggctcagttccctgtcagaagagtggtctcaaagacaagtggctgtatagcagccaggcccagaacagcctcgcagcacacactaacaccaagcgggtgtctgagctctcctaggaagccttgtgcctgccctccctccattcacccagatccgactcctggaagcccacgaaagagtcaccctttgcttcacatttcctgacgataccgagttgctgctctgtcctaaaaatattagttcttttccagggctttcagaaatttgcaggatgcccatactctaaatgtgtaccaaaaagagagagaaataaaggtgcgaagaaagtttagtattttggaatggtgcgataaaatggaatctgttggtttttaatgtaacataagatactattggctggcactggctaaaaaaaatatctaagtgttggagttggatgcacaatcaacttttacttagctattcaaagagtacttatgttttccaagttaaaacagacttgtttttgacaggggccgtgggtggtcttatacaatgccagctcctaactgcagcttctgagaactggatatcgtttgccctgagagctgcccgtctccaactatgtgctgctgctgccctgtgtgctcagcccacaaggatgtggagactggatagacaaccccttgcttcttgctgggttgtgctgagttctttgcagtccagtcaagtgcccagagctaccagcctacgtccctcatgcatccaagagaaatgatcttgactatcatgatcaaaacagctgtagtaatatttctagtaaatatttctgatgactctgtgtaatctcctacaacaggacactattcattaacttgacagagacatgtgggcatgtggtcctgctttagtttaacagacaagtcaaccagttctcattacttaggaagagtgaggctatgtctgttacaatcccaatgtggtgcttgcccttatccaaagacagtccgggggccctgtctgcctgaactatgtctcgctccctcttgggcttcccactgggatgtgaaaagataaccaatggctcccaggttcccagtgccccccaaaccagtaatcaggtctgggactacagaacccgcaaaatcatacacaggctgtttcaaagccagtactctctttatactcctgcttcctccagcccccatttcacaccccacccaaatcacaaggtcctctgaagtctcagaactccaaattaacgttgggatttacgatgtgaatgctgaggagaaaattgggagttggtgggagatcaccaaattgtcaaaactatgaaactcatctgtcttcccaaatctgacctcagggacttggggggttcactctggcttctgccacagtattttctggggaaccaaaggcctcgggaatagagaaacaggttgccggatatcctggaagtctaagccatactgaccagtttgtcttgagtgttttctttgtgagcctggaactgtccccggacccctttcttttaaacatggttcaggactttaaaaaaaagcactgtattttttttatgtaagccaagatgccctccctagcagagatagcgttgaactgtctctagttctgtagcctgagagacttaaatcgtttaacttcagtgtctttgtccactctgttgaactgctaaggattctattgaatgtgttctttgcggctttggaggagttgctgggtgtgtaagtcctgcatccctttgcctggtatgtgtatattattcctttgcctggctgtgtatcgttcttcagtgtaagtacacccacactctgtattcctttgcctgctccccgcccccccacacacacacatcctgcatagttttaaaataaggcctgagagactgtttctatttcctgtcatagctggtgacttttaacagttgaggcgaatggcctgtcacttgcctgggttcccgtcaggggtgatccatggaactcctcagtggaacagaatttaggacagaagatcccaccttccttccaggcctggggagaatcagactgtgagataaaccatgatgctgcccaatcccactgccccaccttgcttttaaaataaagtgcctcctaacgtc

SEQ ID NO: 38 - protein, 2244 aa, Mus musculus
METGLLPNHKLKAVGEAPAAPPHQQHHHHHAHHHHHHHAHHLHHLHHHHALQQQLNQFQQPQPPQPQQQQPPPPPQQQHPTANNSLGGAGGGAPQPGPDMEQPQHGGAKDSVAGNQADPQGQPLLSKPGDEDDAPPKMGEPAGSRYEHPGLGAQQQPAPVAVPGGGGGPAAVSEFNNYYGSAAPASGGPGGRAGPCFDQHGGQQSPGMGMMHSASAAAGAPSSMDPLQNSHEGYPNSQYNHYPGYSRPGAGGGGGGGGGGGGSGGGGGGGGAGGAGGAAAAAAGAGAVAAAAAAAAAAAAAAGGGGGGGYGSSSSGYGVLSSPRQQGGGMMMGPGGGGAASLSKAAAGAAAAAGGFQRFAGQNQHPSGATPTLNQLLTSPSPMMRSYGGSYPDYSSSSAPPPPSQPQSQAAAGAAAGGQQAAAGMGLGKDLGAQYAAASPAWAAAQQRSHPAMSPGTPGPTMGRSQGSPMDPMVMKRPQLYGMGTHPHSQPQQSSPYPGGSYGPPGAQRYPLGMQGRAPGALGGLQYPQQQMPPQYGQQAVSGYCQQGQQPYYNQQPQPSHLPPQAQYLQPAAAQSQQRYQPQQDMSQEGYGTRSQPPLAPGKSNHEDLNLIQQERPSSLPDLSGSIDDLPTGTEATLSSAVSASGSTSSQGDQSNPAQSPFSPHASPHLSSIPGGPSPSPVGSPVGSNQSRSGPISPASIPGSQMPPQPPGSQSESSSHPALSQSPMPQERGFMTGTQRNPQMSQYGPQQTGPSMSPHPSPGGQMHPGISNFQQSNSSGTYGPQMSQYGPQGNYSRTPTYSGVPSASYSGPGPGMGINANNQMHGQGPAQPCGAMPLGRMPSAGMQNRPFPGTMSSVTPSSPGMSQQGGPGMGPPMPTVNRKAQEAAAAVMQAAANSAQSRQGSFPGMNQSGLVASSSPYSQSMNNNSSLMSTQAQPYSMTPTMVNSSTASMGLADMMSPSESKLSVPLKADGKEEGVSQPESKSKDSYGSQGISQPPTPGNLPVPSPMSPSSASISSFHGDESDSISSPGWPKTPSSPKSSSSSTTGEKITKVYELGNEPERKLWVDRYLTFMEERGSPVSSLPAVGKKPLDLFRLYVCVKEIGGLAQVNKNKKWRELATNLNVGTSSSAASSLKKQYIQYLFAFECKTERGEEPPPEVFSTGDSKKQPKLQPPSPANSGSLQGPQTPQSTGSNSMAEVPGDLKPPTPASTPHGQMTPMQSGRSSTVSVHDPFSDVSDSAYPKRNSMTPNAPYQQGMGMPDMMGRMPYEPNKDPFSGMRKVPGSSEPFMTQGQVPNSGMQDMYNQSPSGAMSNLGMGQRQQFPYGTSYDRRHEAYGQQYPGQGPPTGQPPYGGHQPGLYPQQPNYKRHMDGMYGPPAKRHEGDMYNMQYGSQQQEMYNQYGGSYSGPDRRPIQGQYPYPYNRERMQGPGQMQPHGIPPQMMGGPMQSSSSEGPQQNMWATRNDMPYPYQSRQGPGGPAQAPPYPGMNRTDDMMVPEQRINHESQWPSHVSQRQPYMSSSASMQPITRPPQSSYQTPPSLPNHISRAPSPASFQRSLESRMSPSKSPFLPTMKMQKVMPTVPTSQVTGPPPQPPPIRREITFPPGSVEASQPILKQRRKITSKDIVTPEAWRVMMSLKSGLLAESTWALDTINILLYDDSTVATFNLSQLSGFLELLVEYFRKCLIDIFGILMEYEVGDPSQKALDHRSGKKDDSQSLEDDSGKEDDDAECLVEEEEEEEEEEEDSEKIESEGKSSPALAAPDASVDPKETPKQASKFDKLPIKIVKKNKLFVVDRSDKLGRVQEFSSGLLHWQLGGGDTTEHIQTHFESKMEIPPRRRPPPPLSSTGKKKELEGKGDSEEQPEKSIIATIDDVLSARPGALPEDTNPGPQTDSGKFPFGIQQAKSHRNIRLLEDEPRSRDETPLCTIAHWQDSLAKRCICVSNIVRSLSFVPGNDAEMSKHPGLVLILGKLILLHHEHPERKRAPQTYEKEEDEDKGVACSKDEWWWDCLEVLRDNTLVTLANISGQLDLSAYTESICLPILDGLLHWMVCPSAEAQDPFPTVGPNSVLSPQRLVLETLCKLSIQDNNVDLILATPPFSRQEKFYATLVRYVGDRKNPVCREMSMALLSNLAQGDTLAARAIAVQKGSIGNLISFLEDGVTMAQYQQSQHNLMHMQPPPLEPPSVDMMCRAAKALLAMARVDENRSEFLLHEGRLLDISISAVLNSLVASVICDVLFQIGQL

SEQ ID NO: 39 - DNA, 5780 bp, Homo sapiens
ctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattacccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgtttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctggattctaaaaaaaaaaaaaaaaaaaaaaaa

SEQ ID NO: 40 - protein, 1104 aa, Homo sapiens
MAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPAFTKLPAKCFMDFKAGGALCHILGAAYKYKNEQGWRRFDLQNPSRMDRNVEMFMNIEKTLVQNNCLTRPNIYLIPDIDLKLANKLKDIIKRHQGTFTDEKSKASHHIYPYSSSQDDEEWLRPVMRKEKQVLVHWGFYPDSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSENTPVKGGTVADLDEQDEETVTAGGKEDEDPAKGDQSRSVDLGEDNVTEQTNHIIIPSYASWFDYNCIHVIERRALPEFFNGKNKSKTPEIYLAYRNFMIDTYRLNPQEYLTSTACRRNLTGDVCAVMRVHAFLEQWGLVNYQVDPESRPMAMGPPPTPHFNVLADTPSGLVPLHLRSPQVPAAQQMLNFPEKNKEKPVDLQNFGLRTDIYSKKTLAKSKGASAGREWTEQETLLLLEALEMYKDDWNKVSEHVGSRTQDECILHFLRLPIEDPYLENSDASLGPLAYQPVPFSQSGNPVMSTVAFLASVVDPRVASAAAKAALEEFSRVREEVPLELVEAHVKKVQEAARASGKVDPTYGLESSCIAGTGPDEPEKLEGAEEEKMEADPDGQQPEKAENKVENETDEGDKAQDGENEKNSEKEQDSEVSEDTKSEEKETEENKELTDTCKERESDTGKKKVEHEISEGNVATAAAAALASAATKAKHLAAVEERKIKSLVALLVETQMKKLEIKLRHFEELETIMDREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAP

SEQ ID NO: 41 - DNA, 5684 bp, Mus musculus
ggaggtggcatctgcgcgcgcgcgcgcgggtgcgaacgggaaacgccgcgagggccaggctaggccgggcggtagacacgacggacggtgactatggccgcgacagcgggtggcggtccgggagcagcagcaggcgccgtgggtgcagggggtgcggcggcggcctccgggctggccgtgtaccggaggaaggacgggggcccggccagcaagttttgggagagcccggacacggtgtcccagctagattcggtgcgagtctggctgggcaagcactacaagaagtatgttcatgcagatgctcctaccaataaaacactagctggactggtggtgcagcttctacagttccaagaagatgcctttgggaagcatgtcaccaacccagctttcaccaaactacctgcaaaatgtttcatggatttcaaagctggaggcaccttgtgtcacattcttggggcagcttacaagtacaaaaatgaacagggctggcggagatttgatcttcagaacccatcccgaatggatcgtaacgttgaaatgttcatgaacattgagaaaacattggtacagaacaactgtctgactagaccaaacatctacctcattccagacattgatttgaagttggctaacaagttgaaagatatcatcaaacggcatcaggggacatttactgatgagaagtcaaaagcttcccaccatatttatccatatccttcctcacaagaggatgaggagtggctgagaccagtgatgaggagagacaagcaggtgctggtgcactggggtttctacccagacagctatgacacttgggtccacagtaatgatgttgatgctgaaattgaagatgcaccaatcccagaaaagccctggaaggttcatgtaaaatggattttggacactgacgttttcaatgaatggatgaatgaagaggattatgaagtggatgagaacagaaagccagtgagctttcgtcaacgaatttcaacaaagaatgaagagccagtcagaagtccagaaaggagagacagaaaagcctctgccaactctaggaagaggaaaccttccccttctcctcctcctcccacagccacagagtcccgcaagaagagcgggaagaaaggacaagctagcctttatgggaaacgtagaagtcagaaggaagaagatgagcaagaagatcttaccaaggacatggaagaccccacacctgtacctaacatagaggaagtggttctccctaagaatgtaaacccaaagaaggacagtgaaaacacacccgttaaaggaggcacggtggcagatctagatgagcaggatgaagaagcagttacaacaggaggaaaggaagatgaagatcccagcaaaggtgatccaagtcgctcagttgacccaggtgaagacaacgtgacagaacagaccaatcacatcattattcccagctacgcatcctggtttgattataattgtattcatgtcattgaacggcgtgcgcttcctgagttctttaatggaaaaaacaaatccaagacccctgaaatatacttggcatatcgaaattttatgattgacacataccgtctaaaccctcaagaatatttaaccagcactgcttgccggcgaaacctgactggagatgtgtgtgctgtgatgagggttcatgccttcttagagcagtggggtcttgttaactaccaagttgacccagagagtcgacccatggcaatgggacctcctcccactcctcacttcaatgtgttagctgacacaccctctgggcttgtgcccctgcatcttcgatcacctcaggtccctgccgctcaacagatgttaaattttcctgagaagaacaaggaaaaaccaattgatttgcagaactttggtcttcgaactgacatttactccaagaaaacactggcaaagagtaaaggtgctagtgctggaagggagtggacagaacaggagacccttcttctcctagaggctctggagatgtacaaggacgattggaataaagtgtcagaacatgttggaagccgtactcaggacgaatgcatcctccactttctgaggcttcccattgaggacccttaccttgaaaattcagatgcttctcttgggccactggcttaccagcctgtccctttcagccagtcgggaaacccggtgatgagcactgttgcctttttagcatctgtcgttgacccccgtgtagcatctgctgcagcaaaagcagcgttggaggagttttctcgtgtccgagaagaagtacccctggaattggttgaagcacatgtcaagaaagtacaggaagctgcaagagcctctgggaaggtggaccccacctatggcttggagagcagctgtattgctggcacagggcctgacgagccagagaagcttgaaggatctgaagaagagaagatggaaacagatcctgatggtcagcagcctgaaaaggcagaaaacaaagtggaaaatgaatcggatgaaggtgataaaatacaagatcgagagaatgaaaaaaacactgagaaggaacaagatagtgacgtcagtgaggatgtcaagccagaagaaaaggagaatgaagagaacaaagagctcactgatacatgtaaagaaagagaaagcgatgccgggaagaagaaagtggaacacgagatttcggaaggaaacgttgccacagccgcagcagctgctctggcctcagctgctactaaagccaagcacctggcggctgttgaagaaagaaaaatcaagtccttggtagctctcttggttgaaacacaaatgaagaaactagagatcaaacttcgacattttgaagagctggagactataatggacagagagaaagaggctctagaacaacagagacagcagttgcttactgagcgtcagaacttccacatggaacagttgaaatatgctgaactacgtgcccggcagcaaatggagcagcagcagcagcatggccagacacctcagcaggcgcaccagcacacgggagggccggggatggccccacttggagccacaggccaccctggcatgatgccgcatcagcagccccctccctacccactgatgcaccatcagatgccgccaccccatcctccccaaccaggtcaaataccaggccctggctccatgatgcctggccagcccatgccaggtcgcatgatccccgctgtggcagccaacattcaccctactgggagtggccctacccctcctggtatgcctccaatgcccggaaacatcttaggaccccgggtacccctcacagcaccaaacggcatgtatcctcctccaccacagcagcagcagccgcctcctcctgcagatggggtccctccacctcctgctccaggcccacccgcctcggccactccctagcctggaagatacaagagcctccacagccaccacaagcaggaatggggatggcaggacttgtgtctcggcttccttggttttcttgcaggatttttttttcacaaccccaagcacaagccccatgtctctccactccttgatacttcttgtgtcaggtccttagttgacactcattgggaagcctgtggtgactgatgtgctctggtcatttaaaaagtaccatgtgtctcccctgtccccgtgtgacagatgttggcaggtggtctgcaggtcctgttgtgttgacattagtattctttgtgtgtatctctctctgtctctctctctctgctttgtctaaggcttcaatgtataatcctctataattattgtcctttcttcctttgtaatggttgtttttttaaggaaagtatcctaagttaatagaaaccaaaaaaaatggtaatgggcagaaagagatagccacagagggacacaccttaaggcattataagtgaccttatttctgcttatctgagctagagtggtgctactgatagagtccctgagacttgtcacacataagtgcaccaagatgagaagagctggggaaagggggtatcctttcgatttgatttcctggtgaggaccatgaaggacttccctgtgcctggaagaacatgccactgtacctagtacacgatagatagcaaagagcacagctttacaacaagcccttcctaccttctcccgccattctggttgtctgtgcagaagatttgcaggattggaacatggtggttgttttcccaagggcagcgtgagctttcagagttggggttttcccagtctaacaaagataaagggtctggggccctacctacaaacctttaggaacccttccaaacctcccaaccttccccaaacacatagggcctaccctcgccaccccaataaacattacatgttttttaaaccttcctataagaaaggaaaaaaatgtaaaatgggttatagattatgttgaacattttatctcatgcggcttggtgggggtgggggtacagatccctaaactacctcttgctgtagccagggtgagcggggttcttaagcggtactgaggtgcagaacgggagtgggaatgctcacatgtgatgagcagcctcctgtacctcacattctgagacctcacattccatctgttgtcacagggttatggagactgtgctaatggcacaaggacctcacttggctccagagtgcgaggctgtaaggtttaagtgccatcccagaggaattgccaccaaaaaaaaaaaaaaaagccttaatctgagcctgtatctacccctgctgatgaacaactagatgggttttggttttgccagcttctttcctccctccctccctccctccctccctccctccctcctttctgtctttccattagtagcaaaagggtgtttttagcagaactttaagtggcagtttcattcttgagagtgcaaggtagagcaccttacgggtgtatttttatgtgtattttaaagctttatgtatgagagctataggtaggcatttcttaataacacaaaaacctacagttgagatttgcctttaagactcttggttttcctctaaccaggagcccacgtcaccgccagagtcctggagctagagctaatgactccagagccttggggtggaaatggagattcgcttattccctgggtgcttgtttttcctccaggaaaaccccggtgtcttctgaccgcagccagggttgccctccttccctccattctctcccaaagtaaattgactccagcacttgccttctccccggagtcctaggggaggtataggactctgcttgtctgtaacctgaggtctgtaatgtgattgctttccagttttgagagatgcaagtgggaatagtttttacattgttgataatctatagaacctaagttcaacacttcaacacagctctttccatgactgtcagttaggtatcattcctgtaataacacccatccagttttgtgaggggcgggcttggatactgtgtggtttttgtacaaatgtgtttctcagtgtgggtttttgttttttgttgggttttttttttttttttggtgtttttttgtttgtttatttgttttttttctttaggttttgttctaatgaggtaaaggagctttgagagtttgggagaaaatgaatgaaagtggcttaatgtccctcgtttgcattgaataaatgaaataccatttatgaattctaaaaaaaaaaaa

SEQ ID NO: 42 - protein, 1104 aa, Mus musculus
MAATAGGGPGAAAGAVGAGGAAAASGLAVYRRKDGGPASKFWESPDTVSQLDSVRVWLGKHYKKYVHADAPTNKTLAGLVVQLLQFQEDAFGKHVTNPAFTKLPAKCFMDFKAGGTLCHILGAAYKYKNEQGWRRFDLQNPSRMDRNVEMFMNIEKTLVQNNCLTRPNIYLIPDIDLKLANKLKDIIKRHQGTFTDEKSKASHHIYPYPSSQEDEEWLRPVMRRDKQVLVHWGFYPDSYDTWVHSNDVDAEIEDAPIPEKPWKVHVKWILDTDVFNEWMNEEDYEVDENRKPVSFRQRISTKNEEPVRSPERRDRKASANSRKRKPSPSPPPPTATESRKKSGKKGQASLYGKRRSQKEEDEQEDLTKDMEDPTPVPNIEEVVLPKNVNPKKDSENTPVKGGTVADLDEQDEEAVTTGGKEDEDPSKGDPSRSVDPGEDNVTEQTNHIIIPSYASWFDYNCIHVIERRALPEFFNGKNKSKTPEIYLAYRNFMIDTYRLNPQEYLTSTACRRNLTGDVCAVMRVHAFLEQWGLVNYQVDPESRPMAMGPPPTPHFNVLADTPSGLVPLHLRSPQVPAAQQMLNFPEKNKEKPIDLQNFGLRTDIYSKKTLAKSKGASAGREWTEQETLLLLEALEMYKDDWNKVSEHVGSRTQDECILHFLRLPIEDPYLENSDASLGPLAYQPVPFSQSGNPVMSTVAFLASVVDPRVASAAAKAALEEFSRVREEVPLELVEAHVKKVQEAARASGKVDPTYGLESSCIAGTGPDEPEKLEGSEEEKMETDPDGQQPEKAENKVENESDEGDKIQDRENEKNTEKEQDSDVSEDVKPEEKENEENKELTDTCKERESDAGKKKVEHEISEGNVATAAAAALASAATKAKHLAAVEERKIKSLVALLVETQMKKLEIKLRHFEELETIMDREKEALEQQRQQLLTERQNFHMEQLKYAELRARQQMEQQQQHGQTPQQAHQHTGGPGMAPLGATGHPGMMPHQQPPPYPLMHHQMPPPHPPQPGQIPGPGSMMPGQPMPGRMIPAVAANIHPTGSGPTPPGMPPMPGNILGPRVPLTAPNGMYPPPPQQQQPPPPADGVPPPPAPGPPASATP

SEQ ID NO: 43 - DNA, 5106 bp, Homo sapiens
ggaggcggcggccgcggcggcgggaggcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcgggtaatgctcctttgggtttgccttttggcatgccgcctcctcctcctcctcctgctccatccatcatcccatttggtagtctagctgactccatcagtattaacctccccgctcctcctaacctgcatgggcatcaccaccatctcccgttcgccccgggcactctccccccacctaacctgcctgtgtccatggcgaaccctctacatcctaacctgccggcgaccaccaccatgccatcttccttgcctctcgggccggggctcggatccgccgcagcccaaagccctgccattgtggcagctgttcagggcaacctcctgcccagtgccagcccactgccagacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaagtagattttaaaaagccacattggagctcccttctacccactaaaaaataaccaatttttacattttttgagggggagtgagttttaggaaaggggaattaagattccagggagagctctggggatagaacagggcgcagattccatctctccccaagcccctttttagtgactaagtcaaggccccaactcccctcccccaccctacgctgagcttattcgagttcattcgtactaataatccctcctgcggcttcctcattgttgctgttttaggccaccccagctcagccaatgattcctttccctctgaatgtcagttttgtttttaaaagtcacttgcttagttgatgtcagcgtatgtgtatttggtggggaaaacctaatttcggggatttctgtggtaggtaataggagaagaaagggcactgggggctgttctccttccttccctgggctgtatccatggactcctggaaggcacagagaagggagctataagaggatgtgaagttttaaaacctgaaattgttttttaaagcacttaagcacctccatattatgacttggtgggtcaccccttagcttcctccctctcccaccaagactatgagaacttcagctgatagctgggggctccccagatgaggatgcagggatttgggagcagtggaagagggtgcccaaccttgggttggaccaacccttggctcgcagctcaactctgcttcccgcattcctgctccacgtgtcccagcttctcccctgtgacgggaaggcaggtgtgactccaggctctgcactggttcttcttggttcctcccaccaggccctttgttcctcatgtccccatgtttctctccctctgcgtcttagcacctttcttctgttcaaagttttctgtaaattttctctttttttctttctttcttttttttttttttataaattaatttgctttcagttccaaaaaaaaaaaaaaaaaaa

SEQ ID NO: 44 - protein, 1214 aa, Homo sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVAGNAPLGLPFGMPPPPPPPAPSIIPFGSLADSISINLPAPPNLHGHHHHLPFAPGTLPPPNLPVSMANPLHPNLPATTTMPSSLPLGPGLGSAAAQSPAIVAAVQGNLLPSASPLPDPGTPLPPDPTAPSPGTVTPVPPPQ

SEQ ID NO: 45 - DNA, 4854 bp, Homo sapiens
ggaggcggcggccgcggcggcgggaggcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagggccgccaggttgatgctgataccaaggctgggcgaaagggcaaagagctggatgacctggtgccagagacggctaagggcaagccagagctgcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcggacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaagtagattttaaaaagccacattggagctcccttctacccactaaaaaataaccaatttttacattttttgagggggagtgagttttaggaaaggggaattaagattccagggagagctctggggatagaacagggcgcagattccatctctccccaagcccctttttagtgactaagtcaaggccccaactcccctcccccaccctacgctgagcttattcgagttcattcgtactaataatccctcctgcggcttcctcattgttgctgttttaggccaccccagctcagccaatgattcctttccctctgaatgtcagttttgtttttaaaagtcacttgcttagttgatgtcagcgtatgtgtatttggtggggaaaacctaatttcggggatttctgtggtaggtaataggagaagaaagggcactgggggctgttctccttccttccctgggctgtatccatggactcctggaaggcacagagaagggagctataagaggatgtgaagttttaaaacctgaaattgttttttaaagcacttaagcacctccatattatgacttggtgggtcaccccttagcttcctccctctcccaccaagactatgagaacttcagctgatagctgggggctccccagatgaggatgcagggatttgggagcagtggaagagggtgcccaaccttgggttggaccaacccttggctcgcagctcaactctgcttcccgcattcctgctccacgtgtcccagcttctcccctgtgacgggaaggcaggtgtgactccaggctctgcactggttcttcttggttcctcccaccaggccctttgttcctcatgtccccatgtttctctccctctgcgtcttagcacctttcttctgttcaaagttttctgtaaattttctctttttttctttctttcttttttttttttttataaattaatttgctttcagttccaaaaaaaaaaaaaaaaaaa

SEQ ID NO: 46 - protein, 1130 aa, Homo sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQGRQVDADTKAGRKGKELDDLVPETAKGKPELQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVADPGTPLPPDPTAPSPGTVTPVPPPQ

SEQ ID NO: 47 - DNA, 4920 bp, Homo sapiens
ggaggcggcggccgcggcggcgggaggcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagggccgccaggttgatgctgataccaaggctgggcgaaagggcaaagagctggatgacctggtgccagagacggctaagggcaagccagagctgcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcggcccaaagccctgccattgtggcagctgttcagggcaacctcctgcccagtgccagcccactgccagacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaagtagattttaaaaagccacattggagctcccttctacccactaaaaaataaccaatttttacattttttgagggggagtgagttttaggaaaggggaattaagattccagggagagctctggggatagaacagggcgcagattccatctctccccaagcccctttttagtgactaagtcaaggccccaactcccctcccccaccctacgctgagcttattcgagttcattcgtactaataatccctcctgcggcttcctcattgttgctgttttaggccaccccagctcagccaatgattcctttccctctgaatgtcagttttgtttttaaaagtcacttgcttagttgatgtcagcgtatgtgtatttggtggggaaaacctaatttcggggatttctgtggtaggtaataggagaagaaagggcactgggggctgttctccttccttccctgggctgtatccatggactcctggaaggcacagagaagggagctataagaggatgtgaagttttaaaacctgaaattgttttttaaagcacttaagcacctccatattatgacttggtgggtcaccccttagcttcctccctctcccaccaagactatgagaacttcagctgatagctgggggctccccagatgaggatgcagggatttgggagcagtggaagagggtgcccaaccttgggttggaccaacccttggctcgcagctcaactctgcttcccgcattcctgctccacgtgtcccagcttctcccctgtgacgggaaggcaggtgtgactccaggctctgcactggttcttcttggttcctcccaccaggccctttgttcctcatgtccccatgtttctctccctctgcgtcttagcacctttcttctgttcaaagttttctgtaaattttctctttttttctttctttcttttttttttttttataaattaatttgctttcagttccaaaaaaaaaaaaaaaaaaa

SEQ ID NO: 48 - protein, 1152 aa, Homo sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQGRQVDADTKAGRKGKELDDLVPETAKGKPELQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVAAQSPAIVAAVQGNLLPSASPLPDPGTPLPPDPTAPSPGTVTPVPPPQ

SEQ ID NO: 49 - DNA, 5199 bp, Homo sapiens
ggaggcggcggccgcggcggcgggaggcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagggccgccaggttgatgctgataccaaggctgggcgaaagggcaaagagctggatgacctggtgccagagacggctaagggcaagccagagctgcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcgggtaatgctcctttgggtttgccttttggcatgccgcctcctcctcctcctcctgctccatccatcatcccatttggtagtctagctgactccatcagtattaacctccccgctcctcctaacctgcatgggcatcaccaccatctcccgttcgccccgggcactctccccccacctaacctgcctgtgtccatggcgaaccctctacatcctaacctgccggcgaccaccaccatgccatcttccttgcctctcgggccggggctcggatccgccgcagcccaaagccctgccattgtggcagctgttcagggcaacctcctgcccagtgccagcccactgccagacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaagtagattttaaaaagccacattggagctcccttctacccactaaaaaataaccaatttttacattttttgagggggagtgagttttaggaaaggggaattaagattccagggagagctctggggatagaacagggcgcagattccatctctccccaagcccctttttagtgactaagtcaaggccccaactcccctcccccaccctacgctgagcttattcgagttcattcgtactaataatccctcctgcggcttcctcattgttgctgttttaggccaccccagctcagccaatgattcctttccctctgaatgtcagttttgtttttaaaagtcacttgcttagttgatgtcagcgtatgtgtatttggtggggaaaacctaatttcggggatttctgtggtaggtaataggagaagaaagggcactgggggctgttctccttccttccctgggctgtatccatggactcctggaaggcacagagaagggagctataagaggatgtgaagttttaaaacctgaaattgttttttaaagcacttaagcacctccatattatgacttggtgggtcaccccttagcttcctccctctcccaccaagactatgagaacttcagctgatagctgggggctccccagatgaggatgcagggatttgggagcagtggaagagggtgcccaaccttgggttggaccaacccttggctcgcagctcaactctgcttcccgcattcctgctccacgtgtcccagcttctcccctgtgacgggaaggcaggtgtgactccaggctctgcactggttcttcttggttcctcccaccaggccctttgttcctcatgtccccatgtttctctccctctgcgtcttagcacctttcttctgttcaaagttttctgtaaattttctctttttttctttctttcttttttttttttttataaattaatttgctttcagttccaaaaaaaaaaaaaaaaaaa

SEQ ID NO: 50 - protein, 1245 aa, Homo sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQGRQVDADTKAGRKGKELDDLVPETAKGKPELQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVAGNAPLGLPFGMPPPPPPPAPSIIPFGSLADSISINLPAPPNLHGHHHHLPFAPGTLPPPNLPVSMANPLHPNLPATTTMPSSLPLGPGLGSAAAQSPAIVAAVQGNLLPSASPLPDPGTPLPPDPTAPSPGTVTPVPPPQ

SEQ ID NO: 51 - DNA, 4964 bp, Mus musculus
gtggcggcgggaggcggcgggaggcgggcggaggaggaggcgggagctgagctgagcggggcgggcggcggcggggcccgagcccgagaagatggcggtgcggaagaaggacggcggccccaacgtgaagtactacgaggccgcggacaccgtgacccagttcgacaacgtgcggctctggctcggcaagaactacaagaagtacatacaagcagaaccgccaaccaacaagtctctgtccagcctggtggtgcagttgctccagtttcaggaagaggtttttggcaaacatgtcagcaacgcaccgcttactaaactgccgatcaaatgtttcctagatttcaaagcaggaggatccctctgccatattcttgcagctgcctacaaattcaagagtgaccagggatggcggcgttacgatttccagaatccatcacgcatggaccgcaatgtggaaatgttcatgaccattgagaagtccttggtacagaataattgcctgtcacgacctaacattttcctctgcccagaaattgagcccaaactgctagggaaattaaaagacattgttaagagacaccagggaaccatctctgaggataagagcaatgcctcccatgttgtgtatcctgtcccagggaacctagaagaagaggaatgggtacggccagtcatgaagagggataaacaggttcttctgcactggggctactatcctgacagctacgacacgtggatcccagcgagtgaaattgaagcatctgtggaggacgctcccactcctgagaaaccgaggaaggtccatgcgaagtggatcctcgacaccgacacattcaacgagtggatgaatgaggaagactacgaagtcagtgacgacaaaagcccagtctcccgcaggaagaagatctcagccaagacgctgacagacgaggtaaacagcccagattcagacagacgagacaagaaggggggcaactataagaagaggaagcgctctccctctccttcacccaccccagaggctaagaagaaaaacgctaagaaaggaccctcaacaccttataccaagtcaaagcgaggccacagagaagaggaacaagaagacctgacaaaagacatggatgagccctctccagtcccaaacgtggaagaggtgacactccccaaaacagtcaacactaaaaaggactctgagtcagccccagtcaaaggcggcaccatgactgacctggatgaacaggacgatgaaagcatggagaccaccggcaaggacgaggatgagaacagcacgggcaacaaaggcgagcagacgaagaacccggacctgcatgaggacaatgtgaccgagcagacccaccacatcatcatccccagctacgccgcctggtttgactacaacagcgtccatgccattgaacggagggctcttcctgagttcttcaacggcaagaacaagtctaagactccagagatctacctggcgtatcggaacttcatgattgacacttaccgactgaatccccaggagtatctaacatctactgcctgtcggcggaatttggcgggtgatgtctgcgctatcatgagggtccatgccttcctggaacagtggggtcttattaactaccaggtagatgctgagagccgaccaaccccaatggggcctccacccacctctcacttccatgtcttggcggacacaccatcagggctggttcctcttcagccgaagcctccacagcagagctctgcttcccagcaaatgctgaacttccctgagaagggcaaggagaaaccagcagacatgcagaattttgggctgcgcacagacatgtacacaaagaagaacgtcccctccaagagcaaagctgcagcaagtgccactcgggaatggacggagcaggagactctgctgctcctggaggctttggaaatgtacaaggacgactggaacaaagtatctgagcacgtgggaagccgcacgcaggacgagtgcatcttgcattttctccgccttcccattgaagacccatacctggaggactcggaggcttctctaggccctctggcctaccaacccatccccttcagtcagtcaggcaaccctgttatgagcaccgttgccttcctggcctctgtcgtcgatccccgagttgcctctgctgctgcgaagtcagccctagaagagttctcaaaaatgaaggaagaggtgcccacagctttggtggaagcccacgtgcgtaaggtcgaagaagcggccaaagtcacaggcaaggccgacccagcctttggtctggagagtagcggcatcgcagggactgcctctgatgagcctgagcgcattgaggaaagcgggactgaggaggcacggccagagggccaggcagcagatgagaagaaggagcctaaggaaccacgggaaggagggggcgctgtggaggaagaagcaaaggaggaaataagtgaggtccccaagaaagatgaagagaaagggaaagaaggtgacagtgagaaggagtctgagaagagtgacggggacccgatagttgatcctgagaaagacaaggaaccaacagaagggcaggaggaagtgctaaaggaagtggcagagccagagggggagaggaaaaccaaggtggagcgtgacattggtgaaggcaacctgtccacagctgcagccgcagccctggccgctgctgcagtcaaggccaagcacttggctgcagttgaggagagaaagatcaagtctttggtggctctgctggtagagacccaaatgaagaaactagagatcaaactccgacattttgaggagctggagacaataatggaccgggagcgagaggcgctggaataccagaggcagcagctcctggccgaccggcaagccttccacatggagcagctgaagtatgcagagatgagggcccggcagcagcacttccagcagatgcaccagcagcagcagcagcagccaccaaccttgcccccaggctcccagcccatacctcccaccggggctgctggaccacctacagtccatggtctagctgtgcctccagccgctgtggcctctgcccctcctggcagtggggcccctcctggaagcttgggcccttctgaacagattgggcaggcagggacaactgcagggccacagcagccacaacaagctggagcccctcagcctggggcagtcccaccaggggtacccccccctggaccccatggcccctcaccgttccccaaccaaccaactcctccctcaatgatgccaggggcagtgccaggcagcgggcacccaggcgtggcgggtaatgctcctttgggtttgccttttggcatgccgcctcctcctcctgctgctccatccgtcatcccattcggtagtctagctgactccattagtattaaccttccccctcctcctaacctgcatgggcatcaccaccatctcccgtttgccccgggcactatccccccacctaacctgcctgtgtccatggcgaaccctctacatcctaacctgccggcgaccaccaccatgccatcttccttgcctctcgggccggggctcggatccgccgcagcccagagccctgccattgtggcagctgttcagggcaacctcctgcccagtgccagcccactgccagacccaggcaccccgctgcctccagaccccacagctccaagcccaggcacagtcacccctgtgccacctccacagtgaggaaccagccagccatctctccccctcactccccatggagatcacagttccaggaacagccctcccccactactgggaccctccctcagcctgaagagttcatcactacgtaaggaaagctcctcctgccccctcaccacccccaccatgcccagcagaggtgtgcagttttatatccaattattatccacggacttctgactaaaagatgtttctaatgcctgggagagagaataggagggaaagatgtttatacgaggttctactaactggttctgagggtctaccccttcagaattactgcatttttgaagtgataacatgaaaatgaaaccctttaaaagggaggttttaaaaaaagacacttcggagcccacaaaaaaagaacttttttaattattattattattattttgaggggaaagggcaggttttaagaggaattaaatttctggggcaaggtgtgaggtggaatagggcaccgagcctgtctccctgagcccttggcagtgctgagtcagctcccctcacccattccagtttattcatacaaatccctcctgctgctcgtcatggttgctgttttaggcccagttcagccaatgaccttttcctccagtcagctttgtgtttgtgtttaagtcacctgcttactcgtcagcgtctgtgtacttgtgggaaatgtagttttcggggattctgtggtaggaaatagaggaagaaggggcctcagttgggctcttcttcctgctttcctagttgtatctgtgagtgcccaacaggcatcagagggggagctctaagaggatggggggcctgcagaccctcaagtttgaaaagcacttaagcacctacttttgacagtgggacagtctgctaacttctgcccccaccaaccaagcctgacagaacccagtgatagctaggagttccccaaatgaggacaaagatttgggagcagtgcagcgtgcctctgcactccaggtcttcctcttcaccccctacttggaggcagacacaattccaggccgcaccagagcctggcccctcccaccaggcgctttgctccttctgtcccagcgtctccttcctctgcatctccacacctttcttctgttcaaagtcttctgtaaaattttctttccttctttgttcttttctttttccttttttttttataaattaatttgctttcagttccaaaaaaaaaaaaaaaaaaaaaaaaaaaaaa

SEQ ID NO: 52 - protein, 1213 aa, Mus musculus
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIVKRHQGTISEDKSNASHVVYPVPGNLEEEEWVRPVMKRDKQVLLHWGYYPDSYDTWIPASEIEASVEDAPTPEKPRKVHAKWILDTDTFNEWMNEEDYEVSDDKSPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQDDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKPPQQSSASQQMLNFPEKGKEKPADMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTASDEPERIEESGTEEARPEGQAADEKKEPKEPREGGGAVEEEAKEEISEVPKKDEEKGKEGDSEKESEKSDGDPIVDPEKDKEPTEGQEEVLKEVAEPEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQQPPTLPPGSQPIPPTGAAGPPTVHGLAVPPAAVASAPPGSGAPPGSLGPSEQIGQAGTTAGPQQPQQAGAPQPGAVPPGVPPPGPHGPSPFPNQPTPPSMMPGAVPGSGHPGVAGNAPLGLPFGMPPPPPAAPSVIPFGSLADSISINLPPPPNLHGHHHHLPFAPGTIPPPNLPVSMANPLHPNLPATTTMPSSLPLGPGLGSAAAQSPAIVAAVQGNLLPSASPLPDPGTPLPPDPTAPSPGTVTPVPPPQ

SEQ ID NO: 53 - DNA, 4715 bp, Mus musculus
gtggcggcgggaggcggcgggaggcgggcggaggaggaggcgggagctgagctgagcggggcgggcggcggcggggcccgagcccgagaagatggcggtgcggaagaaggacggcggccccaacgtgaagtactacgaggccgcggacaccgtgacccagttcgacaacgtgcggctctggctcggcaagaactacaagaagtacatacaagcagaaccgccaaccaacaagtctctgtccagcctggtggtgcagttgctccagtttcaggaagaggtttttggcaaacatgtcagcaacgcaccgcttactaaactgccgatcaaatgtttcctagatttcaaagcaggaggatccctctgccatattcttgcagctgcctacaaattcaagagtgaccagggatggcggcgttacgatttccagaatccatcacgcatggaccgcaatgtggaaatgttcatgaccattgagaagtccttggtacagaataattgcctgtcacgacctaacattttcctctgcccagaaattgagcccaaactgctagggaaattaaaagacattgttaagagacaccagggaaccatctctgaggataagagcaatgcctcccatgttgtgtatcctgtcccagggaacctagaagaagaggaatgggtacggccagtcatgaagagggataaacaggttcttctgcactggggctactatcctgacagctacgacacgtggatcccagcgagtgaaattgaagcatctgtggaggacgctcccactcctgagaaaccgaggaaggtccatgcgaagtggatcctcgacaccgacacattcaacgagtggatgaatgaggaagactacgaagtcagtgacgacaaaagcccagtctcccgcaggaagaagatctcagccaagacgctgacagacgaggtaaacagcccagattcagacagacgagacaagaaggggggcaactataagaagaggaagcgctctccctctccttcacccaccccagaggctaagaagaaaaacgctaagaaaggaccctcaacaccttataccaagtcaaagcgaggccacagagaagaggaacaagaagacctgacaaaagacatggatgagccctctccagtcccaaacgtggaagaggtgacactccccaaaacagtcaacactaaaaaggactctgagtcagccccagtcaaaggcggcaccatgactgacctggatgaacaggacgatgaaagcatggagaccaccggcaaggacgaggatgagaacagcacgggcaacaaaggcgagcagacgaagaacccggacctgcatgaggacaatgtgaccgagcagacccaccacatcatcatccccagctacgccgcctggtttgactacaacagcgtccatgccattgaacggagggctcttcctgagttcttcaacggcaagaacaagtctaagactccagagatctacctggcgtatcggaacttcatgattgacacttaccgactgaatccccaggagtatctaacatctactgcctgtcggcggaatttggcgggtgatgtctgcgctatcatgagggtccatgccttcctggaacagtggggtcttattaactaccaggtagatgctgagagccgaccaaccccaatggggcctccacccacctctcacttccatgtcttggcggacacaccatcagggctggttcctcttcagccgaagcctccacagggccgccaggttgatgctgacaccaaggctgggcggaagggcaaagagctggatgacctggtgccagagacggctaagggcaagccagagctgcagagctctgcttcccagcaaatgctgaacttccctgagaagggcaaggagaaaccagcagacatgcagaattttgggctgcgcacagacatgtacacaaagaagaacgtcccctccaagagcaaagctgcagcaagtgccactcgggaatggacggagcaggagactctgctgctcctggaggctttggaaatgtacaaggacgactggaacaaagtatctgagcacgtgggaagccgcacgcaggacgagtgcatcttgcattttctccgccttcccattgaagacccatacctggaggactcggaggcttctctaggccctctggcctaccaacccatccccttcagtcagtcaggcaaccctgttatgagcaccgttgccttcctggcctctgtcgtcgatccccgagttgcctctgctgctgcgaagtcagccctagaagagttctcaaaaatgaaggaagaggtgcccacagctttggtggaagcccacgtgcgtaaggtcgaagaagcggccaaagtcacaggcaaggccgacccagcctttggtctggagagtagcggcatcgcagggactgcctctgatgagcctgagcgcattgaggaaagcgggactgaggaggcacggccagagggccaggcagcagatgagaagaaggagcctaaggaaccacgggaaggagggggcgctgtggaggaagaagcaaaggaggaaataagtgaggtccccaagaaagatgaagagaaagggaaagaaggtgacagtgagaaggagtctgagaagagtgacggggacccgatagttgatcctgagaaagacaaggaaccaacagaagggcaggaggaagtgctaaaggaagtggcagagccagagggggagaggaaaaccaaggtggagcgtgacattggtgaaggcaacctgtccacagctgcagccgcagccctggccgctgctgcagtcaaggccaagcacttggctgcagttgaggagagaaagatcaagtctttggtggctctgctggtagagacccaaatgaagaaactagagatcaaactccgacattttgaggagctggagacaataatggaccgggagcgagaggcgctggaataccagaggcagcagctcctggccgaccggcaagccttccacatggagcagctgaagtatgcagagatgagggcccggcagcagcacttccagcagatgcaccagcagcagcagcagcagccaccaaccttgcccccaggctcccagcccatacctcccaccggggctgctggaccacctacagtccatggtctagctgtgcctccagccgctgtggcctctgcccctcctggcagtggggcccctcctggaagcttgggcccttctgaacagattgggcaggcagggacaactgcagggccacagcagccacaacaagctggagcccctcagcctggggcagtcccaccaggggtacccccccctggaccccatggcccctcaccgttccccaaccaaccaactcctccctcaatgatgccaggggcagtgccaggcagcgggcacccaggcgtggcggacccaggcaccccgctgcctccagaccccacagctccaagcccaggcacagtcacccctgtgccacctccacagtgaggaaccagccagccatctctccccctcactccccatggagatcacagttccaggaacagccctcccccactactgggaccctccctcagcctgaagagttcatcactacgtaaggaaagctcctcctgccccctcaccacccccaccatgcccagcagaggtgtgcagttttatatccaattattatccacggacttctgactaaaagatgtttctaatgcctgggagagagaataggagggaaagatgtttatacgaggttctactaactggttctgagggtctaccccttcagaattactgcatttttgaagtgataacatgaaaatgaaaccctttaaaagggaggttttaaaaaaagacacttcggagcccacaaaaaaagaacttttttaattattattattattattttgaggggaaagggcaggttttaagaggaattaaatttctggggcaaggtgtgaggtggaatagggcaccgagcctgtctccctgagcccttggcagtgctgagtcagctcccctcacccattccagtttattcatacaaatccctcctgctgctcgtcatggttgctgttttaggcccagttcagccaatgaccttttcctccagtcagctttgtgtttgtgtttaagtcacctgcttactcgtcagcgtctgtgtacttgtgggaaatgtagttttcggggattctgtggtaggaaatagaggaagaaggggcctcagttgggctcttcttcctgctttcctagttgtatctgtgagtgcccaacaggcatcagagggggagctctaagaggatggggggcctgcagaccctcaagtttgaaaagcacttaagcacctacttttgacagtgggacagtctgctaacttctgcccccaccaaccaagcctgacagaacccagtgatagctaggagttccccaaatgaggacaaagatttgggagcagtgcagcgtgcctctgcactccaggtcttcctcttcaccccctacttggaggcagacacaattccaggccgcaccagagcctggcccctcccaccaggcgctttgctccttctgtcccagcgtctccttcctctgcatctccacacctttcttctgttcaaagtcttctgtaaaattttctttccttctttgttcttttctttttccttttttttttataaattaatttgctttcagttccaaaaaaaaaaaaaaaaaaaaaaaaaaaaaa

SEQ ID NO: 54 - protein, 1130 aa, Mus musculus
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIVKRHQGTISEDKSNASHVVYPVPGNLEEEEWVRPVMKRDKQVLLHWGYYPDSYDTWIPASEIEASVEDAPTPEKPRKVHAKWILDTDTFNEWMNEEDYEVSDDKSPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQDDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKPPQGRQVDADTKAGRKGKELDDLVPETAKGKPELQSSASQQMLNFPEKGKEKPADMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTASDEPERIEESGTEEARPEGQAADEKKEPKEPREGGGAVEEEAKEEISEVPKKDEEKGKEGDSEKESEKSDGDPIVDPEKDKEPTEGQEEVLKEVAEPEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQQPPTLPPGSQPIPPTGAAGPPTVHGLAVPPAAVASAPPGSGAPPGSLGPSEQIGQAGTTAGPQQPQQAGAPQPGAVPPGVPPPGPHGPSPFPNQPTPPSMMPGAVPGSGHPGVADPGTPLPPDPTAPSPGTVTPVPPPQ

SEQ ID NO: 55 - DNA, 4622 bp, Mus musculus
gtggcggcgggaggcggcgggaggcgggcggaggaggaggcgggagctgagctgagcggggcgggcggcggcggggcccgagcccgagaagatggcggtgcggaagaaggacggcggccccaacgtgaagtactacgaggccgcggacaccgtgacccagttcgacaacgtgcggctctggctcggcaagaactacaagaagtacatacaagcagaaccgccaaccaacaagtctctgtccagcctggtggtgcagttgctccagtttcaggaagaggtttttggcaaacatgtcagcaacgcaccgcttactaaactgccgatcaaatgtttcctagatttcaaagcaggaggatccctctgccatattcttgcagctgcctacaaattcaagagtgaccagggatggcggcgttacgatttccagaatccatcacgcatggaccgcaatgtggaaatgttcatgaccattgagaagtccttggtacagaataattgcctgtcacgacctaacattttcctctgcccagaaattgagcccaaactgctagggaaattaaaagacattgttaagagacaccagggaaccatctctgaggataagagcaatgcctcccatgttgtgtatcctgtcccagggaacctagaagaagaggaatgggtacggccagtcatgaagagggataaacaggttcttctgcactggggctactatcctgacagctacgacacgtggatcccagcgagtgaaattgaagcatctgtggaggacgctcccactcctgagaaaccgaggaaggtccatgcgaagtggatcctcgacaccgacacattcaacgagtggatgaatgaggaagactacgaagtcagtgacgacaaaagcccagtctcccgcaggaagaagatctcagccaagacgctgacagacgaggtaaacagcccagattcagacagacgagacaagaaggggggcaactataagaagaggaagcgctctccctctccttcacccaccccagaggctaagaagaaaaacgctaagaaaggaccctcaacaccttataccaagtcaaagcgaggccacagagaagaggaacaagaagacctgacaaaagacatggatgagccctctccagtcccaaacgtggaagaggtgacactccccaaaacagtcaacactaaaaaggactctgagtcagccccagtcaaaggcggcaccatgactgacctggatgaacaggacgatgaaagcatggagaccaccggcaaggacgaggatgagaacagcacgggcaacaaaggcgagcagacgaagaacccggacctgcatgaggacaatgtgaccgagcagacccaccacatcatcatccccagctacgccgcctggtttgactacaacagcgtccatgccattgaacggagggctcttcctgagttcttcaacggcaagaacaagtctaagactccagagatctacctggcgtatcggaacttcatgattgacacttaccgactgaatccccaggagtatctaacatctactgcctgtcggcggaatttggcgggtgatgtctgcgctatcatgagggtccatgccttcctggaacagtggggtcttattaactaccaggtagatgctgagagccgaccaaccccaatggggcctccacccacctctcacttccatgtcttggcggacacaccatcagggctggttcctcttcagccgaagcctccacagcagagctctgcttcccagcaaatgctgaacttccctgagaagggcaaggagaaaccagcagacatgcagaattttgggctgcgcacagacatgtacacaaagaagaacgtcccctccaagagcaaagctgcagcaagtgccactcgggaatggacggagcaggagactctgctgctcctggaggctttggaaatgtacaaggacgactggaacaaagtatctgagcacgtgggaagccgcacgcaggacgagtgcatcttgcattttctccgccttcccattgaagacccatacctggaggactcggaggcttctctaggccctctggcctaccaacccatccccttcagtcagtcaggcaaccctgttatgagcaccgttgccttcctggcctctgtcgtcgatccccgagttgcctctgctgctgcgaagtcagccctagaagagttctcaaaaatgaaggaagaggtgcccacagctttggtggaagcccacgtgcgtaaggtcgaagaagcggccaaagtcacaggcaaggccgacccagcctttggtctggagagtagcggcatcgcagggactgcctctgatgagcctgagcgcattgaggaaagcgggactgaggaggcacggccagagggccaggcagcagatgagaagaaggagcctaaggaaccacgggaaggagggggcgctgtggaggaagaagcaaaggaggaaataagtgaggtccccaagaaagatgaagagaaagggaaagaaggtgacagtgagaaggagtctgagaagagtgacggggacccgatagttgatcctgagaaagacaaggaaccaacagaagggcaggaggaagtgctaaaggaagtggcagagccagagggggagaggaaaaccaaggtggagcgtgacattggtgaaggcaacctgtccacagctgcagccgcagccctggccgctgctgcagtcaaggccaagcacttggctgcagttgaggagagaaagatcaagtctttggtggctctgctggtagagacccaaatgaagaaactagagatcaaactccgacattttgaggagctggagacaataatggaccgggagcgagaggcgctggaataccagaggcagcagctcctggccgaccggcaagccttccacatggagcagctgaagtatgcagagatgagggcccggcagcagcacttccagcagatgcaccagcagcagcagcagcagccaccaaccttgcccccaggctcccagcccatacctcccaccggggctgctggaccacctacagtccatggtctagctgtgcctccagccgctgtggcctctgcccctcctggcagtggggcccctcctggaagcttgggcccttctgaacagattgggcaggcagggacaactgcagggccacagcagccacaacaagctggagcccctcagcctggggcagtcccaccaggggtacccccccctggaccccatggcccctcaccgttccccaaccaaccaactcctccctcaatgatgccaggggcagtgccaggcagcgggcacccaggcgtggcggacccaggcaccccgctgcctccagaccccacagctccaagcccaggcacagtcacccctgtgccacctccacagtgaggaaccagccagccatctctccccctcactccccatggagatcacagttccaggaacagccctcccccactactgggaccctccctcagcctgaagagttcatcactacgtaaggaaagctcctcctgccccctcaccacccccaccatgcccagcagaggtgtgcagttttatatccaattattatccacggacttctgactaaaagatgtttctaatgcctgggagagagaataggagggaaagatgtttatacgaggttctactaactggttctgagggtctaccccttcagaattactgcatttttgaagtgataacatgaaaatgaaaccctttaaaagggaggttttaaaaaaagacacttcggagcccacaaaaaaagaacttttttaattattattattattattttgaggggaaagggcaggttttaagaggaattaaatttctggggcaaggtgtgaggtggaatagggcaccgagcctgtctccctgagcccttggcagtgctgagtcagctcccctcacccattccagtttattcatacaaatccctcctgctgctcgtcatggttgctgttttaggcccagttcagccaatgaccttttcctccagtcagctttgtgtttgtgtttaagtcacctgcttactcgtcagcgtctgtgtacttgtgggaaatgtagttttcggggattctgtggtaggaaatagaggaagaaggggcctcagttgggctcttcttcctgctttcctagttgtatctgtgagtgcccaacaggcatcagagggggagctctaagaggatggggggcctgcagaccctcaagtttgaaaagcacttaagcacctacttttgacagtgggacagtctgctaacttctgcccccaccaaccaagcctgacagaacccagtgatagctaggagttccccaaatgaggacaaagatttgggagcagtgcagcgtgcctctgcactccaggtcttcctcttcaccccctacttggaggcagacacaattccaggccgcaccagagcctggcccctcccaccaggcgctttgctccttctgtcccagcgtctccttcctctgcatctccacacctttcttctgttcaaagtcttctgtaaaattttctttccttctttgttcttttctttttccttttttttttataaattaatttgctttcagttccaaaaaaaaaaaaaaaaaaaaaaaaaaaaaa

SEQ ID NO: 56 - protein, 1099 aa, Mus musculus
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIVKRHQGTISEDKSNASHVVYPVPGNLEEEEWVRPVMKRDKQVLLHWGYYPDSYDTWIPASEIEASVEDAPTPEKPRKVHAKWILDTDTFNEWMNEEDYEVSDDKSPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQDDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKPPQQSSASQQMLNFPEKGKEKPADMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTASDEPERIEESGTEEARPEGQAADEKKEPKEPREGGGAVEEEAKEEISEVPKKDEEKGKEGDSEKESEKSDGDPIVDPEKDKEPTEGQEEVLKEVAEPEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQQPPTLPPGSQPIPPTGAAGPPTVHGLAVPPAAVASAPPGSGAPPGSLGPSEQIGQAGTTAGPQQPQQAGAPQPGAVPPGVPPPGPHGPSPFPNQPTPPSMMPGAVPGSGHPGVADPGTPLPPDPTAPSPGTVTPVPPPQ

SEQ ID NO: 57 - DNA, 3431 bp, Homo sapiens
agcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagatccatgagacaatagaaaccatcaaccagctgaagactcagcgggagttcatgctgagctttgccagagaccctcagggtttcatcaatgactggcttcagtcccagtgcagggacctcaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaaggatgggtcctcctacctactgtgagagagctcttccctgagctcttcttccttcaataccattagccaaa

SEQ ID NO: 58 - protein, 515 aa, Homo sapiens
MAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKQKRKLRIFISNTFNPAKSDAEDGEGTVASWELRVEGRLLEDSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKIHETIETINQLKTQREFMLSFARDPQGFINDWLQSQCRDLKTMTDVVGNPEEERRAEFYFQPWAQEAVCRYFYSKVQQRRQELEQALGIRNT

SEQ ID NO: 59 - DNA, 3308 bp, Homo sapiens
agcacgccttttccgctagtcgccccgctctatcccatagtctcgctgccctgagcctcccgtgccggccggccggccgggggaacaggcgggcgctcggggggcgctcggggggcggggggagttccggttccggttctttgtgcggctgcatcggcggctccgggaagatggcggcccgggcgggtttccagtctgtggctccaagcggcggcgccggagcctcaggaggggcgggcgcggctgctgccttgggcccgggcggaactccggggcctcctgtgcgaatgggcccggctccgggtcaagggctgtaccgctccccgatgcccggagcggcctatccgagaccaggtatgttgccaggcagccgaatgacacctcagggaccttccatgggaccccctggctatggggggaacccttcagtccgacctggcctggcccagtcagggatggatcagtcccgcaagagacctgcccctcagcagatccagcaggtccagcagcaggcggtccaaaatcgaaaccacaatgcaaagaaaaagaagatggctgacaaaattctacctcaaaggattcgtgaactggtaccagaatcccaggcctatatggatctcttggcttttgaaaggaaactggaccagactatcatgaggaaacggctagatatccaagaggccttgaaacgtcccatcaagcaaaaacggaagctgcgaattttcatttctaacactttcaatccggctaagtcagatgccgaggatggggaagggacggtggcttcctgggagcttcgggtagaaggacggctcctggaggattcagccttgtccaaatatgatgccactaaacaaaagaggaagttctcttccttttttaagtccttggtgattgaactggacaaagacctgtatgggccagacaaccatctggtagaatggcacaggaccgccactacccaggagaccgatggctttcaggtgaagcggccgggagacgtgaatgtacggtgtactgtcctactgatgctggattaccagcctccccagtttaaattagacccccgcctagctcgactcctgggcatccatacccagactcgtccagtgatcatccaagcactgtggcaatatattaagacacataagctccaggaccctcacgagcgggagtttgtcatctgtgacaagtacctgcagcagatctttgagtctcaacgtatgaagttttcagagatccctcagcggctccatgccttgcttatgccaccagaacctatcatcattaatcatgtcatcagtgttgacccgaatgatcagaaaaagacagcttgttatgacattgatgttgaagtggatgacaccttgaagacccagatgaattcttttctgctgtccactgccagccaacaggagattgctactctagacaacaagacaatgactgatgtggtgggtaacccagaggaggagcgccgagctgagttctacttccagccctgggctcaggaggctgtgtgccgatacttctactccaaggtgcagcagagacgacaagaattagagcaagccctgggaatccggaatacatagggcctctcccacagccctgattcgactgcaccaattcttgatttgggccctgtgctgcctgcctcatagtatctgccttggtcttgcttggggcgttccaggggatgctgttggttcaaggacaacaccagaatgaagagggtctcacaagacacctgttatcctcttctttcaccctatctcttcccacccccagcttccctttgccccacaaagttcccatgtgcctgtaccctcccctggtctacataggacctctagatagtgttagagagagaacatgtagtggtaatgagtgcttggaatggattgggcctcaggccaggtggtcttcaaggggaccagctaactgatcctgcccttcagagacccaggagttgggagctttcgctccttctccaagactcaggcctgtgggcactctataagctagttgatcttggctctcctgataacagaatccaatttccttccttccctccacaggtttggaacaaactctcccttcacttgttgccctgtagcactacagaaaccctggttcttgggctccactgagccccaggtcagtccccagccctctgggttggcctgctgtcagtgcttctctcactccttagttggggtccacatcagtattggagttttgttctttattgctccctcccagacactccctgtggctgccctttgtgattccctcagatctgccctaatcccgggcatttgggtgggggaatcttgcctttccctttcagagccccagggatctcatctggggaactgtcattgccagcagaggctgttccttcctgctgtttggagatgtgactcattcattcactcactccaccctgcctctgcatcccttaatggagaaacgggcctaaaaccaaacgggtaaaaagccctgggccatccctgtcttcctgtcccttgtctgcccagttgacacctactggtgacttctagggcactgaggagtgaaagcgcctagggctggagaatagcgctgagttgggtttgtgactcttccctctccctgcctcacaggattgtgactccccagcccctgccctcaaagcttcagacccctcaggtagcagcaggaccttgtgatcttggccccttggatctgagatggtttttgcatctttccaggagagcctcacattcttcttccaggttgtatcacccccgagttagcatatcccaggctcgcagactcaacacagcaagggtgggagacagctgggcacaaagggggaattccgttcagcatgggctctaaacccacagaactgacaaagcccctgcttccccaccccctcctcaggctcctgcgagcacacccccacccccaaatccctccctgttctacactggggacagcagaattttctccccgtcttccccttcctgccattttccctcccttgaaaggttgacactggacaaccttggggcagctgagccctggccgcctcctggctggaaccatgagaaggaagctcagtacttcccacagtgtccctgttgataactgtttttattaactgaattgtttttttcatggaccaaacttttttttgtactgtccccttattgatgttacccagttttaataaaagaatcttctgaaggatgggtcctcctacctactgtgagagagctcttccctgagctcttcttccttcaataccattagccaaa

SEQ ID NO: 60 - protein, 474 aa, Homo sapiens
MAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKQKRKLRIFISNTFNPAKSDAEDGEGTVASWELRVEGRLLEDSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKTMTDVVGNPEEERRAEFYFQPWAQEAVCRYFYSKVQQRRQELEQALGIRNT

SEQ ID NO: 61 - DNA, 3153 bp, Mus musculus
gttctttgtgcagctgcagcggcggctccgggaagatggcggcccgggcgggtttccagtctgtggctccgagcggcggcgcgggagcctcaggaggagcgggcgtggcggctgctctgggcccgggcggaactcccgggcctcccgtgcgaatgggcccggcgccgggtcaagggctgtaccgctctccgatgcccggggcggcctatccgagaccaggtatgctgccaggtagccgaatgacacctcagggaccttccatgggacctcctggctatggggggaacccttcagtccgacctggtctggcccagtcagggatggaccagtcccgcaagagacctgcacctcaacagatccagcaggtccagcagcaggcggtccaaaatcgaaatcacaatgcaaagaaaaagaagatggctgacaaaatcctacctcaaaggattcgggaactggtcccagaatcacaggcctacatggatctcctggcttttgaaaggaaactggaccagactattatgaggaagcggctagatatccaggaggccttgaaacgtcccatcaagcaaaaacggaagctgcgaattttcatttctaacacgttcaatccggctaagtcggacgcggaggatggggaagggacggtggcttcctgggagctccgggtagaaggccggctcctggaggacgcggccttgtccaaatatgacgccaccaagcaaaagagaaagttctcttccttttttaagtccttggtgatcgaactggacaaagacctctatggcccagacaaccatctggtagaatggcacaggaccgccactacccaggagaccgatggcttccaggtgaagcggccaggagatgtgaatgtacggtgtactgtcctgctgatgctggactaccagcccccccagtttaaattagaccctcgcctggctcggctcttgggcatccatacccagacacgtccagtgatcatccaagcactgtggcagtatattaaaacacacaagctccaggaccctcacgagcgagagtttgttctctgtgacaagtacctccagcagatctttgaatctcagcggatgaagttctcagagatccctcagcggctccacgccttgcttatgccaccagagcccatcatcatcaatcatgtcatcagtgtggacccaaatgaccagaaaaagaccgcgtgctatgacattgacgtggaggtggatgacactctgaagacccagatgaactctttcctgttgtccactgccagccagcaggagatcgccactctagacaacaagatccatgagacgatagagaccatcaaccagctgaagacccagcgagagttcatgttgagctttgcccgagaccctcagggtttcatcaatgattggcttcagtcccagtgcagggacctcaagacgatgactgatgtggtgggtaacccggaagaggagcgtcgtgctgagttctacttccagccctgggctcaggaggctgtgtgccgatacttctactccaaggtgcagcagaggcggcaagagttagagcaagccctgggaatccgaaacacatagggcctctgtggccctagcctggctgcaccgattccttgggccctgtgctgcctgcctcagtgtacctgtcttggtcttgcttgaggcattccaggggacttggcttcaggacagtgtcacaatgaagagggtgtcacatttctgtctcacagtcacctgttatcccgtcctgtaccccagtcgtcccccgtcccgtcgtgtccccccctcaccccaccccgcctcagctcctccccatcaggctcctgtgtgcctctacctccctatcctacataggacctctagatagtgttagagaaccacagagtgggggcctcctgaggtcaggtggtcttgagggagaccagctacactgatcctgcccttgtcaggagacctaggccttgggagctatccctgtctgagcctcaggcctagggcagtctgtaagctagctgaccttggccctcccggtagcttgacttcttccctcccctccgcaggttggggcagaggctcctttacctctggcagtaaaggagcctgggcttcactgagccccgggttggtcccctgccctctggacttaacctgctgtctcagtgtcctctgaccccttaggggtccatgtcagtattggagtgtgtgttgaattgttgctccctcccacacactcccgtagccgcccagtttaggatttccctacacctgccctaacccacgcttttgggttggggatcttgcctttccttgtcattcccagcagagactgttccttcctgctgttagaggagtggcttgtttattcactccaccctgccccctcctgtaaatggagaaacaggcctgaaatcaaacgggtaaagccctaggccatccctgtcttcctgtcccatgtctgcccagttgaatcccactggtggcttcccgggcactgaggagtaaaagcgcctagggctggagaataggtctgaaatgggtttgtgactccccaccccctgccctgccctcaaagcttcagacccctcagggagcagcaggatgtgggatcgaggccccttgggacagatgctttgaatcttccagggaagcctccgattcttccaggtttgtcacccggagttagcatgtcccaggctcgcagacaacactgcagggtgggagacagctgggcacagggggattctgttgagcatgggctctgaacccacagaactgacaaagcccctgcttccccacccccacctcaggctcctgcgagcagtgctcctgcacccttcccagcctgttctgtactggggacagcagtcttctccctgtcctcccatgtcctatatccacccctccccttggaaggtcctccccacagtgacactggacagccctggggcagctgagccccagcctggcttctggctggaagcgcgatgaggagacttagcactccacagtgtccctggtggtaactgttcttattaactgattgtgttttgttttgttttgttttgttttcatggaccaaaattttttttgtactgtctccttaactgatgtcacccagttttaataaaagacttctaaagagcaggtc

SEQ ID NO: 62 - protein, 515 aa, Mus musculus
MAARAGFQSVAPSGGAGASGGAGVAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKQKRKLRIFISNTFNPAKSDAEDGEGTVASWELRVEGRLLEDAALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVLCDKYLQQIFESQRMKFSEIPQRLHALLMPPEPIIINHVISVDPNDQKKTACYDIDVEVDDTLKTQMNSFLLSTASQQEIATLDNKIHETIETINQLKTQREFMLSFARDPQGFINDWLQSQCRDLKTMTDVVGNPEEERRAEFYFQPWAQEAVCRYFYSKVQQRRQELEQALGIRNT

SEQ ID NO: 63 - DNA, 2770 bp, Homo sapiens
gttgggcggggcagggagttcgtagccgcctctgggtaactcgactcgggcggccaaacctccggaggccggggacggaaggcgggcccgcagcagatcctggatccggaatctcccgggcaggagcggaatctgtcccgaaccgggtctgtgaggaactcgcgaacttggattaggaaatcccggagcccggatcgacaaatcccggaacccggaattaagatcgccaagtcccggatcgcggagcacagagcacggagtggactcgacgcggagcccggagtccggatcgcggcaccgcgggacgggacggagcgatgtcgggccgaggcgcgggcgggttcccgctgcccccgctaagccctggcggcggcgccgtggctgcggccctgggagcgccgcctccccccgcgggacccggcatgctgcccggaccggcgctccggggaccgggtccggcaggaggcgtggggggccccggggccgccgccttccgccccatgggccccgcgggccccgcggcgcagtaccagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacatctggcaggtttggaaatttccaaataaatccttttgtctattg

SEQ ID NO: 64 - protein, 531 aa, Homo sapiens
MSGRGAGGFPLPPLSPGGGAVAAALGAPPPPAGPGMLPGPALRGPGPAGGVGGPGAAAFRPMGPAGPAAQYQRPGMSPGNRMPMAGLQVGPPAGSPFGAAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKAEGDSAGTAGTPGGTPAGDKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 65 - DNA, 2341 bp, Homo sapiens
agtaccaggtgagcaaggaggacgcgagcggacgggggcgagaggcgctgcgagggcgcccgggccggcggctgaaggggcctcgacgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacatctggcaggtttggaaatttccaaataaatccttttgtctattgaaaaaaaaaaaaaaaaaa

SEQ ID NO: 66 - protein, 456 aa, Homo sapiens
MSPGNRMPMAGLQVGPPAGSPFGAAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKAEGDSAGTAGTPGGTPAGDKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 67 - DNA, 2374 bp, Homo sapiens
agtgtgtgcaaggcagagctgccaaacaggccttgcaggcagcagccatggggaggcgggtgggggtggaggtgactcccagatgggctccacagaaatgtcagggagcaaggcctcagcgacctggcatgtcaccagggaaccggatgcccatggctggcttgcaggtgggaccccctgctggctccccatttggtgcagcagctccgcttcgacctggcatgccacccaccatgatggatccattccgaaaacgcctgcttgtgccccaggcgcagcctcccatgcctgcccagcgccgggggttaaagaggaggaagatggcagataaggttctacctcagcgaatccgggagcttgttccagagtctcaggcgtacatggatctcttggcttttgagcggaagctggaccagaccattgctcgcaagcggatggagatccaggaggccatcaaaaagcctctgacacaaaagcgaaagcttcggatctacatttccaatacgttcagtcccagcaaggcggaaggcgatagtgcaggaactgcagggacccctgggggaaccccagcaggggacaaggtggcttcctgggaactccgagtggaaggaaaactgctggatgatcctagcaaacagaagaggaagttttcttcattctttaagagcctcgtcattgagctggacaaggagctgtacgggcctgacaatcacctggtggagtggcaccggatgcccaccacccaggagacagatggcttccaagtaaaacggcctggagacctcaacgtcaagtgcaccctcctgctcatgctggatcatcagcctccccagtacaaattggacccccgattggcaaggctgctgggagtgcacacgcagacgagggccgccatcatgcaggccctgtggctttacatcaagcacaaccagctgcaggatgggcacgagcgggagtacatcaactgcaaccgttacttccgccagatcttcagttgtggccgactccgtttctccgagattcccatgaagctggcagggttgctgcagcatccagaccccattgtcatcaaccatgtcattagtgtcgaccctaacgaccagaagaagacagcctgttacgacatcgatgtggaggtggacgacccactgaaggcccaaatgagcaattttctggcctctaccaccaatcagcaggagatcgcctcccttgatgtcaagatccatgagaccattgagtccatcaaccagctgaagacccagagagatttcatgctcagttttagcaccgacccccaggacttcatccaggaatggctccgttcccagcgccgagacctcaagatcatcactgatgtgattggaaatcctgaggaggagagacgagctgctttctaccaccagccctgggcccaggaagcagtaggcaggcacatctttgccaaggtgcagcagcgaaggcaggaactggaacaggtgctgggaattcgcctgacctaactgctcagggatctttcttcccagccctggagcctggagggagaccaccctctgggtccttgctggggccgcagacacgtaggctggggtgaggagtgtctgctgtcaccctctactctccagctttagtcttataaatgtagtgataggattccttgttgcttggtccccaaagccttatactttttgcattggctttaattgggttcagcagatgcctcctctgcccccctgcaggcaggcccaagtaggactgctggaggctgtgctttgacattgtaagacatttccgaaccaaaggctgctgggtttgcatgtttacagactccccctggggcgagggtcagagctggctctggggagctgggctaggaagaggaggtgcagcccagactcttcctagcctttctaaaccaaagttctttgccattcctacaagcccagccttgctgctggttttttcctttcctttgggtatttgcactattttgggagcaagttttctatgtgggagccactttttttgtacaggggtaagttgggggttttcagggagcctgttaggtgcctccttcttttctttcctcaatctatgcaagcggctctggccgccatcatctcctgggatgccagagggctgcctctccagcggcttgggccggggaggggacactccagttctctagcatggcctgaggtatggggtatgtgcatgtggaggccagggtaaggtgaatggggaggctgggaggactggtgttgccctttggagcttggtgaggagggtgggcctagggcttggcgagtgccacatctggcaggtttggaaatttccaaataaatccttttgtctattgaaaaaaaaaaaaaaaaaa

SEQ ID NO: 68 - protein, 483 aa, Homo sapiens
MGRRVGVEVTPRWAPQKCQGARPQRPGMSPGNRMPMAGLQVGPPAGSPFGAAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKAEGDSAGTAGTPGGTPAGDKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 69 - DNA, 2767 bp, Mus musculus
ctccggcgatcaaacctccggaggccgggagaggcctgcgggctcgcggcacatcccggatctggagtatccctggcaggagcggagtcagaggggccgcgggatcctaaagccgggctgcaaagaacttgcgaacttggagtagaagatcccggaacccggtagtaaaatcgggaagtcccggatcgcggaacgtagctcgcggagcggactcaacacggagaccggaggccggatcgctgcaccgcgggacgggacagagtgatgtccggccgtggcgcgggcgggttcccgctgcctccgctgagccccggcggcggcgccgttgccgcggcccttggtgcgccgcctccgcctgcgggacccggaatgctgcccagcccggcgctcaggggcccggggccttctggaggcatgggggtaccgggggccgccgccttccgccccatgggccccgctggccccgcggcgcagtaccagcgtcctggcatgtcaccaggaagcaggatgcccatggctggcttgcaggtgggacctcctgccggttccccatttggcacagctgctccgctccgacctggcatgccacctaccatgatggatccattccgaaaacgcctgcttgtgcctcaggcccagcccccgatgcctgcccagcgccgagggttaaagaggaggaagatggcagataaggttctacctcagcgaatccgggagcttgtcccagagtctcaggcatacatggatcttttagctttcgagaggaagctggaccagaccatcgctcgcaagcggatggagattcaagaggccatcaagaagcctctgacgcaaaagcgaaaacttcggatctatatttccaatacattcagccccagcaaggcggatggagataatgcgggaactgcggggacccctgggggaaccccggcagcagacaaggtggcctcctgggagcttcgagtagaggggaaactgctggatgatcctagcaaacagaagaggaagttctcatcattctttaagagccttgtgattgagttggacaaggaactctatgggccggacaaccatctggtggagtggcatcggatgcccaccacacaggaaacagatggctttcaggtgaaacggccaggagatctcaatgtcaagtgcacccttctgctcatgctggatcatcagcctcctcagtataaactggacccccgcctggcgaggttgctgggagtgcacacacagaccagggcggcaatcatgcaggcactgtggctttacatcaaacacaaccagctgcaggacggccatgagcgcgagtacatcaactgcaatcgttacttccgccagatcttcagttgtggccgactccgtttctccgagattcccatgaagctggctggattgctgcagcatccagaccccattgttattaatcatgtcattagtgtggatcctaatgaccaaaagaagacagcctgctatgacattgatgtagaggttgatgacccactgaaggcccagatgagcaacttcctggcctctaccaccaaccagcaggagattgcttctcttgacgtcaagatccatgagaccattgagtccatcaaccagctaaagacccagagggatttcatgctcagctttagcaccgagccccaggacttcatccaggagtggctccgttcccaacgccgagacctcaagatcatcacagatgtgattggaaaccctgaggaggagagacgagctgctttctaccaccagccctgggctcaggaagcagtggggaggcacatctttgccaaggtgcagcagcgaaggcaggaactggaacaggtgctgggaattcgcctgacctaactgctcagggattgcctccttccttcctcccctgccctggatggaacctggcaagagcccgtcctctgggttctggcttgggctgcagacatgtaggatggagtgaggtgtgtttcctgtcaccctccactccccagctttagtttcataaatgtagttttagatccctcactgcttggttcccaaagccttattactgaccttttagcgctggctttaattgggtttgcaatgagcggcctcagccccctgcaggcaggcaggcctgagtaggaggctggaggctgtgctttaactttgtaccagacatttccaaaccaaaggctgctgggtttgcatgtttacaggctccaccctagggccagtgccagagctggctttggggagctgggcaaggaagagaaggccctagactcttcctggcctttctaaccaaagttttttgccattcctacaagcccagtcttgctgctggtttgtccttctttttgggtatttgcactatttggggagcaggtttttctatgtgggagccacttttttgtacagaggtaatggggtttttcagggagcccacttggtgcctccttcttcctttcttttcttaatctatgcaagcggctgcagccgccatcatctcctggtatgccacaaggctgcccacccatagctgcttgggcagggggaggtggaatctcctgagagtggcaatgccagttctctaacccagttacagcaggggtgtgtgtgcgtgcgtgcgtgcgtgctgcaggggaaggggaaagctggaggactgctgttaccttttgcagtcggtcttaaagaggatgggcctaaggcttggcaaacttggaaaattccaaataaatctttttgtttattggtggtgcccagaaaaaaaaaaaaa

SEQ ID NO: 70 - protein, 531 aa, Mus musculus
MSGRGAGGFPLPPLSPGGGAVAAALGAPPPPAGPGMLPSPALRGPGPSGGMGVPGAAAFRPMGPAGPAAQYQRPGMSPGSRMPMAGLQVGPPAGSPFGTAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKADGDNAGTAGTPGGTPAADKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTEPQDFIQEWLRSQRRDLKIITDVIGNPEEERRAAFYHQPWAQEAVGRHIFAKVQQRRQELEQVLGIRLT

SEQ ID NO: 71 - DNA, 2401 bp, Mus musculus
tttgttcctggtctccccatttgagagagagagagagagatggagggtatgggctatggacctcggagggctccgccactgacctgtgtccctccactgttccactttcctcagcgtcctggcatgtcaccaggaagcaggatgcccatggctggcttgcaggtgggacctcctgccggttccccatttggcacagctgctccgctccgacctggcatgccacctaccatgatggatccattccgaaaacgcctgcttgtgcctcaggcccagcccccgatgcctgcccagcgccgagggttaaagaggaggaagatggcagataaggttctacctcagcgaatccgggagcttgtcccagagtctcaggcatacatggatcttttagctttcgagaggaagctggaccagaccatcgctcgcaagcggatggagattcaagaggccatcaagaagcctctgacgcaaaagcgaaaacttcggatctatatttccaatacattcagccccagcaaggcggatggagataatgcgggaactgcggggacccctgggggaaccccggcagcagacaaggtggcctcctgggagcttcgagtagaggggaaactgctggatgatcctagcaaacagaagaggaagttctcatcattctttaagagccttgtgattgagttggacaaggaactctatgggccggacaaccatctggtggagtggcatcggatgcccaccacacaggaaacagatggctttcaggtgaaacggccaggagatctcaatgtcaagtgcacccttctgctcatgctggatcatcagcctcctcagtataaactggacccccgcctggcgaggttgctgggagtgcacacacagaccagggcggcaatcatgcaggcactgtggctttacatcaaacacaaccagctgcaggacggccatgagcgcgagtacatcaactgcaatcgttacttccgccagatcttcagttgtggccgactccgtttctccgagattcccatgaagctggctggattgctgcagcatccagaccccattgttattaatcatgtcattagtgtggatcctaatgaccaaaagaagacagcctgctatgacattgatgtagaggttgatgacccactgaaggcccagatgagcaacttcctggcctctaccaccaaccagcaggagattgcttctcttgacgtcaagatccatgagaccattgagtccatcaaccagctaaagacccagagggatttcatgctcagctttagcaccgagccccaggacttcatccaggagtggctccgttcccaacgccgagacctcaagatcatcacagatgtgattggaaaccctgaggaggagagacgagctgctttctaccaccagccctgggctcaggaagcagtggggaggcacatctttgccaaggtgcagcagcgaaggcaggaactggaacaggtgctgggaattcgcctgacctaactgctcagggattgcctccttccttcctcccctgccctggatggaacctggcaagagcccgtcctctgggttctggcttgggctgcagacatgtaggatggagtgaggtgtgtttcctgtcaccctccactccccagctttagtttcataaatgtagttttagatccctcactgcttggttcccaaagccttattactgaccttttagcgctggctttaattgggtttgcaatgagcggcctcagccccctgcaggcaggcaggcctgagtaggaggctggaggctgtgctttaactttgtaccagacatttccaaaccaaaggctgctgggtttgcatgtttacaggctccaccctagggccagtgccagagctggctttggggagctgggcaaggaagagaaggccctagactcttcctggcctttctaaccaaagttttttgccattcctacaagcccagtcttgctgctggtttgtccttctttttgggtatttgcactatttggggagcaggtttttctatgtgggagccacttttttgtacagaggtaatggggtttttcagggagcccacttggtgcctccttcttcctttcttttcttaatctatgcaagcggctgcagccgccatcatctcctggtatgccacaaggctgcccacccatagctgcttgggcagggggaggtggaatctcctgagagtggcaatgccagttctctaacccagttacagcaggggtgtgtgtgcgtgcgtgcgtgcgtgctgcaggggaaggggaaagctggaggactgctgttaccttttgcagtcggtcttaaagaggatgggcctaaggcttggcaaacttggaaaattccaaataaatctttttgtttattggtggtgcccagaaaaaaaaaaaaa

SEQ ID NO: 72 - protein, 484 aa, Mus musculus
MEGMGYGPRRAPPLTCVPPLFHFPQRPGMSPGSRMPMAGLQVGPPAGSPFGTAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKADGDNAGTAGTPGGTPAADKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTEPQDFIQEWLRSQRRDLKIITDVIGNPEEERRAAFYHQPWAQEAVGRHIFAKVQQRRQELEQVLGIRLT

SEQ ID NO: 73 - DNA, 1689 bp, Homo sapiens
ctggcatcttcctcccctcctcctttccagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgacaaaaaaaaaaaaaaaaaa

SEQ ID NO: 74 - protein, 470 aa, Homo sapiens
MTPGLQHPPTVVQRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 75 - DNA, 1728 bp, Homo sapiens
gccgggccgagccgagcgccgagcagggagcgggcggccgcgctccgggccggggtcccgggggagcagatcctcagaatggcccttggtgctgcaggcgcggtgggctccgggcccaggcaccgagggggcactggatgactctccaggtgcaggaccctgccatctatgactccaggtcttcagcacccacccaccgtggtacagcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgacaaaaaaaaaaaaaaaaaa

SEQ ID NO: 76 - protein, 456 aa, Homo sapiens; identical to SEQ ID NO: 66

SEQ ID NO: 77 - DNA, 1700 bp, Homo sapiens
agcaggactcagaggggagagttggaggaaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtgcgccccgggatgccgtctggagcccggatgccccaccagggggcgcccatgggccccccgggctccccgtacatgggcagccccgccgtgcgacccggcctggcccccgcgggcatggagcccgcccgcaagcgagcagcgcccccgcccgggcagagccaggcacagagccagggccagccggtgcccaccgcccccgcgcggagccgcagtgccaagaggaggaagatggctgacaaaatcctccctcaaaggattcgggagctggtccccgagtcccaggcttacatggacctcttggcatttgagaggaaactggatcaaaccatcatgcggaagcgggtggacatccaggaggctctgaagaggcccatgaagcaaaagcggaagctgcgactctatatctccaacacttttaaccctgcgaagcctgatgctgaggattccgacggcagcattgcctcctgggagctacgggtggaggggaagctcctggatgatcccagcaaacagaagcggaagttctcttctttcttcaagagtttggtcatcgagctggacaaagatctttatggccctgacaaccacctcgttgagtggcatcggacacccacgacccaggagacggacggcttccaggtgaaacggcctggggacctgagtgtgcgctgcacgctgctcctcatgctggactaccagcctccccagttcaaactggatccccgcctagcccggctgctggggctgcacacacagagccgctcagccattgtccaggccctgtggcagtatgtgaagaccaacaggctgcaggactcccatgacaaggaatacatcaatggggacaagtatttccagcagatttttgattgtccccggctgaagttttctgagattccccagcgcctcacagccctgctattgccccctgacccaattgtcatcaaccatgtcatcagcgtggacccttcagaccagaagaagacggcgtgctatgacattgacgtggaggtggaggagccattaaaggggcagatgagcagcttcctcctatccacggccaaccagcaggagatcagtgctctggacagtaagatccatgagacgattgagtccataaaccagctcaagatccagagggacttcatgctaagcttctccagagaccccaaaggctatgtccaagacctgctccgctcccagagccgggacctcaaggtgatgacagatgtagccggcaaccctgaagaggagcgccgggctgagttctaccaccagccctggtcccaggaggccgtcagtcgctacttctactgcaagatccagcagcgcaggcaggagctggagcagtcgctggttgtgcgcaacacctaggagcccaaaaataagcagcacgacggaactttcagccgtgtcccgggccccagcattttgccccgggctccagcatcactcctctgccaccttggggtgtggggctggattaaaagtcattcatctgacaaaaaaaaaaaaaaaaaa

SEQ ID NO: 78 - DNA, 1743 bp, Mus musculus
gggccccctccccactccgctcgagtagaagtgtgagagagcccagcaggactcagaggggagagttggaggaaaaaaaaggcagaaaagggaaagaaagaggaagagagagagagagtgagaggagccgctgagcccaccccgatggccgcggacgaagttgccggaggggcgcgcaaagccacgaaaagcaaactttttgagtttctggtccatggggtgcgccccgggatgccgtctggagcccgaatgccccaccagggggcgcccatgggccccccgggctccccgtacatgggcagccccgcggtacgacccggcctggcccccgcgggcatggagcccgcccgcaagcgagcagcgcccccgcccgggcagagccaggcacagggccagggccagcccgtgcccaccgccccagcgcggagccgcagtgccaagaggaggaagatggctgacaaaatcctccctcaaaggattcgggagctggtacccgagtcccaggcttacatggacctcctagcatttgagaggaaactggatcaaaccatcatgcggaagcgggtggacatccaggaggccctgaagaggcccatgaagcaaaagcgaaagctgcgcctttatatctccaatacttttaaccctgcgaagcctgatgcggaagactctgatggcagcattgcctcctgggagctgcgggtggaggggaagctcttggatgatcctagtaagcagaagaggaagttttcttccttcttcaagagtttggtcattgagttggacaaagacctttatggcccagacaaccaccttgttgagtggcaccggacacccacaacccaggaaacagatgggttccaagtgaagagaccaggggacttgagtgtgcgctgcaccctgctcctgatgctggactatcagcctccccagttcaaattggacccccgcttagcccggctgctggggttacacacacagagccgctcagccattgtccaggcactgtggcagtatgtgaagaccaacaggctacaggactcccatgacaaggagtacatcaatggcgacaagtatttccagcagatttttgactgcccccgcctaaagttctctgagattccccagcgcctcacagccctgctgctgccccctgaccccattgtgatcaaccacgtcatcagcgtggacccatcagaccagaagaagacagcgtgctatgacatagatgtggaggtggaggaaccgctgaaagggcagatgagtagcttcctcctgtccacggccaaccagcaggagatcagtgctctggacagtaagatccatgagacgattgagtccataaaccagctcaagatccagagggacttcatgctaagtttctccagagaccccaaaggctacgtccaagacctgctccgctcccagagccgtgatctcaaggtgatgacagatgtggcagggaaccccgaggaagaacgcagggctgagttctaccaccagccctggtcccaggaagccgttagccgctacttctactgtaagatccagcagcgcaggcaggagctggagcagtcgctggtcgtgcgcaacacctaggagcccgtgaacaagcgtcagggtggaccagccactccgcccagcacaggccctgggctctggactccccctctcgcgctgtgcggaaggtggggagggctggatggattaaaggtcacgtaacagacaaaaaaaaaaaaaaaaaaa

SEQ ID NO: 79 - protein, 483 aa, Mus musculus
MAADEVAGGARKATKSKLFEFLVHGVRPGMPSGARMPHQGAPMGPPGSPYMGSPAVRPGLAPAGMEPARKRAAPPPGQSQAQGQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 80 - DNA, 1749 bp, Homo sapiens
tttgtttgagcggcggcgcgcgcgtcagcgtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatggtaaaaaaacaaaacctaacactaaggatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaacaaaaaaaaaaaaaaa

SEQ ID NO: 81 - protein, 385 aa, Homo sapiens
MMMMALSKTFGQKPVKFQLEDDGEFYMIGSEVGNYLRMFRGSLYKRYPSLWRRLATVEERKKIVASSHGKKTKPNTKDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 82 - DNA, 1722 bp, Homo sapiens
tttgtttgagcggcggcgcgcgcgtcagcgtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaacaaaaaaaaaaaaaaa

SEQ ID NO: 83 - protein, 376 aa, Homo sapiens
MMMMALSKTFGQKPVKFQLEDDGEFYMIGSEVGNYLRMFRGSLYKRYPSLWRRLATVEERKKIVASSHDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 84 - DNA, 1776 bp, Homo sapiens
tttgtttgagcggcggcgcgcgcgtcagcgtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatgatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttggtgtggatgcatcgctgcactcaccctccgtgctgattccgccttagttctccactttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaacaaaaaaaaaaaaaaa

SEQ ID NO: 85 - protein, 394 aa, Homo sapiens
MMMMALSKTFGQKPVKFQLEDDGEFYMIGSEVGNYLRMFRGSLYKRYPSLWRRLATVEERKKIVASSHDHGYTTLATSVTLLKASEVEEILDGNDEKYKAVSISTEPPTYLREQKAKRNSQWVPTLPNSSHHLDAVPCSTTINRNRMGRDKKRTFPLWCGCIAALTLRADSALVLHFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 86 - DNA, 1803 bp, Homo sapiens
tttgtttgagcggcggcgcgcgcgtcagcgtcaacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatggtaaaaaaacaaaacctaacactaaggatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttggtgtggatgcatcgctgcactcaccctccgtgctgattccgccttagttctccactttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaacaaaaaaaaaaaaaaa

SEQ ID NO: 87 - protein, 403 aa, Homo sapiens
MMMMALSKTFGQKPVKFQLEDDGEFYMIGSEVGNYLRMFRGSLYKRYPSLWRRLATVEERKKIVASSHGKKTKPNTKDHGYTTLATSVTLLKASEVEEILDGNDEKYKAVSISTEPPTYLREQKAKRNSQWVPTLPNSSHHLDAVPCSTTINRNRMGRDKKRTFPLWCGCIAALTLRADSALVLHFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 88 - DNA, 1674 bp, Mus musculus
gtcagcttctccacgcatgcgcaccgagggcggcctgctcgttgcagagacggccaaggagcccagtagtgacacgagcgctcgcccggttcgcccggcttgccctgcccgaccttcacctccaggcctccgttcctttcggtccgacgcgcctcggccccgccctagcccaccggattctttccagctcgaccccggctgccggtttcccccgccgccatgatgatgatggcgttgagcaagaccttcgggcagaagcccgtcaagtttcagctggaggacgacggggagttctacatgatcggctccgaggtgggaaactacctgcgtatgttccgaggttctctgtacaagagatacccctcactctggcggcgactagccactgtggaagaaaggaagaaaatagtggcatcgtcacatggtaaaaaaacaaaacctaacactaaggatcatggatataccaccctggccaccagcgtgacactcctgaaagcctcagaggtagaagagatcctggatggcaatgacgagaagtacaaggctgtgtccatcagcacagagcccccgacctacctcagggagcagaaggccaagaggaacagccagtgggtccccaccctgcccaacagctcccaccacctggatgctgtgccctgttccaccaccatcaacaggaaccgcatgggtcgggacaagaagagaaccttccccttgtgctttgatgaccacgacccagctgtgatccatgagaatgcgtcacagcctgaggtgctggtgcccatccggctcgacatggagatcgacgggcagaagctgcgagacgcttttacctggaacatgaatgagaagctaatgactcctgagatgttttcagaaatactttgtgatgacctggatttgaatccactgacttttgtgccagctattgcctctgccattcgacagcagattgagtcctaccccacagacagcatcctagaggatcaatccgaccagcgtgtcatcatcaagctgaacatccacgtggggaacatctccctggtggaccagtttgagtgggacatgtcagagaaagagaactccccagagaagtttgccctgaagctgtgctcagagctgggcttgggcggggagtttgtcaccaccattgcatacagcatccgaggacagctgagctggcaccagaagacctatgccttcagtgagaacccacttcccacagtggagattgccatccgaaataccggagatgctgaccagtggtgccccctgctggagacactgactgatgccgagatggagaaaaagatccgggatcaagataggaacacaaggcgaatgaggcgtcttgccaacactgccccagcctggtgatgaagacatccatgctcgacctctacggagcatctcagactgcctttccttcctctgtggaaagagaaaggcaaagggacagctggtgccatcctgaggactggggtaggagcctcctaggtgcctcccttcagcacacattccatttgctaaaccccaacactgtcccccagagtctagagtcggaagcagcctcattttgggttgtgttttgtttttgtataggagcccaggcagggctggtaacactttttaaataaaaagtaccatgttcaatttcaaaaaaaaaaaaaaaaa

SEQ ID NO: 89 - protein, 385 aa, Mus musculus; identical to SEQ ID NO: 81

SEQ ID NO: 90 - DNA, 1647 bp, Mus musculus
gtcagcttctccacgcatgcgcaccgagggcggcctgctcgttgcagagacggccaaggagcccagtagtgacacgagcgctcgcccggttcgcccggcttgccctgcccgaccttcacctccaggcctccgttcctttcggtccgacgcgcctcggccccgccctagcccaccggattctttccagctcgaccccggctgccggtttcccccgccgccatgatgatgatggcgttgagcaagaccttcgggcagaagcccgtcaagtttcagctggaggacgacggggagttctacatgatcggctccgaggtgggaaactacctgcgtatgttccgaggttctctgtacaagagatacccctcactctggcggcgactagccactgtggaagaaaggaagaaaatagtggcatcgtcacatgatcatggatataccaccctggccaccagcgtgacactcctgaaagcctcagaggtagaagagatcctggatggcaatgacgagaagtacaaggctgtgtccatcagcacagagcccccgacctacctcagggagcagaaggccaagaggaacagccagtgggtccccaccctgcccaacagctcccaccacctggatgctgtgccctgttccaccaccatcaacaggaaccgcatgggtcgggacaagaagagaaccttccccttgtgctttgatgaccacgacccagctgtgatccatgagaatgcgtcacagcctgaggtgctggtgcccatccggctcgacatggagatcgacgggcagaagctgcgagacgcttttacctggaacatgaatgagaagctaatgactcctgagatgttttcagaaatactttgtgatgacctggatttgaatccactgacttttgtgccagctattgcctctgccattcgacagcagattgagtcctaccccacagacagcatcctagaggatcaatccgaccagcgtgtcatcatcaagctgaacatccacgtggggaacatctccctggtggaccagtttgagtgggacatgtcagagaaagagaactccccagagaagtttgccctgaagctgtgctcagagctgggcttgggcggggagtttgtcaccaccattgcatacagcatccgaggacagctgagctggcaccagaagacctatgccttcagtgagaacccacttcccacagtggagattgccatccgaaataccggagatgctgaccagtggtgccccctgctggagacactgactgatgccgagatggagaaaaagatccgggatcaagataggaacacaaggcgaatgaggcgtcttgccaacactgccccagcctggtgatgaagacatccatgctcgacctctacggagcatctcagactgcctttccttcctctgtggaaagagaaaggcaaagggacagctggtgccatcctgaggactggggtaggagcctcctaggtgcctcccttcagcacacattccatttgctaaaccccaacactgtcccccagagtctagagtcggaagcagcctcattttgggttgtgttttgtttttgtataggagcccaggcagggctggtaacactttttaaataaaaagtaccatgttcaatttcaaaaaaaaaaaaaaaaa

SEQ ID NO: 91 - protein, 376 aa, Mus musculus; identical to SEQ ID NO: 83

SEQ ID NO: 92 - DNA, 2425 bp, Homo sapiens
gctccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaa

SEQ ID NO: 93 - protein, 411 aa, Homo sapiens
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 94 - DNA, 2961 bp, Mus musculus
ggcggaggcaggggagccccgctgggcgccagcaaggacctaaacgcagcgacccgggtcctccccgcctacattctccatcttctccattcatacgtccatcagcggaggactgaagaccagagcgaagggaaaagccagagtgcatggtgtgtgggaactgcgtcccaccctctcccgggagaggctccggcgagcctttcccctccggcgcccgcctcacgcggcggcgcccaccgcctcagtgaagccccgggcgcgcagtctgcgcagttcctgccgccgggccgcgaaccagggcccgcaacgcggcccagccttctccgccctcctcgccgtgacgaatcggcgcccgactgggacgggatccaaattggaagacttctgaggaaacccaggagcctgacgaaattttttttaaaaatccttggcgccctaagcctcgccgcgtgctcactggaagggctgttcgtctgccgggagccggccgcggccggcagacaattcccgggagcgtgtggaaagtgcgagcgcggaagctccggcgcgaggggcggggcgagcgcgggacaaagggaagcgaagccggagctgcgggcgcctgctcggcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcgtcctctggcattacgattccaaagcctccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagagaagcaagaatatttaaacgaatacgaagcagaaaagatagagtacaatgagtctatgaaggcctaccataattcccctgcgtaccttgcctatattaatgcaaaaagtcgtgcggaagctgcattagaggaagaaagtcgacagagacagtctcgcatggagaaaggagaaccttacatgagcattcagcctgctgaggatccagacgactatgatgatggcttttcaatgaagcacacagccactgcccgtttccagagaaaccaccgtctcatcagtgagatcctcagtgagagtgtggtacctgatgtgcggtcggttgtcacaacagctagaatgcaggtcctcaagcgacaggtccagtctttaatggttcatcagcggaaactagaagccgagctccttcagatagaggaacgacaccaggaaaagaagaggaaattcctggaaagcacggactcctttaacaatgaacttaaaaggttatgtggtctgaaggtggaagtagacatggagaagattgcggctgagatcgcacaggcggaggaacaagcccgcaagaggcaagaggagagggagaaggaggcagcagagcaggctgagcgcagtcagagcagcatggcccctgaggaagagcaagtggcgaacaaagccgaggagaagaaagatgaggagagcatcccgatggagacagaggagacacaccttgaagacacagcagagagccagcagaatggtgaagaaggcacgtctactcctgaggacaaggagagtgggcaggagggggttgacagcatggaggtggaagggaccagtgacagtaacacgggctcagagagcaacagcgccacagtggaggagccgcccacagacccagtgccagaagacgagaagaaggagtaaatgttgccttgttttatgtgacctaaaacttttttaaatgaaaaaaaaatgtggttttttttttggttttaatggtgttatgtggtctgtgtattaattatttacttttccgttgatacaacatgaaggtctttgaaccctcagcatcatagcctaatgccagccgctcacctttcttagctctcaacgtctgaaacctcagagctgagattaatcaagacacccatcattctctgagaactaccttggctgctgcagaatcgactcttccaaatacctgccttcagctcacgtggtgctcaccaaagccatagctttaaacccttccagcccatccacagctttcccagtccctgtcttgtgtacttacacagagtgccctcttgaaatcatgagggggtctcttcactcaccctttctatgtcccatgtcagacaccaggagttctcttacagggtagggtgtagccagaaactggtgagacacagatcacagagatgcctctgggggcactgggggtgggggagcagggggagtacagttgttctttctgtggattccttgttggtgagagctgcgcctgcttatctagagtgctgttcagtgtagtcgatctgggatgtgttctgggaaattcatcctttttgtacaggggaaagaaacacttttttttaccagattggctttccaaagacacgatagatggcagagcttaaggaatggaatgttcttataatggactacagacttcaaagtgattggcccattccaaaaggaaaatgggaatgctgttcatccatgtgagcatacttcacagtgatgaaaacctcaagactcgagatcccatagatcagagccgaacctacttttttgataacccctgtagtggtcttagagactagaaacaagatagtttgtagtgtgtgctccctaaaatctagaatagatttttactgaatagtggtatatatgatggtatatgtttcttaaaggtccaaacataataaagaaattaagacaaaaaaaaaaaaaaaaaaaaaaaaaaaaaaaaaaaaaaaaaaaaa

SEQ ID NO: 95 - protein, 411 aa, Mus musculus
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSMAPEEEQVANKAEEKKDEESIPMETEETHLEDTAESQQNGEEGTSTPEDKESGQEGVDSMEVEGTSDSNTGSESNSATVEEPPTDPVPEDEKKE

SEQ ID NO: 96 - DNA, 2348 bp, Homo sapiens
gtgctcccgccccccgggaatgaatggatgggcggcctcagcgcccgcccgaccgctgggaggaccgacccggcggggacctgctgggggcaggacccggggagcaagatggccactgtcatccctggccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccacgaaaaaaaaaaaaaaaaaaaa

SEQ ID NO: 97 - protein, 414 aa, Homo sapiens
MGGLSARPTAGRTDPAGTCWGQDPGSKMATVIPGPLSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 98 - DNA, 2246 bp, Homo sapiens
gtgctcccgccccccgggaatgaatggatgggcggcctcagcgcccgcccgaccgctgggaggaccgacccggcggggacctgctgggggcaggacccggggagcaagatggccactgtcatccctggccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgataagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacggtgccagctgggcgggtctcaccccccaggaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccacgaaaaaaaaaaaaaaaaaaaa

SEQ ID NO: 99 - protein, 380 aa, Homo sapiens
MGGLSARPTAGRTDPAGTCWGQDPGSKMATVIPGPLSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDKFYKELAWVPEAQRKHTAKKAPDGTVIPNGYCDFCLGGSKKTGCPEDLISCADCGRSGHPSCLQFTVNMTAAVRTYRWQCIECKSCSLCGTSENDGASWAGLTPQDQLLFCDDCDRGYHMYCLSPPMAEPPEGSWSCHLCLRHLKEKASAYITLT

SEQ ID NO: 100 - DNA, 2362 bp, Homo sapiens
cgcagccccaagaatgaatgaaatcgtagcgcgctgggcggcagagcgggcggcgcaggccgggctgggcccgcgcgcggcggcagcggcgccccgggccggaggcggcccagccgagcgggccatggccaccgccattcagaacccgctcaagtcgcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccacgaaaaaaaaaaaaaaaaaaaa

SEQ ID NO: 101 - protein, 332 aa, Homo sapiens
MEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 102 - DNA, 2378 bp, Homo sapiens
gtgctcccgccccccgggaatgaatggatgggcggcctcagcgcccgcccgaccgctgggaggaccgacccggcggggacctgctgggggcaggacccggggagcaagatggccactgtcatccctggccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacggtgccagctgggcgggtctcaccccccaggaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccacgaaaaaaaaaaaaaaaaaaaa

SEQ ID NO: 103 - protein, 424 aa, Homo sapiens
MGGLSARPTAGRTDPAGTCWGQDPGSKMATVIPGPLSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDGASWAGLTPQDQLLFCDDCDRGYHMYCLSPPMAEPPEGSWSCHLCLRHLKEKASAYITLT

SEQ ID NO: 104 - DNA, 2329 bp, Homo sapiens
gaaatcgtagcgcgctgggcggcagagcgggcggcgcaggccgggctgggcccgcgcgcggcggcagcggcgccccgggccggaggcggcccagccgagcgggccatggccaccgccattcagaacccgctcaagtccctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccacga

SEQ ID NO: 105 - protein, 388 aa, Homo sapiens
MATAIQNPLKSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDICGKRYKNRPGLSYHYTHTHLAEEEGEENAERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 106 - DNA, 2278 bp, Mus musculus
gcaggccgggctgggcccgcgctcagcggcagcagcagcggcgccccgggccggaggcggcccagccgagcgggccatggccaccgccattcagaacccgctcaagtcccttggcgaggacttctaccgggaggccatcgagcactgtcgcagctacaacgcgcgcctgtgtgccgagcgcagcctgcgcctgcctttcctcgactcgcagaccggagtggcccagaacaactgctacatctggatggagaagacccaccgcgggcctggtttggccccgggacagatctacacttaccccgcccgctgttggaggaagaaacggagactcaacatcctggaggaccccaggctccggccctgcgagtacaagatcgattgtgaggcacctctgaagaaggagggtggcctcccggaagggccagtcctcgaggctctgctgtgtgctgagactggagagaagaaagtggagctgaaggaggaggagaccatcatggactgtcagaaacagcagttgctggagtttccgcatgatctcgaggtagaagacttggaggaagacattcccaggaggaagaacagggcaagaggaaaggcatatggcattggaggtctccgcaaacgccaggacaccgcatccctggaggaccgagacaagccgtacgtctgtgatatctgtgggaagagatataagaaccggccaggactcagctaccattacacccacacccacctggctgaggaggagggggaggagcacactgaacgccacgccctgcctttccaccggaaaaacaaccataaacagttttacaaagaattggcctgggtccccgaggcacagaggaaacacacagccaagaaagcaccagatggcactgtcatccccaatggctactgtgacttttgcctggggggctccaagaagactgggtgtcccgaggacctcatctcctgtgcggactgtgggcgatcaggacatccctcgtgtttacagttcacggtgaacatgaccgcggctgtgcggacctaccgctggcagtgcattgaatgcaagtcctgcagcctgtgtggcacctcggagaatgacgaccagctgctgttctgtgatgactgcgatcgaggttaccacatgtactgcctgagccctcccatggcggagcccccggaagggagctggagctgccacctctgtctccggcacttgaaggaaaaggcctctgcttacatcaccctgacctaggcccggctctgcttccccaggatctttgggtggtgctatctcctgcctcttggagctcctggcgctccccacccggtgtccccagtggaagggatggggtgaagcccagagtgggggggggcaaggtgttctccctctgcaagtggaatgttaccctgtgggtggctgggtccaacagggtccctcctgtcccccctcttcatcccttgacaaatgggcaccaggcttctgctctcctcaaagccatacccccgcctttgggcgggcatagaggggtagtggatgctagccagcagcacggaaagagcctttttctaaagaaaaagacaaaacgtggaaaaaaaagggaaaaaaattaatatatacaaagagtcctataaagcctggctgggtggagaggcactgttgagtgtctgctggggacctgactttaccagtttcctgaatggcgcctccccacctcatttctggagttgcaatggtctcaactcccatctgaggtgggtaccaccccttcctcagtacccaccgtggatactgcatgtgaactatggttttgaactcttcctcctcctccttgagagccccgccctgcgcccgcgtggtgcctgcctgccaggcctggggcgtgcagccggggaggcgggtggggtgaggcaggcaggcagccagccccctgcagtgagaagcacagattgcaatggactcagttttttttttttttttttttttttttcctttctcccttcccacccctttccttccctacccagccaggctgggctgcctcctgcccccctcgctagccatttgggggtggcaagggggtgtggttgtttctcgtggttgtgtgtgtttgttgttcgggtttttaaaaggggaaattgagactgcaagtgggggaggtggagggtctgggggagtctgcccccaatccaggagtaccccccttgccaccaagtctcctttattgcctgcctctgctgtgaattaacttgttctgtgtattaaactgggcctgacccctctgcccac

SEQ ID NO: 107 - protein, 388 aa, Mus musculus
MATAIQNPLKSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKVELKEEETIMDCQKQQLLEFPHDLEVEDLEEDIPRRKNRARGKAYGIGGLRKRQDTASLEDRDKPYVCDICGKRYKNRPGLSYHYTHTHLAEEEGEEHTERHALPFHRKNNHKQFYKELAWVPEAQRKHTAKKAPDGTVIPNGYCDFCLGGSKKTGCPEDLISCADCGRSGHPSCLQFTVNMTAAVRTYRWQCIECKSCSLCGTSENDDQLLFCDDCDRGYHMYCLSPPMAEPPEGSWSCHLCLRHLKEKASAYITLT

SEQ ID NO: 108 - DNA, 2545 bp, Homo sapiens
agtgctcgctctagtgcgcgcgcccggacggcgcctgcgcagagggcaaggaacctggtaccccggtgcggtcccggcgcctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttttttttctttctttagttcctgtattctaaacattagtaaaaataaatgtttttacacagaaaaaaaaaaaaaaaa

SEQ ID NO: 109 - protein, 391 aa, Homo sapiens
MAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDICGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGSWSCHLCLDLLKEKASIYQNQNSS

SEQ ID NO: 110 - DNA, 3897 bp, Homo sapiens
agtgctcgctctagtgcgcgcgcccggacggcgcctgcgcagagggcaaggaacctggtaccccggtgcggtcccggcgcctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacaatagtttcaaacaaaagcatacctcgaaagcgccccagagagtttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttttttttctttctttagttcctgtattctaaacattagtaaaaataaatgtttttacacagagccctctgctggatggtttatctcctgcctttctccattaagaaggccatttcatcctaagatttccatgatggtggtttttttttttaatgttttgaaatacagcttttttccccccaaattaaaatttttttgtggaaccccaatatgtaaagcgaatataaaattggttattttgttttgttacataaattcaagtttataacaattctttgttataaagaacaatgaagctgttttgatcaatacaaaatttgggttaaaatcaactttaacatctatttttatgtttcagttgatttggagaattctcctagtcttggatacatagatggaagtgatgacaggtttataacagttgaccttgcaatctcagacatttaaaacaggaccagaagtttatataaatataattaataagcaaactaatgacatcaccatgggacacacacaaaagttcttgcaggagcagggtctgtgtggcttcagttgcctgcagcgctcccaggccagagcaagtgctctaggatctgaactgcccgcagtgcagccctgcagcctttcccagggcacgttgatgtgcacacagtttccctgaaggcaaagtgaacatgtggagagcttacgtggcagcgcgtatgtcttcagtgtgtgttttagaagtccaactgttgtttttatgtttttaaaggaaagatttgaatcaagcagttatgggccccctgaagtatccttttttctagaacattctgaaagtcatccttgcctatgggaagcctaggccggcctgcactgttatgttcaataaataagcagggtgctctgggctggggattgtgtgaggagcagagcgcagcccgtcctcatgcttttccactgaagtaggccaggcagagagggagtacagcaatggatgcgctttggcagctgagtagtccgagagccagaaaagaaatgtggaaaataagaacgctgtagcaggcctaggtgaggaaatttaggaagggtttgcgggaggtaggatttgagatgggtcttggagagttggacagtgtcagccggtaggacgggggtgcggacggaagcctgtgaggaaggcagaggatgcggagctgtgagcggagggagcagcgaggctggagagcagctgggctgcgggtcaagacgtctgcgtttaattcgggactgaaggttagcagggaagggaacgatgccagatcttgagtttaagaacttgaatcttgtaaagtaccaaatctaataaaatactcgtcctaaataaaaaaaaaaaaaaaaaaaaaaaaaaaaaaaaaaaaaaaaaaaaa

SEQ ID NO: 111 - protein, 405 aa, Homo sapiens
MAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDNSFKQKHTSKAPQRVCGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGSWSCHLCLDLLKEKASIYQNQNSS

SEQ ID NO: 112 - DNA, 3356 bp, Mus musculus
cctgcgcagagggtcgaggaccctgtgtcctgagaaggcttagcgcctgcgcgttgtaggtttcggggcctcccggcctgagggagaggaacagggaagatggcggctgtggtggagaatgtagtgaagctccttggcgagcaatactacaaagatgccatggaacagtgccacaattataacgcccgcctctgtgctgaacgtagtgtgcgcctgcctttcctggactcacagactggagtagcccagagcaattgttatatctggatggaaaagcgacaccggggaccaggattggcctctggacagttatactcctatcctgccagacgctggcggaaaaagcgccgagcccacccacctgaggatcccaggctttctttcccatcgattaaaccagacactgaccagactctgaagaaagaggggcttatctctcaggatggcagcagtttagaggctctgttgcgtactgatcccctggagaaacggggtgccccagatccccgagttgacgatgacagcctgggcgagtttcctgttagcaacagtcgagcacggaagcggatcattgaacccgatgacttccttgatgaccttgatgatgaggactatgaagaagatacgccaaagcgtcgggggaaggggaagtccaagagtaagggtgtgagcagtgcccggaagaagctggatgcttccatcctggaggaccgggataagccctatgcctgtgacaatagtttcaaacaaaagcatacctcgaaagcgccccagagagtttgtggaaaacgttacaagaaccgacctggcctcagttaccactatgcccactcccacctggctgaagaggaaggagaggacaaagaagactcccgaccccccactcctgtgtcccagaggtctgaggagcagaaatccaagaaaggacctgatggattggccctgcctaacaactactgtgacttctgcctaggagactcaaaaatcaacaagaagacagggcagcccgaggagctagtgtcctgttccgactgtggccgctcagggcatccgtcctgcctgcagttcacccctgtgatgatggcggccgtgaagacctaccgctggcagtgcatcgaatgcaagtgctgcaacctctgcggcacgtcggagaacgatgaccagctacttttctgtgatgactgtgaccgtggctaccacatgtactgtctcactccttccatgtctgagcctcctgaaggaagttggagttgccacctgtgtctggatctgctgaaggagaaagcatccatctaccagaaccagaactcctcctgatgtgccacccagctcccctgcatctaaggccgttgctctcctctctaccttggtttccattgcccctctctcctctttcactctgtagtcctgccaacctccgttggcaacagcacagggaggtggcagctctgactgcctctagccccgagccctcagggagtaaggagcagcgtgctgctccagggctgacctgtgggtccaacttctctctgctctccaagaagtgcattcactctgcctgccttgggcctaagaccctggtgattacagggctcaaatggggtcctctgagaaggaatatgagagcagctcacttgtctcaagccttgcccacccctcttcccccaaaccccctttggtttccagggttttgccccagagatgagccaggctgggcctttcctggaagcagctggagtgagctggctgagtggcacttgccaggaccttttcataccctagttctgcttccctttgcctcctgccaaagcagtcccctgtcctctgtcatgctacatggggttctgtgcttgagctagaatgttctcgggcacctcctggctctgccctgtcccacaaagggacgagcagcttcaaacctgtcctccctgtgcttggtggcttgctcacaggtgcgctctggctacccagacatttcctatcctcagaacttcccatcttctgcccccatccttagtccctttgcttttgtagggagagggatagtgtcaggggctgggccagcagcttgggggccacagggagaagttggataatgtgcctgttttttaactcgataaaaaagcctacctccaaaattccctttttgttcttcctgaacctgggcattcagcctcctgtccttaactaaattaggagcctctgcctcctgcctgtgtatcctggctcccaggacacaggatggtcccctttccttgcacgctagctagtagctggtaaggtcttcacaccctgagttttctgtttcctgcttagtggcactgacattaagtaggaggggacagtcctctgcagtactctagagagtgggcttcccccttggctgtgggcaggccctaactgttttctgcaaagttgagggccccccctcgcatatttagttcctgtattcaaaacattagtaaaaataaacatttttacagagtcttctgctggacagtttgtctcttgactccttgttgaaaggttgtttcatttcaaacttacgacaatagggttttttgttggtggtggttggttgttttaaattgaaacaactttttctcccaaaatcaaagtttttgttaaactccaccatgtaaaattattttgttagttttgttatgtaaattcagatttataacaatttagtggtataaaggatgaagctaattaatacaaaaattgggttaaaatcaactttagcattttctctgtatctgtgcttttggctggttggaaagactttactcggtgtgaatatgtaggcggaggtgcggcagatctatggcactgcagtgtctcctggttaaagtgaacccagaagcttgtttgtgctttaaactccaaggagttatgagttaagcctggagagagagcgcagcagaggagaggatgctcgttgttcttgcagagggccaagtttggttcccagcactcaaatccggtggctcacaaccacctgtagctccagctccaggagctggggaggtcaactgtgctcctgcaaacacccacctgcccactcatcttcatccatctacaaacctaccagtgtcatcgtagaacaaaagaagccgagaggagagtaacctcagatcctgtcatctgatgaaccttttcattgcctgtcggattgctaagccaaagcagagttgcaaagccagaattgtccacagtgcagggtgtcatgtgcagaccgtgagtgagtttatatccagccagattagtacttggatgttatatagtggatcttgtatagctcacttggtatgtattaacattttaacttttttcttttaaagatttatttattt

SEQ ID NO: 113 - protein, 405 aa, Mus musculus
MAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVSNSRARKRIIEPDDFLDDLDDEDYEEDTPKRRGKGKSKSKGVSSARKKLDASILEDRDKPYACDNSFKQKHTSKAPQRVCGKRYKNRPGLSYHYAHSHLAEEEGEDKEDSRPPTPVSQRSEEQKSKKGPDGLALPNNYCDFCLGDSKINKKTGQPEELVSCSDCGRSGHPSCLQFTPVMMAAVKTYRWQCIECKCCNLCGTSENDDQLLFCDDCDRGYHMYCLTPSMSEPPEGSWSCHLCLDLLKEKASIYQNQNSS

SEQ ID NO: 114 - DNA, 3314 bp, Mus musculus
cctgcgcagagggtcgaggaccctgtgtcctgagaaggcttagcgcctgcgcgttgtaggtttcggggcctcccggcctgagggagaggaacagggaagatggcggctgtggtggagaatgtagtgaagctccttggcgagcaatactacaaagatgccatggaacagtgccacaattataacgcccgcctctgtgctgaacgtagtgtgcgcctgcctttcctggactcacagactggagtagcccagagcaattgttatatctggatggaaaagcgacaccggggaccaggattggcctctggacagttatactcctatcctgccagacgctggcggaaaaagcgccgagcccacccacctgaggatcccaggctttctttcccatcgattaaaccagacactgaccagactctgaagaaagaggggcttatctctcaggatggcagcagtttagaggctctgttgcgtactgatcccctggagaaacggggtgccccagatccccgagttgacgatgacagcctgggcgagtttcctgttagcaacagtcgagcacggaagcggatcattgaacccgatgacttccttgatgaccttgatgatgaggactatgaagaagatacgccaaagcgtcgggggaaggggaagtccaagagtaagggtgtgagcagtgcccggaagaagctggatgcttccatcctggaggaccgggataagccctatgcctgtgacatttgtggaaaacgttacaagaaccgacctggcctcagttaccactatgcccactcccacctggctgaagaggaaggagaggacaaagaagactcccgaccccccactcctgtgtcccagaggtctgaggagcagaaatccaagaaaggacctgatggattggccctgcctaacaactactgtgacttctgcctaggagactcaaaaatcaacaagaagacagggcagcccgaggagctagtgtcctgttccgactgtggccgctcagggcatccgtcctgcctgcagttcacccctgtgatgatggcggccgtgaagacctaccgctggcagtgcatcgaatgcaagtgctgcaacctctgcggcacgtcggagaacgatgaccagctacttttctgtgatgactgtgaccgtggctaccacatgtactgtctcactccttccatgtctgagcctcctgaaggaagttggagttgccacctgtgtctggatctgctgaaggagaaagcatccatctaccagaaccagaactcctcctgatgtgccacccagctcccctgcatctaaggccgttgctctcctctctaccttggtttccattgcccctctctcctctttcactctgtagtcctgccaacctccgttggcaacagcacagggaggtggcagctctgactgcctctagccccgagccctcagggagtaaggagcagcgtgctgctccagggctgacctgtgggtccaacttctctctgctctccaagaagtgcattcactctgcctgccttgggcctaagaccctggtgattacagggctcaaatggggtcctctgagaaggaatatgagagcagctcacttgtctcaagccttgcccacccctcttcccccaaaccccctttggtttccagggttttgccccagagatgagccaggctgggcctttcctggaagcagctggagtgagctggctgagtggcacttgccaggaccttttcataccctagttctgcttccctttgcctcctgccaaagcagtcccctgtcctctgtcatgctacatggggttctgtgcttgagctagaatgttctcgggcacctcctggctctgccctgtcccacaaagggacgagcagcttcaaacctgtcctccctgtgcttggtggcttgctcacaggtgcgctctggctacccagacatttcctatcctcagaacttcccatcttctgcccccatccttagtccctttgcttttgtagggagagggatagtgtcaggggctgggccagcagcttgggggccacagggagaagttggataatgtgcctgttttttaactcgataaaaaagcctacctccaaaattccctttttgttcttcctgaacctgggcattcagcctcctgtccttaactaaattaggagcctctgcctcctgcctgtgtatcctggctcccaggacacaggatggtcccctttccttgcacgctagctagtagctggtaaggtcttcacaccctgagttttctgtttcctgcttagtggcactgacattaagtaggaggggacagtcctctgcagtactctagagagtgggcttcccccttggctgtgggcaggccctaactgttttctgcaaagttgagggccccccctcgcatatttagttcctgtattcaaaacattagtaaaaataaacatttttacagagtcttctgctggacagtttgtctcttgactccttgttgaaaggttgtttcatttcaaacttacgacaatagggttttttgttggtggtggttggttgttttaaattgaaacaactttttctcccaaaatcaaagtttttgttaaactccaccatgtaaaattattttgttagttttgttatgtaaattcagatttataacaatttagtggtataaaggatgaagctaattaatacaaaaattgggttaaaatcaactttagcattttctctgtatctgtgcttttggctggttggaaagactttactcggtgtgaatatgtaggcggaggtgcggcagatctatggcactgcagtgtctcctggttaaagtgaacccagaagcttgtttgtgctttaaactccaaggagttatgagttaagcctggagagagagcgcagcagaggagaggatgctcgttgttcttgcagagggccaagtttggttcccagcactcaaatccggtggctcacaaccacctgtagctccagctccaggagctggggaggtcaactgtgctcctgcaaacacccacctgcccactcatcttcatccatctacaaacctaccagtgtcatcgtagaacaaaagaagccgagaggagagtaacctcagatcctgtcatctgatgaaccttttcattgcctgtcggattgctaagccaaagcagagttgcaaagccagaattgtccacagtgcagggtgtcatgtgcagaccgtgagtgagtttatatccagccagattagtacttggatgttatatagtggatcttgtatagctcacttggtatgtattaacattttaacttttttcttttaaagatttatttattt

SEQ ID NO: 115 - protein, 391 aa, Mus musculus
MAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVSNSRARKRIIEPDDFLDDLDDEDYEEDTPKRRGKGKSKSKGVSSARKKLDASILEDRDKPYACDICGKRYKNRPGLSYHYAHSHLAEEEGEDKEDSRPPTPVSQRSEEQKSKKGPDGLALPNNYCDFCLGDSKINKKTGQPEELVSCSDCGRSGHPSCLQFTPVMMAAVKTYRWQCIECKCCNLCGTSENDDQLLFCDDCDRGYHMYCLTPSMSEPPEGSWSCHLCLDLLKEKASIYQNQNSS

SEQ ID NO: 116 - DNA, 4077 bp, Homo sapiens
agacaatattctgttacattgtagcaaaatggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagcaaaaaaaaaaaaaaaaaaaaagcaaaaataaaagcatcagctgaggtgatattagttcagtcacctaacaactcctagaagagatgaggaaagggaaccttctgctgagctggcttctggggcctgagcttccagagctgtccccaagggctaggaaggccgacctgaaggatgagaacctcaaattcagttgctggtgggagccaaggaagacggcgggtgttctaacatggccctttctggctgagctggcggaagtgggcgttttggccgatgggatgtatctcggcgctgtgtctgtggcccagcaaaggtgcagggctgactggctgagccactgggttctacccgcaggctccccactgcactgggctttcacacagccatgctcttgggtttccctcccttgtaagcagagtcataataacacacgaatagtctaaggctgggtattctggtcagcagaggtccttgagtcacagtgttactgaaatggttctgagcctgagaatctctttggcctctgaaagggcagggcaggtgggcaccgacttcctgccagtcctttcaggtttcctgttcaaagccagtcctgttggtggaggggatcaccgagagtgtctgtatcattttgtagcccttttctctgacgttttctggtagaaaatgtcccttgtcaaaatgctaataattatcataataatctgctttccaaccaactcccacaagtgacaacctgtgtagaactgtgataaaggtttgcataatgtagggtttgtaccaagtgtgtgtaagtttctgttaaataaaaagtctgtttccaatgctcctat

SEQ ID NO: 117 - protein, 357 aa, Homo sapiens
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 118 - DNA, 1166 bp, Homo sapiens
agacaatattctgttacattgtagcaaaatggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctggtcacccaacctgcctgcagtttaccctgaacatgaccgaggctgtcaagacctacaagtggcagtgcatagagtgcaaatcctgtatcctctgtgggacctcagagaatgatgaccagctactcttctgcgatgactgtgaccgaggctatcacatgtactgtttaaatcccccggtggctgagcccccagaaggaagctggagctgccacttatgctgggaactgctcaaagagaaagcctcagcctttggctgccaggcctagg

SEQ ID NO: 119 - protein, 378 aa, Homo sapiens
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSGHPTCLQFTLNMTEAVKTYKWQCIECKSCILCGTSENDDQLLFCDDCDRGYHMYCLNPPVAEPPEGSWSCHLCWELLKEKASAFGCQA

SEQ ID NO: 120 - DNA, 4221 bp, Homo sapiens
agacaatattctgttacattgtagcaaaatggcgactgtcattcacaaccccctgaaagcgccctttcaagaatcctatgaaagttgtggatcatctccccggaaaacacgcatatagatgtgaacatctgcctatggttttatggggttcacagacctggaagagcccatctctggatgccctggaggcccatgggctctagggctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagcaaaaaaaaaaaaaaaaaaaaagcaaaaataaaagcatcagctgaggtgatattagttcagtcacctaacaactcctagaagagatgaggaaagggaaccttctgctgagctggcttctggggcctgagcttccagagctgtccccaagggctaggaaggccgacctgaaggatgagaacctcaaattcagttgctggtgggagccaaggaagacggcgggtgttctaacatggccctttctggctgagctggcggaagtgggcgttttggccgatgggatgtatctcggcgctgtgtctgtggcccagcaaaggtgcagggctgactggctgagccactgggttctacccgcaggctccccactgcactgggctttcacacagccatgctcttgggtttccctcccttgtaagcagagtcataataacacacgaatagtctaaggctgggtattctggtcagcagaggtccttgagtcacagtgttactgaaatggttctgagcctgagaatctctttggcctctgaaagggcagggcaggtgggcaccgacttcctgccagtcctttcaggtttcctgttcaaagccagtcctgttggtggaggggatcaccgagagtgtctgtatcattttgtagcccttttctctgacgttttctggtagaaaatgtcccttgtcaaaatgctaataattatcataataatctgctttccaaccaactcccacaagtgacaacctgtgtagaactgtgataaaggtttgcataatgtagggtttgtaccaagtgtgtgtaagtttctgttaaataaaaagtctgtttccaatgctcctat

SEQ ID NO: 121 - protein, 367 aa, Homo sapiens
MGFTDLEEPISGCPGGPWALGLGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 122 - skipped

SEQ ID NO: 123 - DNA, 4520 bp, Homo sapiens
attctcgtcttcacccctggccactcctggagttgaaaaccaggttcgctcccggggacggtagggggttcctaacgcaaaggaatgcacagggagaatcggacgtgtttgcgccagctcgtcgcccatcagaaatagggaaaggggtaggaaggccccaggtttcaaatatatttatatgaaagctgccgttaagaggacgttggaagctgaggctgatcagataggagctcctggcttcagttctggctcggaagctcggatacactgcgcttgaacgccacagcgtttcacccaagaaagaaaatgttttatggcagaataaatgggcgtaacttcgccgcatcctcgctgccggttgctttcgctgcaacaccgctgatgctgtttctaccgaacccacaactgattttcagtttccccatttccagccgaaatcacataaccgggctgatgccacctggtaaactcaagttagagaacctatttcacatgtgcaccaggctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagcaaaaaaaaaaaaaaaaaaaaagcaaaaataaaagcatcagctgaggtgatattagttcagtcacctaacaactcctagaagagatgaggaaagggaaccttctgctgagctggcttctggggcctgagcttccagagctgtccccaagggctaggaaggccgacctgaaggatgagaacctcaaattcagttgctggtgggagccaaggaagacggcgggtgttctaacatggccctttctggctgagctggcggaagtgggcgttttggccgatgggatgtatctcggcgctgtgtctgtggcccagcaaaggtgcagggctgactggctgagccactgggttctacccgcaggctccccactgcactgggctttcacacagccatgctcttgggtttccctcccttgtaagcagagtcataataacacacgaatagtctaaggctgggtattctggtcagcagaggtccttgagtcacagtgttactgaaatggttctgagcctgagaatctctttggcctctgaaagggcagggcaggtgggcaccgacttcctgccagtcctttcaggtttcctgttcaaagccagtcctgttggtggaggggatcaccgagagtgtctgtatcattttgtagcccttttctctgacgttttctggtagaaaatgtcccttgtcaaaatgctaataattatcataataatctgctttccaaccaactcccacaagtgacaacctgtgtagaactgtgataaaggtttgcataatgtagggtttgtaccaagtgtgtgtaagtttctgttaaataaaaagtctgtttccaatgctcctat

SEQ ID NO: 124 - protein, 412 aa, Homo sapiens
MFYGRINGRNFAASSLPVAFAATPLMLFLPNPQLIFSFPISSRNHITGLMPPGKLKLENLFHMCTRLGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFHGFDEDDLEEPRSCRGRRSGRGSPTADKKGSC

SEQ ID NO: 125 - DNA, 3155 bp, Mus musculus
agacaatattctgttacattgtagcaaaatggcgactgtcattcacaaccccctgaaagcgcttggggaccagttctacaaggaagccattgagcactgccggagctacaactcgaggctgtgcgcagagcggagcgtgcgtctccccttcctggactcgcagactggggtggctcagaacaactgctacatctggatggagaagaggcaccgcggcccaggcctcgctccgggccagttgtacacataccctgcccgctgctggcgcaagaagcgacgattgcacccaccagaggacccaaaactacgactcctggaaatcaaacccgaagtagaactgcccctgaagaaagatggatttacctctgagagtaccacactggaagccttgcttcgcggcgagggagtagagaagaaggtggatgccagagaagaggaaagcatccaggagatacagagggttttggaaaatgatgaaaacgtagaagaagggaatgaagaggaggatttggaagaagatgttcccaagcgcaagaacaggaccagaggacgggctcgcggctctgcaggcggaaggaggaggcatgatgccgcctctcaggaagaccacgacaaaccctacgtctgcgacatctgtggcaagcgctacaagaaccggccaggactcagctaccactacgctcatactcacctggccagcgaggagggagacgaagcccaagaccaggagacccgatccccacccaaccacagaaatgagaaccacagaccccagaaaggaccagacgggacagtcattcctaataactactgtgacttctgcttggggggctccaacatgaacaagaagagtgggaggcctgaagagctggtgtcctgtgcagactgtggacgctctggtcatccaacttgcctgcagttcactctgaacatgactgaggcagttaagacctacaagtggcagtgcatagagtgtaaatcctgtatcctgtgtgggacctcggagaacgacgaccagctactcttctgtgatgactgcgatcgtggctatcacatgtactgtttaaatcccccagtggctgagcccccagaaggaagctggagctgccatttatgctgggagctgctcaaagagaaagcatcagcctttggctgccaggcctagggctccacccaggtcacagagtgcagcccaccactagagaggctgaactgaagccctgttcaacccagatggaggtctcctcctgtatatgcacacagaccaactacaaggaaaacgaatagttacagaagggaacggagggagcaaggtctccactcacttctcgccctacccatgacctcccaccccacacatccttcagccagctcttcctcatttctaccagcgggaacttggcacttttgaagaataatccagccccggctctgtggaaacttcctcatgttcactgtcacaggcatctctctttgttgcttcttgttttggaggaagccattttgtgactgctcatcaaccactcgtgtgttgcttggtggggttcttgttttgttgtctattgtgtttcaagaacttgtcacagagtgtcctcacccttagcttaggctcttcatcctgaaactcacagaggaacaaaatgccgtggtggggaagctcctgcctattacgagtctcactggaagcatccatgtttggaggccatcttgaagacagaacttggaaaatgtcttggttttcttagtctctgctgagaagagaagttgtagcatttgagccttggcagtagcatccccagctgcgatgaccttgatccactgcactgccatttgatcaggggttcagagggcctgggagatgggaggaacacttggggccctgctatagccagccagtatttgctgttcctcaggagggactaggtggttccttgaccttcagaactgtggtgtccttgaggtgagacaacacagtctctaaacacagaaaagtgctgaagatcctgcccccaaccgaattgaccgtgaaggtctggctcagtctctggggggtgggactcaagctctggagaggtgggcaaaggatgcccattcaacagtccagggttggttagaagagactgtatgtagctttgagaaactctcccagtattgatgctacactatggatttcttttctgggcaatttcttccttccatgtagtatatgtttgccaatgaccactgagatgtgactggaaattttagaatggtgaagagatgaacattacttaaccagatcattgggcacagtgattacttgtgactgggtggcaatgattcagagcccttgtccgttcttgcaccctaagctcccccatatggaatgggctctcgtttgaagcaaggtttctagaagatgtaggaaggtctagattctgagaactcttgtgtgtcagaagagaagccttgagggctggagtgggctgggctgcctttgacgcacggcaccagcatgataactgacacatttctggaaaaatcgtttgcccaaagggcaggtctccgtgagcaggaccctcgcgcatgctcggcttccctggattcagctccatcgctgtggtccagcagcttgcaacaaaggcctgggttatttttagtcgtcagctcctgaagaagcccctggagacctgggctggctgggcccctctgcccagcggcagcatggcctctgccactccacaggagtcatcctccccctggctaattgctcttggcacgtggacccagggcagcctggcatggaaccaagcagtgtgaccccccctgcaacttctttgcagagtgacctgtggcaagagagtgggggtcactttcctgcaggccctgtggcctcagagctagttccatgcatacgaaatgatctcatttaaagggcccctgtccagagagcatctgtctcctcctctcaagctctcttcttcctcctgctggttgctgtgcctgtgtggattcaaaagacccaagggagggctggaggaatggcccgtctccacggaggggtacattccctctccagactctgcgggctctctcgttccacaaaacccaaagcagagtatcttcagagactaactacttgtttgggggatcatattaaattaatttcagaaggg

SEQ ID NO: 126 - protein, 378 aa, Mus musculus
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDVPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSGHPTCLQFTLNMTEAVKTYKWQCIECKSCILCGTSENDDQLLFCDDCDRGYHMYCLNPPVAEPPEGSWSCHLCWELLKEKASAFGCQA

SEQ ID NO: 127 - DNA, 1532 bp, Mus musculus
agacaatattctgttacattgtagcaaaatggcgactgtcattcacaaccccctgaaagcgcttggggaccagttctacaaggaagccattgagcactgccggagctacaactcgaggctgtgcgcagagcggagcgtgcgtctccccttcctggactcgcagactggggtggctcagaacaactgctacatctggatggagaagaggcaccgcggcccaggcctcgctccgggccagttgtacacataccctgcccgctgctggcgcaagaagcgacgattgcacccaccagaggacccaaaactacgactcctggaaatcaaacccgaagtagaactgcccctgaagaaagatggatttacctctgagagtaccacactggaagccttgcttcgcggcgagggagtagagaagaaggtggatgccagagaagaggaaagcatccaggagatacagagggttttggaaaatgatgaaaacgtagaagaagggaatgaagaggaggatttggaagaagatgttcccaagcgcaagaacaggaccagaggacgggctcgcggctctgcaggcggaaggaggaggcatgatgccgcctctcaggaagaccacgacaaaccctacgtctgcgacatctgtggcaagcgctacaagaaccggccaggactcagctaccactacgctcatactcacctggccagcgaggagggagacgaagcccaagaccaggagacccgatccccacccaaccacagaaatgagaaccacagaccccagaaaggaccagacgggacagtcattcctaataactactgtgacttctgcttggggggctccaacatgaacaagaagagtgggaggcctgaagagctggtgtcctgtgcagactgtggacgctctgctcatttgggaggagaaggcaggaaggagaaggaggcagcggccgcagcacgtaccacggaggacttattcggttccacgtcagaaagtgacacctcaactttctacggctttgatgaggacgatttggaagagcctcgctcctgtcgaggacgccgcagtggccggggttcacccacagcagataaaaagggcagctgctgagcacatgggacagactgtgtggccaattagccacccctccccctgactctggtcattgttctagttctgatatatatttttaaatgaaagacaacttgggcatttcccttaatccttgccttttccttctgcctcccacgtgtccctccctctcctagcttccttctattttgggtacaacagaagcacacactactgagaaccagggaagagcaggatgagagtcctctggggagccatggcatcatggcgggctcttatggactcttatccctagaagtaggagaaattaagaggattttctgtcactgggggagggcatctttttgatgtgagcagagttgatttcctgttttcaagagaagaggaacatgaggtttgaaaacaaataacattaacaatatttatttataaaaaaaaaaaaaaaaaa

SEQ ID NO: 128 - protein, 357 aa, Mus musculus
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDVPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFYGFDEDDLEEPRSCRGRRSGRGSPTADKKGSC

SEQ ID NO: 129 - DNA, 1529 bp, Mus musculus
agacaatattctgttacattgtagcaaaatggcgactgtcattcacaaccccctgaaagcgcttggggaccagttctacaaggaagccattgagcactgccggagctacaactcgaggctgtgcgcagagcggagcgtgcgtctccccttcctggactcgcagactggggtggctcagaacaactgctacatctggatggagaagaggcaccgcggcccaggcctcgctccgggccagttgtacacataccctgcccgctgctggcgcaagaagcgacgattgcacccaccagaggacccaaaactacgactcctggaaatcaaacccgtagaactgcccctgaagaaagatggatttacctctgagagtaccacactggaagccttgcttcgcggcgagggagtagagaagaaggtggatgccagagaagaggaaagcatccaggagatacagagggttttggaaaatgatgaaaacgtagaagaagggaatgaagaggaggatttggaagaagatgttcccaagcgcaagaacaggaccagaggacgggctcgcggctctgcaggcggaaggaggaggcatgatgccgcctctcaggaagaccacgacaaaccctacgtctgcgacatctgtggcaagcgctacaagaaccggccaggactcagctaccactacgctcatactcacctggccagcgaggagggagacgaagcccaagaccaggagacccgatccccacccaaccacagaaatgagaaccacagaccccagaaaggaccagacgggacagtcattcctaataactactgtgacttctgcttggggggctccaacatgaacaagaagagtgggaggcctgaagagctggtgtcctgtgcagactgtggacgctctgctcatttgggaggagaaggcaggaaggagaaggaggcagcggccgcagcacgtaccacggaggacttattcggttccacgtcagaaagtgacacctcaactttctacggctttgatgaggacgatttggaagagcctcgctcctgtcgaggacgccgcagtggccggggttcacccacagcagataaaaagggcagctgctgagcacatgggacagactgtgtggccaattagccacccctccccctgactctggtcattgttctagttctgatatatatttttaaatgaaagacaacttgggcatttcccttaatccttgccttttccttctgcctcccacgtgtccctccctctcctagcttccttctattttgggtacaacagaagcacacactactgagaaccagggaagagcaggatgagagtcctctggggagccatggcatcatggcgggctcttatggactcttatccctagaagtaggagaaattaagaggattttctgtcactgggggagggcatctttttgatgtgagcagagttgatttcctgttttcaagagaagaggaacatgaggtttgaaaacaaataacattaacaatatttatttataaaaaaaaaaaaaaaaaa

SEQ ID NO: 130 - protein, 356 aa, Mus musculus
MATVIHNPLKALGDQFYKEAIEHCRSYNSRLCAERSVRLPFLDSQTGVAQNNCYIWMEKRHRGPGLAPGQLYTYPARCWRKKRRLHPPEDPKLRLLEIKPVELPLKKDGFTSESTTLEALLRGEGVEKKVDAREEESIQEIQRVLENDENVEEGNEEEDLEEDVPKRKNRTRGRARGSAGGRRRHDAASQEDHDKPYVCDICGKRYKNRPGLSYHYAHTHLASEEGDEAQDQETRSPPNHRNENHRPQKGPDGTVIPNNYCDFCLGGSNMNKKSGRPEELVSCADCGRSAHLGGEGRKEKEAAAAARTTEDLFGSTSESDTSTFYGFDEDDLEEPRSCRGRRSGRGSPTADKKGSC

SEQ ID NO: 131 - DNA, 1932 bp, Homo sapiens
agacttaggcctggaccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgacatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaataaaaaaaaaaaaaaaaaaaaaaaaaaaaaaaaaaa

SEQ ID NO: 132 - protein, 429 aa, Homo sapiens
MSGGVYGGDEVGALVFDIGSYTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 133 - DNA, 1788 bp, Homo sapiens
agacttaggcctggaccctagtgattggctgataggaggagccagcaagtgtggctgagctccggggtgtgtggacgccgctttgttgcctgagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgacatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaataaaaaaaaaaaaaaaaaaaaaaaaaaaaaaaaaaa

SEQ ID NO: 134 - DNA, 1980 bp, Homo sapiens
agacttaggcctggaccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggaggtgagtgagtgcggccggacgagagagcgcgccttttcggcgtgtgggatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgacatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaataaaaaaaaaaaaaaaaaaaaaaaaaaaaaaaaaaa

SEQ ID NO: 135 - protein, 387 aa, Homo sapiens
MVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 136 - DNA, 1969 bp, Mus musculus
cttcttctgtcgcttctccctctccctgcccctacggatgccttccattggctaagacggctaaaccgcgcggggatgcagcagcgccacactctgattggctaatgactaagccggaccctttgtcattggttgatacgagaaaccagcaagagtggctgtgcagcgggcgtgcggccgctgctttgttgccggagggggcggcgttggaagttgcaggcttgcggggccggcgttctcagggagaggagtcacgccgctgttatctttcgtccggtagtcttcggccagtccccgccagacagtagccatgagcggcggcgtgtacggcggagatgaagttggcgctcttgtttttgacattggatcgtacacagtgagggctggctatgctggcgaggactgccctaaggttgatttccccacggctatcggtgtggtgctggagagagatgacggaagtacaatgatggagattgatggtgacaaaggcaagcagggcgggcccacctactacatagacaccaatgccctccgcgtgcccagggagaacatggaggccatctcaccactcaagaatggcatggttgaagactgggatagtttccaggccattttggatcatacatacaagatgcatgtcaaatccgaagccagcctgcatcctgttctcatgtcggaagcaccgtggaacaccagggcgaagagagagaaactgacagagttgatgtttgagcactacagcatccctgcattcttcctttgcaaaactgcagttttgacggcatttgctaatggtcgttctactgggctgattttggacagtggagctacccacaccactgcgattccagtccacgatggctatgttcttcaacaaggcattgtgaaatcccctctggctggagacttcattaccatgcagtgcagagaactcttccaggaaatgaacatagaactcattcctccttacatgattgcatcaaaagaggctgttcgagaaggttctccagccaactggaaaagaaaagagaaactgccccaggttacaaggtcttggcacaattacatgtgcaactgcgtcatccaggattttcaagcttccgttcttcaggtgtcagactccacctacgacgaacaagtggctgcacagatgccaaccgtccactacgaattccccaatggctacaactgtgattttggggcagagcggctgaaaattcctgaagggttatttgacccttccaacgtaaagggactgtctgggaacacgatgctgggagtcagtcacgttgtcacaaccagcgtcggaatgtgtgacatcgacatcagaccaggtctctacggcagtgtgatcgtagcaggaggaaacacgctaatacagagtttcactgacaggttaaatagagagctttctcagaaaactccaccaagtatgcggttgaaactgattgcaaacaacacgacggtggagcggaggttcagctcatggattggtggctctatcctagcatctttgggtacctttcaacagatgtggatttctaaacaggaatatgaagaaggagggaagcagtgtgtagaaagaaaatgcccttgagggctccaccctgcctgcccgtcacctcaacgtctgtagctttagtacactcaggaaaagatgaccatcttttgtagaatgtttatacatgtttgcatatttcaatttccacttaaattttttaaggctttaactggctctataaattaaatgagtttgtgctttccttgaaatgcacttattcttattacaggcattttataattttgtatgaatgtctattttctctaaatattttgctttcagtaagtactctccagctctcctgggggttggttggtggaattactctgtattgacaagtacaagttactgcctatgctttgtaccttaggctacaaaactaaataaaaatcactactgtcctag

SEQ ID NO: 137 - protein, 429 aa, Mus musculus
MSGGVYGGDEVGALVFDIGSYTVRAGYAGEDCPKVDFPTAIGVVLERDDGSTMMEIDGDKGKQGGPTYYIDTNALRVPRENMEAISPLKNGMVEDWDSFQAILDHTYKMHVKSEASLHPVLMSEAPWNTRAKREKLTELMFEHYSIPAFFLCKTAVLTAFANGRSTGLILDSGATHTTAIPVHDGYVLQQGIVKSPLAGDFITMQCRELFQEMNIELIPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 138 - DNA, 1940 bp, Homo sapiens
gagtgagcggcgcggggccaatcagcgtgcgccgttccgaaagttgccttttatggctcgagcggccgcggcggcgccctataaaacccagcggcgcgacgcgccaccaccgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcgttgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatgaggaaaaaaaaaaaaaaaaaa

SEQ ID NO: 139 - protein, 375 aa, Homo sapiens
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 140 - DNA, 1935 bp, Mus musculus
tataaaacccggcggcgcaacgcgcagccactgtcgagtcgcgtccacccgcgagcacagcttctttgcagctccttcgttgccggtccacacccgccaccagttcgccatggatgacgatatcgctgcgctggtcgtcgacaacggctccggcatgtgcaaagccggcttcgcgggcgacgatgctccccgggctgtattcccctccatcgtgggccgccctaggcaccagggtgtgatggtgggaatgggtcagaaggactcctatgtgggtgacgaggcccagagcaagagaggtatcctgaccctgaagtaccccattgaacatggcattgttaccaactgggacgacatggagaagatctggcaccacaccttctacaatgagctgcgtgtggcccctgaggagcaccctgtgctgctcaccgaggcccccctgaaccctaaggccaaccgtgaaaagatgacccagatcatgtttgagaccttcaacaccccagccatgtacgtagccatccaggctgtgctgtccctgtatgcctctggtcgtaccacaggcattgtgatggactccggagacggggtcacccacactgtgcccatctacgagggctatgctctccctcacgccatcctgcgtctggacctggctggccgggacctgacagactacctcatgaagatcctgaccgagcgtggctacagcttcaccaccacagctgagagggaaatcgtgcgtgacatcaaagagaagctgtgctatgttgctctagacttcgagcaggagatggccactgccgcatcctcttcctccctggagaagagctatgagctgcctgacggccaggtcatcactattggcaacgagcggttccgatgccctgaggctcttttccagccttccttcttgggtatggaatcctgtggcatccatgaaactacattcaattccatcatgaagtgtgacgttgacatccgtaaagacctctatgccaacacagtgctgtctggtggtaccaccatgtacccaggcattgctgacaggatgcagaaggagattactgctctggctcctagcaccatgaagatcaagatcattgctcctcctgagcgcaagtactctgtgtggatcggtggctccatcctggcctcactgtccaccttccagcagatgtggatcagcaagcaggagtacgatgagtccggcccctccatcgtgcaccgcaagtgcttctaggcggactgttactgagctgcgttttacaccctttctttgacaaaacctaacttgcgcagaaaaaaaaaaaataagagacaacattggcatggctttgtttttttaaattttttttaaagtttttttttttttttttttttttttttttaagtttttttgttttgttttggcgcttttgactcaggatttaaaaactggaacggtgaaggcgacagcagttggttggagcaaacatcccccaaagttctacaaatgtggctgaggactttgtacattgttttgtttttttttttttttggttttgtctttttttaatagtcattccaagtatccatgaaataagtggttacaggaagtccctcaccctcccaaaagccacccccactcctaagaggaggatggtcgcgtccatgccctgagtccaccccggggaaggtgacagcattgcttctgtgtaaattatgtactgcaaaaatttttttaaatcttccgccttaatacttcatttttgtttttaatttctgaatggcccaggtctgaggcctcccttttttttgtccccccaacttgatgtatgaaggctttggtctccctgggagggggttgaggtgttgaggcagccagggctggcctgtacactgacttgagaccaataaaagtgcacaccttaccttacacaaacaaaaaaaaaaaaaaaa

SEQ ID NO: 141 - protein, 375 aa, Mus musculus; identical to SEQ ID NO: 139

SEQ ID NO: 142 - DNA, 3783 bp, Homo sapiens
actgggccaggcgcgcggcggccccgggctttgtgtgtgtgtgtatgtgtgtgtgtgtgtgtgtgtgtgtgtgagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatgggagaagaaatgggtgaccgttggtgacacatccctacgaatctacaaatgggtccctgtgacggagcccaaggttgatgacaaaaacaagaataagaaaaaaggcaaggacgagaagtgtggctcagaggtgaccactccggagaacagttcctccccagggatgatggacatgcatgacgataacagcaaccagagctccatcgcagatgcctcccccatcaaacaggagaacagcagcaactccagccccgctccagagcccaactcggctgtgcccagcgacggcaccgaggccaaggtggatgaggcccaggctgatgggaaggagcacccaggagctgaagatgcttctgatgagcagaattcacagtcctcgatggaacattcgatgaacagctcagagaaagtagatcggcagccgtctggagactcgggtctggccgcagagacgtctgcaatctctcaggtacctcgctcgaggtctcagaggggcagccagatcggccgggagcccattgggttgtcgggggatttggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaaggctgtctccttaaggcactgagtgggccggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccccaccggggagtgggccttgatggccgggcctcgaaggccacaaacaaggcgtcgaggaattggaaagatttgcacaccctccagaaaggagagacgcaatctcccctccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttatttttttttttaagggatcctgtctatttcctgcacttcgagaagaatcaaaatgttcctgaatttcaaatacctcatgcaaaatgtctcctgaaataagggaaaaaaaaaaaaccacaactttgaaaatcttaatgttgaagttagcaatgccgaaaggtttctgtcttaaaaaaaaaaatccttgtacttatcaattttgccccttaggcagtcagttttgttgagaactgtgtcctgcatcctggcgcagaacctacctgatgcggttcctctccacgcatctcgaggcggcgttacctccagattccgtagagttagagtcacatttttctttgcagcgaaactccatcttggtgagagatgaatttggatatttatttccttctctgtttttgggaaacgagaggctacaaccaagacagctgaaggagaatgaaacacacacatccacagaaacagagaggcgtaggtggccctgccgttgaccgcagcctctctggacaggcaaggggagttggcgcaggtgaggactcagacgacgtccaccgtcccaaggctgtcactagtatttctctgaagtgcctgaaggtaggaatgggccggcgattgggaccagctgggccccaccacggccacgccaggcaaagcgccagcagccctgcactccacgctggccaagaaggccttccacgcagaatgacaagactgcaaaaatccgatgtgcttccttccctggcgcagtcgctcctcgagccgctgccccccacccaccctgcacccctcgccctccccccaccacagaatctaagacctttcagcttcgagccagggggcgggggatcccgagcaaaagccttccgtggacatcaggccccgtggcctcaagggctcccagggcaaacctaattccccccaaaacgtgaagtcggggaagctgcggctacacattccacaaagtgctggcacttacacccacaacccggaaggctgtggaccgattcctctagggtggtgacctcccattagcaaacggtgtcatggtttggaatgttcattatcgccaagaacctggttagaggcataaagaccttttttcaccgttacctaattttttcccctttcaagaattttttttttttttggtgtgttgtacagcagtataatttttcacttatttattccatcagtagatatggtttgtacaatgtacaattgtttcatttcagaaaataaaaatttcaaatcatgaa

SEQ ID NO: 143 - protein, 231 aa, Homo sapiens
MSGRSVRAETRSRAKDDIKRVMAAIEKVRKWEKKWVTVGDTSLRIYKWVPVTEPKVDDKNKNKKKGKDEKCGSEVTTPENSSSPGMMDMHDDNSNQSSIADASPIKQENSSNSSPAPEPNSAVPSDGTEAKVDEAQADGKEHPGAEDASDEQNSQSSMEHSMNSSEKVDRQPSGDSGLAAETSAISQVPRSRSQRGSQIGREPIGLSGDLEGVPPSKKMKLEASQQNSEEM

SEQ ID NO: 144 - DNA, 3720 bp, Homo sapiens
actgggccaggcgcgcggcggccccgggctttgtgtgtgtgtgtatgtgtgtgtgtgtgtgtgtgtgtgtgtgagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatgggagaagaaatgggtgaccgttggtgacacatccctacgaatctacaaatgggtccctgtgacggagcccaaggttgatgacaaaaacaagaataagaaaaaaggcaaggacgagaagtgtggctcagaggtgaccactccggagaacagttcctccccagggatgatggacatgcatgacgataacagcaaccagagctccatcgcagatgcctcccccatcaaacaggagaacagcagcaactccagccccgctccagagcccaactcggctgtgcccagcgacggcaccgaggccaaggtggatgaggcccaggctgatgggaaggagcacccaggagctgaagatgcttctgatgagcagaattcacagtcctcgatggaacattcgatgaacagctcagagaaagtagatcggcagccgtctggagactcgggtctggccgcagagacgtctgcaatctctcaggatttggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaaggctgtctccttaaggcactgagtgggccggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccccaccggggagtgggccttgatggccgggcctcgaaggccacaaacaaggcgtcgaggaattggaaagatttgcacaccctccagaaaggagagacgcaatctcccctccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttatttttttttttaagggatcctgtctatttcctgcacttcgagaagaatcaaaatgttcctgaatttcaaatacctcatgcaaaatgtctcctgaaataagggaaaaaaaaaaaaccacaactttgaaaatcttaatgttgaagttagcaatgccgaaaggtttctgtcttaaaaaaaaaaatccttgtacttatcaattttgccccttaggcagtcagttttgttgagaactgtgtcctgcatcctggcgcagaacctacctgatgcggttcctctccacgcatctcgaggcggcgttacctccagattccgtagagttagagtcacatttttctttgcagcgaaactccatcttggtgagagatgaatttggatatttatttccttctctgtttttgggaaacgagaggctacaaccaagacagctgaaggagaatgaaacacacacatccacagaaacagagaggcgtaggtggccctgccgttgaccgcagcctctctggacaggcaaggggagttggcgcaggtgaggactcagacgacgtccaccgtcccaaggctgtcactagtatttctctgaagtgcctgaaggtaggaatgggccggcgattgggaccagctgggccccaccacggccacgccaggcaaagcgccagcagccctgcactccacgctggccaagaaggccttccacgcagaatgacaagactgcaaaaatccgatgtgcttccttccctggcgcagtcgctcctcgagccgctgccccccacccaccctgcacccctcgccctccccccaccacagaatctaagacctttcagcttcgagccagggggcgggggatcccgagcaaaagccttccgtggacatcaggccccgtggcctcaagggctcccagggcaaacctaattccccccaaaacgtgaagtcggggaagctgcggctacacattccacaaagtgctggcacttacacccacaacccggaaggctgtggaccgattcctctagggtggtgacctcccattagcaaacggtgtcatggtttggaatgttcattatcgccaagaacctggttagaggcataaagaccttttttcaccgttacctaattttttcccctttcaagaattttttttttttttggtgtgttgtacagcagtataatttttcacttatttattccatcagtagatatggtttgtacaatgtacaattgtttcatttcagaaaataaaaatttcaaatcatgaa

SEQ ID NO: 145 - protein, 210 aa, Homo sapiens
MSGRSVRAETRSRAKDDIKRVMAAIEKVRKWEKKWVTVGDTSLRIYKWVPVTEPKVDDKNKNKKKGKDEKCGSEVTTPENSSSPGMMDMHDDNSNQSSIADASPIKQENSSNSSPAPEPNSAVPSDGTEAKVDEAQADGKEHPGAEDASDEQNSQSSMEHSMNSSEKVDRQPSGDSGLAAETSAISQDLEGVPPSKKMKLEASQQNSEEM

SEQ ID NO: 146 - DNA, 3809 bp, Mus musculus
ttgcgcactgggccccgggcgcgcggcggcaccaggctttgtgtgtgcgcgtatgtgtgtgagtgtgtgtctgtgcgcgagtgagagagcgggcgagtgtggcgagcaggacccggcgggcgcgctcccccagcctccctctctctctctctttcctctctctctccctccccgccagaaccatgtcgggcaggtcggttcgagccgagaccaggagccgggccaaagatgatatcaagagggtcatggcggctatcgagaaagtgcgcaaatgggagaagaaatgggtgaccgttggcgatacatccctacgaatctacaagtgggtccctgtgacggagccaaaggttgatgataaaaacaagaacaagaagaaaggcaaggacgagaagtgtggctcggaggtgaccactccagagaacagctcgtctcctgggatgatggacatgcacgatgataacagcaaccagagctccatagcagacgcctcccccatcaagcaagagaacagcagcaactccagccctgccccagagaccaacccacccgtgcccagcgatggcaccgaagccaaggctgatgaggcgcaggccgatggaaaagagcaccctggagctgaagatgcatccgaggagcaaaattcacagtcttcgatggaaaactcggtgaacagctccgagaaggcagaacggcagccatctgcagaatcagggttagcggcagaaacgtcggcagtctctcaggatttggaaggagtgccgccgtctaaaaagatgaagctggaagcctctcaacagaactcagaagagatgtagacggcccggcggaaccttctggtccatgtttcatggcaggtacatcggcaggcttaattctagaaacacggcccaagcgactcctcttgggcgcgagcagaactaacgtttcaagtttactaaagtgcaaatccaagaagaacctagagcggcggcggcagcggaacttcgcagacacttgacggactctgccgtgaaaccgaaacactcgaaccttcaagtgactgccctctgggaggtgggtcgacagctcaggagtgtgtgcgcactgtctcggaagccaagattacatttgtgttgctgctgtatccccctcccctcacttctctatttaacgatataagctattcgagggtggtaccaatcaggaatttgctttccataggggcttttggctcttcaaccaattccttctgctttctttttttgtgccttgtaccctagaggtgacctccggcatgcttcctggtttttgcatctctcctggcaaagtgcccacttgttttggttggctgctgcccccacccccaccccttattgcctctctcctccctgccccaagactgcttcaaagcaagcagggtagagcggcgggagaccaggcacctttcagtgacccccttggttcaggtgagcagtgtttgggcacaccctgagccccaacttccagggcccctggggctacaagtttgcgggggccggtttcccgagggctggcctccttggtcaggacacgccctcaccttttggagccatggaggctaggcgtttgcaaggcaaggtagcccagattgacatgcaaaagcctttagatttttctggcacttccaccctatctcccctccgccccctaacctcacaccccgactctggccacaactggcactgcgctctccaggtcctccgaagacgaaatgaccaactgagcttgtctccttaggatagtaaagggctgggaggttgggagccggcggccggcaggaatagctggtgctgaactaactctcccataggacattgcttggatttcaaatccatggtaacctgctgccctttgtccctgtctcctatccaccgcaccccaagccccccaaaaccccaggcaggatgcgcctggtatggcctgactctgagaggctacaggtggatggagacccattcccagtaccgcgctgttggtctcctctggggaccggaccttaaccattgggcctcaggccagaagcaaggcacagaggaaccgggaagatttgcacacagatttgcccccccagaaaggagcctccgaggcacttccttcccctgctcttccttgcacggagacagctctctctcactcagtggagacgccacttggacagacggactgctcagctgttgatttctgaggcctggtttgctcttaatccctttgctggacccctcagatctgaaaaccttcccctatgctttcttactgcactggagttcgaactccctatgagttgtgtgttggggggaggggcgggcggggtgggttttgtttttttgttgttcttgtttcgttttgtttcgtttgctaattggtgcatattcaggtaccaccttttgacgtgtggatctttctccaaaccaccacaagaagtgtctgccgggctccgttttctaagagtttctgaggggacagctcccatttctttttttggtttcaagggagctgtctatttcctatacttcaagaagaatcaaaatgttcctgaattttaaatacctcatgcaaaaatatctcctgaaataagggaaaaaaaaaaaactttgaaaaatcgtaatgttgaagttagcgatgctaaaatgtttctgtcttaaaaaacaaaaaaattgttgtaatacttagcgattttgcccctcaggcggtcagttctgtccagaactgtgttctgcgtcttggcccggaagcaaccggatgcatgacctctgaacggatctcaaggccaaggcatctttacctccagattctagagttagggcaacaacagttttcttttgcagcaaaactccgttctggtgaaagatgaatttggatatttatttctttttctgggaaacaagaggttaaacaacgtaagcagctgagggagaacccaacacgggcatccacggaaccagcgggcgcggccagggccgcctatacctcttctaccctccgcagcctctctggacagtcaggaggagtcgatacagttgagaaagaagacaacgatgaggttcgaggtaccgaggctgtcattagtttttctctgaagtgcctgaacgtaggaatgggccgtcgacggaggggaccattcggatgttcccccacctcgcgacggccgcgccaggcaaagagccagcagccctgcactccacactggccaggaaaagccttccacgaggagcggtcagactgcaaaatccaatgtgcttccttccccgccacggtcctctctctctctcggggagccgatggtccccgtccctgaaccccctagcccgcatccccaccacagaatctaagacctttcatctggccgagccaggggcaaaggggatcctaagcaaatgccttccgtggacaacaggccccacggcctaaagggctcccagggcaaactttcccccaacacttgaaggggggtgggggggatggcggctacacattccactaagtgcagcactcgcacccacaacccggaaggaaggctcttaagcgattctcagagggtggtgactgcccatcatcgtcagacggtgtcgtggtttggaatgttaattatcgcagaggacctggtagaggtataaagaccttttttcactgttacctaattttttttttcctcttacaattttttttttggtgtgttgtacagcagtataatttttcacttatttattccatcggtagatattgtttgtacaatgtacaatggtttcatttcagaaaataataataataaaaaaaaaagttctgatcatgag

SEQ ID NO: 147 - protein, 210 aa, Mus musculus
MSGRSVRAETRSRAKDDIKRVMAAIEKVRKWEKKWVTVGDTSLRIYKWVPVTEPKVDDKNKNKKKGKDEKCGSEVTTPENSSSPGMMDMHDDNSNQSSIADASPIKQENSSNSSPAPETNPPVPSDGTEAKADEAQADGKEHPGAEDASEEQNSQSSMENSVNSSEKAERQPSAESGLAAETSAVSQDLEGVPPSKKMKLEASQQNSEEM

SEQ ID NO: 148 - DNA, 1729 bp, Homo sapiens
gcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgtccaaaaaaaaaaaaaaaaaa

SEQ ID NO: 149 - protein, 202 aa, Homo sapiens
MSGRSVRAETRSRAKDDIKKVMAAIEKVRKWEKKWVTVGDTSLRIFKWVPVTDSKEKEKSKSNSSAAREPNGFPSDASANSSLLLEFQDENSNQSSVSDVYQLKVDSSTNSSPSPQQSESLSPAHTSDFRTDDSQPPTLGQEILEEPSLPSSEVADEPPTLTKEEPVPLETQVVEEEEDSGAPPLKRFCVDQPTVPQTASES

SEQ ID NO: 150 - DNA, 1558 bp, Homo sapiens
gcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgtccaaaaaaaaaaaaaaaaaa

SEQ ID NO: 151 - protein, 145 aa, Homo sapiens
MSGRSVRAETRSRAKDDIKKVMAAIEKVRKWEKKWVTVGDTSLRIFKWVPVTDSKEKEKSKSNSSAAREPNGFPSDASANSSLLLEFQEPSLPSSEVADEPPTLTKEEPVPLETQVVEEEEDSGAPPLKRFCVDQPTVPQTASES

SEQ ID NO: 152 - DNA, 1851 bp, Homo sapiens
gcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgacggaatctcgctctgtcacccaggctggagtgcattggcgcaatctcggctcactgcaacctctgcctctcaggttcaagcaattctcctgcctcagcctcctgagtagctgggactacagggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgtccaaaaaaaaaaaaaaaaaa

SEQ ID NO: 153 - protein, 213 aa, Homo sapiens
MTESRSVTQAGVHWRNLGSLQPLPLRFKQFSCLSLLSSWDYREKKWVTVGDTSLRIFKWVPVTDSKEKEKSKSNSSAAREPNGFPSDASANSSLLLEFQDENSNQSSVSDVYQLKVDSSTNSSPSPQQSESLSPAHTSDFRTDDSQPPTLGQEILEEPSLPSSEVADEPPTLTKEEPVPLETQVVEEEEDSGAPPLKRFCVDQPTVPQTASES

SEQ ID NO: 154 - DNA, 1678 bp, Mus musculus
acgcgcgcacggagggggggcgacggccgcggtgacgtgctgcggtggcagcgggtggacggcgacgcgtgaggcgcgtgatatcccgcgtcttgggagcactgtcccggcccccagccactccccgccgccgccatgtccggccgttcggtccgggccgagacccgtagccgggctaaagatgacatcaagaaggtgatggcggccatcgagaaagtgcggaaatgggagaagaaatgggtgactgtgggtgatacctccctgaggatattcaaatgggtgcctgtgacagatagcaaggagaaagaaaagtcaaaatcgaataatacagcagcccgggaacctaatggctttccctctgacgcctcagccaattcctccctcctccttgaattccaggatgagaacagcaaccagagctctgtgtcggatgtctatcaactcaaggtggacagcagcaccaactcaagtcccagcccccagcagagcgagtccctgagcccagcacacacctcagacttccgcactgatgactcccagccccccacattgggccaggagatcctggaggaaccttcgctgcctgcatctgaagttgcagatgaacctcccacactcacaaaggaagagccagtgccggtggagacacagaccactgaggaagaggaggactctggtgctccgcccttgaagagattctgtgtggaccaacctgtagtaccgcagaccacgtcggaaagctagcaccgtcctggcccctcgcctcctggcccctgcctctatttattgcattctggtctggccgagctctgatgctggggtccgggcaagcactagggtccagagcctgtgcgtgggagccctctgggctagaaggctgatggagggcgtggggtcgtcgcaccatcttcttgttcctgacacttgtgtctgcttgctcttgagcaaaggagcgctcacatcttttctgtagcccaagtaggccagagcatcagggttcatttctcacctccagaaccactgcacggagctgctggcgccgccacggggagaaaggtgtggaaggcgcccacctgagagaagagtgcctaggattacttgaattgaatggagactgtggagtatggactttgccacagggccaggccctgcaggctgctgctgggagagggactgaccggtagagatgtggagaacaccggagagaggctcttccgggacggaggggctttcgccacctttgggcagaagacccatgggagatgcatcctgtgcctgaggcagacctgcctctgttggatgccccagctgctcccagccctgtgcctgccagaaccttctgctgcatcctcacactcactaagcacacctgaagctttctattcacccgtcctttcattccaacgtccccacctcctcctgcagaaaaccccagccatgattggaggttctgaccacagtacctgccccagtactccttcagctcagactttctagaaagttcctttttctttaaaatctgcatgtttaattaaactttatgattttattttttgtctgaaaaaagaaaagtttaagaaaatggaaatgggtaacagcaagtgaagacctattttagcactgaatagagtatttttaaaattaaactttgaaatatgtcttgttaaaaaaaaaaaaa

SEQ ID NO: 155 - protein, 202 aa, Mus musculus
MSGRSVRAETRSRAKDDIKKVMAAIEKVRKWEKKWVTVGDTSLRIFKWVPVTDSKEKEKSKSNNTAAREPNGFPSDASANSSLLLEFQDENSNQSSVSDVYQLKVDSSTNSSPSPQQSESLSPAHTSDFRTDDSQPPTLGQEILEEPSLPASEVADEPPTLTKEEPVPVETQTTEEEEDSGAPPLKRFCVDQPVVPQTTSES

SEQ ID NO: 156 - DNA, 1998 bp, Homo sapiens
tccgtccccaactcgcgcgtccgtccccaactcccgctctcggcggcgggcagggggcgctgagcgtccaggcgctccaagggggcgggcccgggtcggggcggggccggccgggcttccaggcctgggctctggccgcccgcgccaccgggccgctccggggacaggccggggcggggcgcggcggcaggaaacggggcggggacttgcggaggcgttggggacgagagagggcgcggccaactccaggggggacggcaggccgagagcgcggcgcccgggcctggcgcggagcctgagcccgccggacgggaggcggccccgccgcgggctcggccccggccccagccccgccagcatggccggccggactgtacgggccgagacccggagccgggccaaggatgacatcaagaaggtgatggcgaccatcgagaaggtccggagatgggagaagcgatgggtgactgtgggcgacacttcccttcgtatcttcaagtgggtgccagtggtggatccccaggaggaggagcgaaggcgggcaggtggcggggcagagagatcccgtggccgggaacgtcggggcaggggcgccagtccccgagggggtggccctctcatcctgctggatcttaatgatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagagatcccgggggcataactgctggcagcaccgacgaacccccaatgctgaccaaggaggagcctgttccagaactgctggaagctgaggattcgggagtgagaatgacgaggagagcccttcacgagaaggggctgaagacagagcccctcaggaggctcctgcccaggaggggcctccggacaaatgtccggcccagttccatggcggtgccggacaccagagctcccgggggaggcagcaaggccccgagggcacccagaacaatcccccagggtaaggggaggtgagtgggctccccaagcaagccaagacccctaaagcctcccttggctgccccaagatccagccactacctgtgccccgagggcggaaagagcttcccagctcacccaccgcggtaacatcggagggcgagcggccccacacctgcccgaacctaaggccacagcacccatctggctcgccactggcgcccgaatgcatgggaagggcttagggcagaactcggaccacatccagtgcctgaggccgccttgctagaggcctaggggaggggtgcactgggctgcctcgcccacctcctcacgcacccatgcggccaccctcccagcggtctgagtgtgccatgcgaggcgcctgccaccccgggagaggcgccgagtcccgagtcctgccggcactgagcctccgggtccacagcgggcaagggccgtggcggggacaagcgcaggggacccgccggcctcccgccttctgcagcaccacgagatgcccacgtggcacctggacgtccatgcatatgttgaggcccgtgcacgcgcagagaccccagcgcagaagccgccccgcacgccagggcttatgtatgccagcgctgggagacctccagcgcccgaggacatacggcaagtggttccaccagggtgtcagcctagcaggccaacctgggaacccatgtggacaagcggcctttcagcccaggcgcccgcctcgggtggaggcgtggagacttctggcgcagccctgagctggtggcctaacctacctggaaaatcctagcccgagaagcagcgcgagtgagccttttgggtggttccaaggcccttcaccaagctctcacttcctgacttcaccgttgggtctgttgtactaggaaataataacgcctcccatttatcaagggtttactctgtaaaaa

SEQ ID NO: 157 - protein, 242 aa, Homo sapiens
MAGRTVRAETRSRAKDDIKKVMATIEKVRRWEKRWVTVGDTSLRIFKWVPVVDPQEEERRRAGGGAERSRGRERRGRGASPRGGGPLILLDLNDENSNQSFHSEGSLQKGTEPSPGGTPQPSRPVSPAGPPEGVPEEAQPPRLGQERDPGGITAGSTDEPPMLTKEEPVPELLEAEDSGVRMTRRALHEKGLKTEPLRRLLPRRGLRTNVRPSSMAVPDTRAPGGGSKAPRAPRTIPQGKGR

SEQ ID NO: 158 - DNA, 1101 bp, Homo sapiens
tccgtccccaactcgcgcgtccgtccccaactcccgctctcggcggcgggcagggggcgctgagcgtccaggcgctccaagggggcgggcccgggtcggggcggggccggccgggcttccaggcctgggctctggccgcccgcgccaccgggccgctccggggacaggccggggcggggcgcggcggcaggaaacggggcggggacttgcggaggcgttggggacgagagagggcgcggccaactccaggggggacggcaggccgagagcgcggcgcccgggcctggcgcggagcctgagcccgccggacgggaggcggccccgccgcgggctcggccccggccccagccccgccagcatggccggccggactgtacgggccgagacccggagccgggccaaggatgacatcaagaaggtgatggcgaccatcgagaaggtccggagatgggagaagcgatgggtgactgtgggcgacacttcccttcgtatcttcaagtgggtgccagtggtggatccccaggaggaggagcgaaggcgggcaggtggcggggcagagagatcccgtggccgggaacgtcggggcaggggcgccagtccccgagggggtggccctctcatcctgctggatcttaatgatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagagatcccgggggcataactgctggcagcaccgacgaacccccaatgctgaccaaggaggagcctgttccagaactgctggaagctgaggcccccgaagcttaccctgtctttgagccagtgccacctgtccctgaggcagcccagggtgacacagaggactcggagggtgcccccccactcaagcgcatctgcccaaatgcccctgacccctgagaagccggcctgcctgtcctgttgccccaggggcccctttggctttttacaaataaagacccttttgtaaaaaaaaaaaaaaaaaaaaa

SEQ ID NO: 159 - protein, 217 aa, Homo sapiens
MAGRTVRAETRSRAKDDIKKVMATIEKVRRWEKRWVTVGDTSLRIFKWVPVVDPQEEERRRAGGGAERSRGRERRGRGASPRGGGPLILLDLNDENSNQSFHSEGSLQKGTEPSPGGTPQPSRPVSPAGPPEGVPEEAQPPRLGQERDPGGITAGSTDEPPMLTKEEPVPELLEAEAPEAYPVFEPVPPVPEAAQGDTEDSEGAPPLKRICPNAPDP

SEQ ID NO: 160 - DNA, 6360 bp, Mus musculus
ggccggggctctagcagcccgcgccgcccgggccgctccggggacgggccggggcggggcgcggtcttaggaagccaggcggggacgcgcggaggcgttggggagcgagggagggcgcggccaactcccggagggacggcaggccgaaagagcggcgctggggcctggcgctcagcctgagatcgccggaccacaggccgccccgccacgggctctgtcccggccccagccccgccagcatggccggccggaccgtgcgggccgagacccggagccgggccaaagatgacatcaagaaggtgatggcgaccatcgagaaggtccggagatgggagaagcgctgggtgactgtgggagacacttcccttcgaatcttcaagtgggtgcctgtggtggatccccaggaggaggagaggcggcgggcaggaggcggggcagagagatcccgtggccgggagagacgtggtaggggcaccagtcccagagggggaggccccctcatcctactggatctcaatgatgagaacagcaaccagagtttccattctgaaggttcattgcaaaagggtgctgagcccagccctggggggacgccccagcccagccgccctggatcaccaactggacccccagaagtgattactgaagatactcagcccccacaattgggtcaggagagagatccaggggggacacctgcaggcggtactgatgaacccccaaagctgaccaaggaggagcctgttccagaattgctagaagctgaggattccggcgtgagactcaccaggagagcccttcaagagaaaggcctgaaaaccgagcccctcaggaggcttctccccaggagaggcctccggacaaattctcggccaacttccacggttccggaacccagagctcccggaagtgggagcaaggcccagagggcacccaggacgataccacaagggaaggggaggtgagcgggttccaccacacaaggggaggcccttaggtcttccttagctgcctcaagatccagtcatttacccacaccgtttaagggtggagagggctttggagctgggcacccgcagccagcaatggaggtcggcagccagctctctgcttgtccctgtccctaaattatggatccatcctgcttgctgtgggtccaaaactactgggccagagcaggtcccagacagggaatgtctggggacatctctaggtgatgcctagaagcaacttgaatacacaaaatggtggatcctatgccaacttggtcacctcctcacacacttagggcagccatccaccaaagggccaggcatggcccctggaggtgaccttcgacctttggaactacagtatctacactggtgaggggccctaccagcaagacttgagcagcgagcaacccctgaagcactgggcaaaaggtaatgccacagcttgtgaatggtgtgaagattcaattgcccgtgtgtagagacaccactccagcaagcacctggcagcctcacccgcttccacgagcctatggactctgggcctgctaattaacccttggctccagaagacatgtgccaaccagggtgccaaccttgcctcaggtcaatcgaggggtgcacatggcccagtgacctttcagaccaggccacagcctcctgccccaggaatggatggagacatgtggtccagcactgccaaatctacctggaaactacccactttgagaaactcatggcagatgagccatctgagtgattccaagggctttcatcaacctcttgcctccgacttgacaactcacttggccaggaggtagtgtctcctgtaccacagagagctaactgtactacatattgcaacttgtgggacttatttaatgcagcactcctgtcatagatcctgttactttcacattttacagatatagaaaacaagcaaccaggaggttaaagagcttgccccaagtcacacagcctgtctgtggcagagccagcattcacatccagtctacccacctgactccacagtccctgctagtgtaccactttttgtgctgggcatgcaggtgggctgcagctgtgagctttgttgaggcgttcattgaaggaacatccatttttctcagtggcaaattacaaaggacttttaattttaactttcttctgcctgacctaccttccttccttccttccttccttccttccttccttccttccttccttccttccttccttcctttcttcctctgctggccatgaacccactagaccaggccagtcttgaactcacagaggtctgtctatctctgcctctccagtgctgggattaaaggtgagcgacaccatacccagcttaggccttctttgtttgtttgtttgttgttttttgagtaataaggtaagcagatgttctgtgtccataactgagatgacatggacattgagtggtaagggacttgagctcagcccctgggtccctcagattcctctctggagtgccattgatacaggaagcatcatctaggcccagctcctgattggcgacttcccagaagccatgggctgtcatgccaagtgactggggaacttcaagtaacaaacatttattaattagacttctgaactaccaatggggcagaagttttcacgtttcaaacacagatactagttttcaagattcagaaatgaaacataggaattctggggaggtccagaaagtcctactttgtatttttcataactctctgtatcttaaaagctaagaaactcacagttcatcgtagtttaaaagagctgcaagccttaaatattcaaaaggtagaaactgccagtgtgtgtcactgggtagtagttgaataacaaaatgtttacggatccaattagattcatggtactccagagtcatgagttgaaatcgcggatataaagacttatttccaatgcatcatttctcagaacaccctgggatttgtataaaacacacgatgcatgtgaacgcattcatgtttatcttatttctgagaatcattctacaggcgggggagcacgcatacatttttaatgtcagggctacagaagactggcctggcacggctcccctcagttcttggttcccaaattctaaggatgtctgccttcgtttcatgtgtcagcctttcctgctctcggacctgacacagtggctccgtacagcgaggactcctctgtgctgatgaacttcggctgttagaggactgttagtatgtttcctgtttcgccaatttatttgctgattggttttgtgattcaaaaaacaaacaagcaagcaaacaaacaaaaacaaaagcagggaccaggcgtggtggcgcacgcctttaatcttggaggcagaggcaggcggatttctgagttcgaggccaacctgatctacaaagtgagttccaggacagccagggctatacagagaaaccctgtctcaaaaacaaacaaacaaaaacaaacaaaaaaacaaaagcagacaaaatcaccaccagcagcagcaacaatcccaggtttcccaataatgtcagcaaggaattctgaacagacaaagtccgtggggctgagcagggacggtgaataagtgagctcgtgtttatgaagcccagtgatctgctccttgcagccagaacgctccagctcagccaggccctggcacgagccctcggctgaagcactcacctctgagcttcagtttagtgagtagcatcctccctagaaagtaatattcttgcttcatacggtgatatggtggaagggttaccagcatggctttggagtcagacagactgtggttcaaatcttagctacacgactttctacctctttgatttggggcaagttctaaccgctggctttttctcttctgtaaaatgaggacatggaatctatttcacagggctgtggcttcagtgagatcacatatgacccgcttaagtcaaagcgggtccacggtatgtgtttgatcccacgtaggcattacccgctgtatctacctcacagggcagttgtgaggatgaagggtagagggaaatgctttccaaactgtgaagtgatctgtgtttacctctctcctctggagatggagagataggaagttgctgtcagacactagtgggatgcccatggagagggcctagtatgcttctgtgcacacagtgtggctgggctgaaggggaggtgctgtgttgtgcagtggtgcacagcgggggcgtgccctccggtgagggttgctgcactgaagtggggaagttcagtgcctatggctacactgttgggagcagggagagcgcaggtcctatcttaagaaggatgctagatgggggctaaagtagatgagtgtttgcctagcatgagcaagggccatggatttcgtatctagcacctcaggaaaaacacaacaaacaaacaaacaaacaaacccctcttcttgtttaaagattctggataaagaacagtgttgtgaacgtgtgtatccactgtttgtctttttaaatacaactcaaatagcaggaaggcctgtgtgcacaagaggtgacaagtgactgcaagtgtttccatcgctggcagccatgcaccctcctaccacgagtacagatttcattctggagtgtgcagaccaaatgcaggtcagagggccctcccggggcaactcgccaagatcctgaccaaagcctagcctcacaaagtaatccctagcccagttagcagatcaggggttggggcttgggaacgtcatgtccaatgtccaaggctgcacaggtcctgtggggacagaatccaagcccttcacctggattggggttcctccgcctgccagtctcagatctctgatcttgaacaaggatagcatgcagaagagtaaggttccatgcctaagtgacctcctctggacctcagacgcagttcttgctcctgacctcatgcctcgtctccagacatcactccccagcttagcccttaggtcaggctcctctgggcaccatccttagattcaacccaaaggagggtcctctcattctaaccagactgtctctccaaataccaccctagtcagctccttggcttctcagtgtccccttggagaacatggggtataggttcccagctagttcagtggcattccacagcccatctcttgtgaggtcccactccttaacaatggtctttcagtttcaaacgcatgcggccagcgggcagtctagggacccttcaaagtcaatgcttcttgattaaattatcgagactaatgtttaactttgagatacgttttctgagagttgctaaccggttggagatgaacttagagaatagggttcacctttttcgtctgtcagcgggttatcgagtgcccagtggtgtgccagattcagcagctggtgcaggagatacattcgtgagcaaaacagatctgagccctgacttcgggaggcctcctcctaacaactagggcagatataaccagtgttccctgaatacaaacgcctagcctggcatggtggcacacacctatgatgtcagcccttaggagccggaggtaagaagatcaggagttcagctatctttggccaacctgggctacataagaccgtgtcttaaaaaaaaaaaaaaaaatccaaacaaaatacacactataactgtgagaaatgttgtgaagagaaaggtccaaatgcagtgaaagagctcagtaaaaaaagtgtggggtgtgttaggacagtgacaacatgtgcccgtatgtggagaagagaatcctgggtaatgggaggagcttactgtattggaatcggcagcagcagtgaggtctgctgctggacggagcctgccccccaggctgggtggggaaggtgtcacggaccttgcagaccacggtaaggaacttgcattctggtgtttaactttttatttggagaccatttcaaagtgactggaaccttatgagagtggcacaaaagatgtctgcatactttggctgcagcctccccgactgacctgtaaacgttctgttccccgagtcaccacccgtgtctccctgtgatgtgtactcatagcctgtagtccgaactctgagaatgagttgcatacattgtgtctgtttacacttaaaacacagtggagaccccctacagtaatgcctcgcccgcctccgcctgccacactgggtttatcgctggttggtggctccacactgtttgttggtcgtctctctagtcaccttcattagcatcttccctttaggacaagtcacgtctgcgaatgatgtggaccatgcgttgtgctttcttgctcgtatcttttaatgtggcgtagtttctttcctctctgtttgaatagactatttctccttttg

SEQ ID NO: 161 - protein, 241 aa, Mus musculus
MAGRTVRAETRSRAKDDIKKVMATIEKVRRWEKRWVTVGDTSLRIFKWVPVVDPQEEERRRAGGGAERSRGRERRGRGTSPRGGGPLILLDLNDENSNQSFHSEGSLQKGAEPSPGGTPQPSRPGSPTGPPEVITEDTQPPQLGQERDPGGTPAGGTDEPPKLTKEEPVPELLEAEDSGVRLTRRALQEKGLKTEPLRRLLPRRGLRTNSRPTSTVPEPRAPGSGSKAQRAPRTIPQGKGR

SEQ ID NO: 162 - DNA, 981 bp, Mus musculus
ggccggggctctagcagcccgcgccgcccgggccgctccggggacgggccggggcggggcgcggtcttaggaagccaggcggggacgcgcggaggcgttggggagcgagggagggcgcggccaactcccggagggacggcaggccgaaagagcggcgctggggcctggcgctcagcctgagatcgccggaccacaggccgccccgccacgggctctgtcccggccccagccccgccagcatggccggccggaccgtgcgggccgagacccggagccgggccaaagatgacatcaagaaggtgatggcgaccatcgagaaggtccggagatgggagaagcgctgggtgactgtgggagacacttcccttcgaatcttcaagtgggtgcctgtggtggatccccaggaggaggagaggcggcgggcaggaggcggggcagagagatcccgtggccgggagagacgtggtaggggcaccagtcccagagggggaggccccctcatcctactggatctcaatgatgagaacagcaaccagagtttccattctgaaggttcattgcaaaagggtgctgagcccagccctggggggacgccccagcccagccgccctggatcaccaactggacccccagaagtgattactgaagatactcagcccccacaattgggtcaggagagagatccaggggggacacctgcaggcggtactgatgaacccccaaagctgaccaaggaggagcctgttccagaattgctagaagctgaggcccccgaagcttaccctgtctttgagccagtgccatctgtccctgaggcagcccagggtgacacagaggactcggagggcgcccccccactcaagcgcatctgtccaaatgcccctgacccctgagaagccgcctgcctcctgtcctgttgctccaggggcccctttggctttttataaataaagacccttttgtaaaaaaaaaaaaaaaaaa

SEQ ID NO: 163 - protein, 217 aa, Mus musculus
MAGRTVRAETRSRAKDDIKKVMATIEKVRRWEKRWVTVGDTSLRIFKWVPVVDPQEEERRRAGGGAERSRGRERRGRGTSPRGGGPLILLDLNDENSNQSFHSEGSLQKGAEPSPGGTPQPSRPGSPTGPPEVITEDTQPPQLGQERDPGGTPAGGTDEPPKLTKEEPVPELLEAEAPEAYPVFEPVPSVPEAAQGDTEDSEGAPPLKRICPNAPDP

SEQ ID NO: 164 - protein, 1590 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDRCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 165 - DNA, 5892 bp, Homo sapiens
gcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 166 - DNA, 5879 bp, Homo sapiens
tcagaagaaagccccgagatcacagagacccggcgagatcacagagacccggcctgaaggaacgtggaaagaccaatgtacctgttttgaccggttgcctggagcaagaagttccagttggggagaattttcagaagataaagtcggagattgtggaaagacttgacttgcagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 167 - protein, 1572 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 168 - DNA, 5838 bp, Homo sapiens
gcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 169 - protein, 1514 aa, Homo sapiens
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 170 - DNA, 5664 bp, Homo sapiens
gcgtcttccggcgcccgcggaggaggcgagggtgggacgctgggcggagcccgagtttaggaagaggaggggacggctgtcatcaatgaagtcatattcataatctagtcctctctccctctgtttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 171 - protein, 248 aa, Homo sapiens
MWLAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 172 - DNA, 1846 bp, Homo sapiens
cttggagaggcggaggtggaaacgatgcgcaggagttggcttggggctttttgtttgcgtgtccctgtttacctattcataatcatggatcccctctgctttgtgatactgtgaaccacgcataacagcaattctttacaccaccgggttgagaagaaggcgcctgaggctgactttctggacctgccgtcacgcagtaaagatgtggttggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 173 - protein, 276 aa, Homo sapiens
MKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 174 - DNA, 1833 bp, Homo sapiens
attcacttcattaaatctagaggcagttgagcatgggagccgtctgtatgttgaattagggctcgcactcttgcgcaacacgtcaccagtcggaaactggggctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 175 - protein, 278 aa, Homo sapiens
MLMKRLAARCFAGLLILSPLTVISDSRPADSGKAIEDGNLEEMEEEVRLKKRKRRRNVDKDPAKEDVEKAKKRRGRPPAEKLSPNPPKLTKQMNAIIDTVINYKDSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 176 - DNA, 2254 bp, Homo sapiens
acttcattaaatctagaggcagttgagcatgggagccgtctgtatgttgaattagggctcgcactcttgcgcaacacgtcaccagtcggaaactgggggtttgcttctgtgatttatttcattattgtgctggtaaaaggtttggaagggaattctttttgggggtagtactttagcattgtgtagcaagttttggggttttttttgtgtgtgaccccccagcccccagcgctgagtttgagtcagttgagccagtttagtaaataattttttaaaataaaagaacagtttaaaatctccatgaataattttacttacatgcaggagtaatcttactctactctttatgtgcgaaaagcattgggaagtgtttagtgaattgatttccattagaaaaagacccttagaaatcacagaacataaagcactgcatatggatgtgtttggggtctttggggaggagggaagatgttttgtagctctctgcattcctgcataaaaccttagtttgaggggaataatgctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaaaaaaaaaaaaa

SEQ ID NO: 177 - DNA, 5831 bp, Mus musculus
ctcgctccctctgtttctgtactctgggtgactcagagagggaagattcagccagcacactgctcgcgagcaagtgtcactctgctaactggcagagccaggagacctagatgtccacacccacagacccagcagcaatgccccatcctgggccctccccggggcctggaccctctcctggaccaattctggggcctagtccaggaccaggaccatccccaggttctgtgcacagcatgatgggtcctagtcccggacctcccagcgtctcacatcctctgtcaacgatgggctctgcagacttcccacaggaaggcatgcaccaattacataagcccatggatgggatacatgacaaagggattgtagaagatgtccactgtggatccatgaagggcaccagcatgcgccccccacacccaggaatgggccctccacagagccccatggaccagcacagccaaggttatatgtcaccacatccgtctcctctgggagccccggagcacgtctctagccctatatctggaggaggcccaaccccaccccagatgccaccgagccagccaggggcactcatcccaggagatccgcaggccatgaaccagcctaacagaggtccctcgcctttcagtcctgtgcagctgcatcagcttcgagctcagattttagcttacaaaatgttggccaggggccagcctctccctgaaactctgcagctggcagtccagggaaaaaggaccttgcctggcatgcagcagcagcagcagcaacaacaacaacagcagcagcagcagcagcagcagcagcagcaacagcagcaacaacagcagccccagcagcctcagcagcaggctcaggcacagccccagcagcagcagcaacagcagcagcagccagctcttgttagctataatcgaccatctggccccgggcaggagctgctactgagtggccagagcgctccgcagaagctgtcagcaccagcaccaagcggccgaccttcaccggcaccccaggccgccgtccagcccacggccacagcggtgcccgggccctccgtgcagcagcccgccccagggcagccgtctccggtcctacagctgcaacagaagcagagccgcatcagccccatccagaaaccgcaaggcctggacccggtggagatcctgcaggaacgagagtacagacttcaagctcgcatcgctcataggatacaagaactggaaagtctgcctggttccttgccaccagatttacgcaccaaagcaaccgtggaactgaaagcacttcgcttactcaacttccaacgtcagctgagacaggaggtggtggcctgcatgcggagggacaccaccctggagacggccctcaactccaaagcatataagcggagcaagcgccagaccctgcgtgaggcacgcatgacagagaaactggagaagcagcagaagatagaacaggagaggaaacgccggcagaaacaccaggaatacctgaacagtattttgcaacatgcaaaagattttaaggaatatcaccggtctgtggccgggaagatccagaagctctccaaagcagtggcgacttggcatgctaacacagaaagggagcagaagaaggagacggagcggatcgagaaggagagaatgcggaggctgatggccgaagatgaagagggctacaggaagcttattgaccaaaagaaagacagacgtctcgcctacctattgcagcagaccgatgagtatgtcgccaatctgaccaacctggtgtgggagcacaagcaggcccaagcagccaaagagaagaagaagaggaggaggaggaagaagaaggctgaagagaatgcagagggaggggaacctgccctgggaccagatggagagccaatagatgaaagcagccagatgagtgacctgcctgtcaaagtgacacacacagaaactggcaaggtcctctttggaccagaagcacccaaagcaagtcagctggatgcctggctggagatgaatcctggttacgaagttgcacccagatctgacagtgaagagagtgaatcggactacgaggaggaggatgaagaagaagagtccagtaggcaggaaaccgaggagaagatactgctggatcccaacagtgaagaagtttccgaaaaggatgccaagcagatcattgagactgcgaagcaggacgtggacgacgaatacagcatgcagtacagtgccagaggctctcagtcctactacacggtggctcacgctatctctgagagggtggagaagcagtctgccctcctcattaacggcaccctaaagcattaccagctccagggcctggaatggatggtttccctgtataataacaatctgaacggaatcttagctgatgaaatggggctaggcaagaccatccagaccattgcactcatcacgtatctgatggagcacaaaaggctcaatggtccctacctcatcatcgtccccctctcgactctgtctaactggacatatgaatttgacaaatgggctccttctgtggtgaaaatttcttacaagggtacccctgccatgcgacgctccctcgttccccagctacggagtggcaaattcaatgtcctcctgactacttacgagtacattataaaagacaagcacattcttgcaaagattcggtggaagtacatgatcgtggacgaaggccaccggatgaagaatcaccactgcaagctaacccaggtcctgaacacacactatgtggcccccaggcggatccttctgactgggaccccactgcagaataagcttccggaactctgggccctcctcaacttcctcctccctacaatcttcaagagttgcagcacatttgagcagtggtttaatgctccatttgccatgaccggtgaaagggtggacctgaacgaagaagaaacgattttgatcatcaggcgtctacacaaggtgctgagaccctttttactgaggaggctgaagaaagaggttgagtctcagcttccggaaaaggttgagtatgtgatcaagtgtgacatgtcagctctgcagaagattctgtaccgtcacatgcaagccaaggggatcctcctcacggacgggtctgagaaagataagaaggggaaaggaggtgccaagacacttatgaacaccatcatgcagctgagaaaaatatgcaaccacccatatatgtttcagcacattgaggaatcctttgctgaacacctgggctattcgaatggggtcatcaatggggctgagctgtatcgggcctcgggaaagtttgagctgcttgatcgtattctgcccaaattgagagcgactaaccaccgcgtgctgcttttctgccagatgacgtcactcatgaccattatggaggattactttgcttttcggaacttcctgtacctgcgccttgacggcaccaccaagtctgaagatcgtgctgctttgctaaagaaattcaatgaacctgggtcccagtatttcattttcttgctgagcacaagagcagggggcctgggcttaaatcttcaggcggcagacacggtggtcatatttgacagcgactggaatcctcaccaggatctgcaggcccaagaccgagctcaccgcattggccaacaaaacgaggtccgggtgctgaggctttgcaccgtcaacagtgtggaggaaaagattctcgcggctgccaagtacaagctgaacgtggatcagaaggttatccaagcaggcatgtttgaccagaagtcatccagccacgagcggagggccttcctgcaggccattctggagcacgaggaggagaatgaggaagaagatgaggtaccagacgacgagaccctgaaccagatgattgctcgccgggaggaagaatttgatctttttatgcgcatggacatggaccggcggagggaggatgcccggaacccgaagcgcaaaccccgcttgatggaggaagatgagctgccctcctggattatcaaggatgacgccgaagtggaaaggctcacctgtgaagaagaggaggagaagatatttgggaggggctctcgccagcgccgggatgtggactacagtgatgccctcaccgagaagcaatggctcagggccatcgaagacggcaatttggaagaaatggaagaggaggtacggcttaagaagagaaaaagacgaagaaatgtggataaagaccccgtgaaggaagatgtggaaaaagcgaagaaaagaagaggccgccctccggctgagaagttgtcaccaaatcccccaaaactaacgaagcagatgaacgccatcattgatactgtgataaactacaaagacagttcagggcgacagctcagtgaagtcttcattcagttaccttccaggaaagacttaccagaatactatgaattaattaggaagccagtggatttcaaaaagataaaggagcgaatccgtaatcataagtatcggagcctgggagacctggagaaagacgtcatgcttctctgtcacaacgcacagacattcaacttggaaggatcccagatctacgaagactccattgtcctacagtcagtgtttaagagtgctcggcagaaaattgccaaagaagaagagagtgaggaagaaagcaatgaagaagaggaagaagatgatgaagaggagtcggagtcagaggcgaaatctgtgaaggtgaaaatcaagctgaataaaaaggaagagaaaggccgggacacagggaagggcaagaagcggccaaaccgaggcaaagccaaacccgtcgtgagcgattttgacagtgacgaggaacaggaagagaacgaacagtcagaagcaagtggaactgataacgagtgaccatcctggacgtgagcttcccgcggtggcagaaccgaatgctttcttccccctctccttcctccccagtgagttcacttgccattcgggcacactgggttatttctccgtcctcattgtcatctagaactagctttagggtagtgccagacaaacatatgatatcatggtgtaaaaaaagaaacacatgcgtgcagacacactacacacacacacacacacacacacacacacacacacacatatttgtaacatattgtgaccaaatgggcctcaaagattcaaagattaaaaacaaaaagcttttgatggaaaagatgtgggtggatagtatatttctacaggtgggtcaggtttggtagcagtttgatgtgctgggttctgtcatctgttctgatgagaagatttttatcttctgcagtgctgatggccgggaggaaccattcaaagccactggttattttgtttttcatcaggcgattttcaagattttcatttgtttcagtattgttggttttctcttttctcttttttacactgtggtacatataagcaacttgactagtgacaaatgtacagtagttagatatcacctacatatacatttttccattttatgctctatgatctgaagaacaaaaaaaaaagctttttgacttgtataagatttatgtctactgtaaacattgcggaatttttttttgttcttgttttattgacaatgctattgagtattacagtgtctagaataccctggatggcttctcttgtccacccgatctcccgtgttaccaatgtgtatggtctccttctcccgaaagtgtacttaatctttgctttctttgcacaatgtctttggttgcaagtcataagcctgaggcaaataaaattccagtaatttccaagaatgtggtgttggtactttcctaataaaccgataacgtaccttgaaaaaaaaaaaaaaaaaaa

SEQ ID NO: 178 - protein, 1583 aa, Mus musculus
MSTPTDPAAMPHPGPSPGPGPSPGPILGPSPGPGPSPGSVHSMMGPSPGPPSVSHPLSTMGSADFPQEGMHQLHKPMDGIHDKGIVEDVHCGSMKGTSMRPPHPGMGPPQSPMDQHSQGYMSPHPSPLGAPEHVSSPISGGGPTPPQMPPSQPGALIPGDPQAMNQPNRGPSPFSPVQLHQLRAQILAYKMLARGQPLPETLQLAVQGKRTLPGMQQQQQQQQQQQQQQQQQQQQQQQQQQPQQPQQQAQAQPQQQQQQQQQPALVSYNRPSGPGQELLLSGQSAPQKLSAPAPSGRPSPAPQAAVQPTATAVPGPSVQQPAPGQPSPVLQLQQKQSRISPIQKPQGLDPVEILQEREYRLQARIAHRIQELESLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGEPALGPDGEPIDESSQMSDLPVKVTHTETGKVLFGPEAPKASQLDAWLEMNPGYEVAPRSDSEESESDYEEEDEEEESSRQETEEKILLDPNSEEVSEKDAKQIIETAKQDVDDEYSMQYSARGSQSYYTVAHAISERVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPVKEDVEKAKKRRGRPPAEKLSPNPPKLTKQMNAIIDTVINYKDSSGRQLSEVFIQLPSRKDLPEYYELIRKPVDFKKIKERIRNHKYRSLGDLEKDVMLLCHNAQTFNLEGSQIYEDSIVLQSVFKSARQKIAKEEESEEESNEEEEEDDEEESESEAKSVKVKIKLNKKEEKGRDTGKGKKRPNRGKAKPVVSDFDSDEEQEENEQSEASGTDNE

SEQ ID NO: 179 - DNA, 1964 bp, Mus musculus
ttcacttcattaaatctagaggcggttcagcatgggagccgtctgtatgttgaattagggctcgctctcttgcgcaacacgtcaccagtcggaaactgggggtttgcttctgtgatttatttcattattgtgctggtaaaagctgatgaagagactagcagctcgctgctttgccggcttgttaattttatccccactaactgtgatttccgatagccggcctgctgatagtggtaagtgcggctggctctggtttaaagcaagcgtttgcaggccatcgaagacggcaatttggaagaaatggaagaggaggtacggcttaagaagagaaaaagacgaagaaatgtggataaagaccccgtgaaggaagatgtggaaaaagcgaagaaaagaagaggccgccctccggctgagaagttgtcaccaaatcccccaaaactaacgaagcagatgaacgccatcattgatactgtgataaactacaaagacagttcagggcgacagctcagtgaagtcttcattcagttaccttccaggaaagacttaccagaatactatgaattaattaggaagccagtggatttcaaaaagataaaggagcgaatccgtaatcataagtatcggagcctgggagacctggagaaagacgtcatgcttctctgtcacaacgcacagacattcaacttggaaggatcccagatctacgaagactccattgtcctacagtcagtgtttaagagtgctcggcagaaaattgccaaagaagaagagagtgaggaagaaagcaatgaagaagaggaagaagatgatgaagaggagtcggagtcagaggcgaaatctgtgaaggtgaaaatcaagctgaataaaaaggaagagaaaggccgggacacagggaagggcaagaagcggccaaaccgaggcaaagccaaacccgtcgtgagcgattttgacagtgacgaggaacaggaagagaacgaacagtcagaagcaagtggaactgataacgagtgaccatcctggacgtgagcttcccgcggtggcagaaccgaatgctttcttccccctctccttcctccccagtgagttcacttgccattcgggcacactgggttatttctccgtcctcattgtcatctagaactagctttagggtagtgccagacaaacatatgatatcatggtgtaaaaaaagaaacacatgcgtgcagacacactacacacacacacacacacacacacacacacacacacacatatttgtaacatattgtgaccaaatgggcctcaaagattcaaagattaaaaacaaaaagcttttgatggaaaagatgtgggtggatagtatatttctacaggtgggtcaggtttggtagcagtttgatgtgctgggttctgtcatctgttctgatgagaagatttttatcttctgcagtgctgatggccgggaggaaccattcaaagccactggttattttgtttttcatcaggcgattttcaagattttcatttgtttcagtattgttggttttctcttttctcttttttacactgtggtacatataagcaacttgactagtgacaaatgtacagtagttagatatcacctacatatacatttttccattttatgctctatgatctgaagaacaaaaaaaaaagctttttgacttgtataagatttatgtctactgtaaacattgcggaatttttttttgttcttgttttattgacaatgctattgagtattacagtgtctagaataccctggatggcttctcttgtccacccgatctcccgtgttaccaatgtgtatggtctccttctcccgaaagtgtacttaatctttgctttctttgcacaatgtctttggttgcaagtcataagcctgaggcaaataaaattccagtaatttccaagaatgtggtgttggtactttcctaataaaccgataacgtaccttgaaa

SEQ ID NO: 180 - protein, 236 aa, Mus musculus
MEEEVRLKKRKRRRNVDKDPVKEDVEKAKKRRGRPPAEKLSPNPPKLTKQMNAIIDTVINYKDSSGRQLSEVFIQLPSRKDLPEYYELIRKPVDFKKIKERIRNHKYRSLGDLEKDVMLLCHNAQTFNLEGSQIYEDSIVLQSVFKSARQKIAKEEESEEESNEEEEEDDEEESESEAKSVKVKIKLNKKEEKGRDTGKGKKRPNRGKAKPVVSDFDSDEEQEENEQSEASGTDNE

SEQ ID NO: 181 - DNA, 1979 bp, Mus musculus
acacacacacacacacacacacgcaggctgaagtatgcttaactcttttaacttggctggggctttttagcaccatatgggttctttcgtgacgtccggacccgaaagagtgcagtgtgcctttaaggaaagaggtacctcaccaaacttccctgtagttgtgcctcaccatttagctgatgaagagactagcagctcgctgctttgccggcttgttaattttatccccactaactgtgatttccgatagccggcctgctgatagtggtaaggccatcgaagacggcaatttggaagaaatggaagaggaggtacggcttaagaagagaaaaagacgaagaaatgtggataaagaccccgtgaaggaagatgtggaaaaagcgaagaaaagaagaggccgccctccggctgagaagttgtcaccaaatcccccaaaactaacgaagcagatgaacgccatcattgatactgtgataaactacaaagacagttcagggcgacagctcagtgaagtcttcattcagttaccttccaggaaagacttaccagaatactatgaattaattaggaagccagtggatttcaaaaagataaaggagcgaatccgtaatcataagtatcggagcctgggagacctggagaaagacgtcatgcttctctgtcacaacgcacagacattcaacttggaaggatcccagatctacgaagactccattgtcctacagtcagtgtttaagagtgctcggcagaaaattgccaaagaagaagagagtgaggaagaaagcaatgaagaagaggaagaagatgatgaagaggagtcggagtcagaggcgaaatctgtgaaggtgaaaatcaagctgaataaaaaggaagagaaaggccgggacacagggaagggcaagaagcggccaaaccgaggcaaagccaaacccgtcgtgagcgattttgacagtgacgaggaacaggaagagaacgaacagtcagaagcaagtggaactgataacgagtgaccatcctggacgtgagcttcccgcggtggcagaaccgaatgctttcttccccctctccttcctccccagtgagttcacttgccattcgggcacactgggttatttctccgtcctcattgtcatctagaactagctttagggtagtgccagacaaacatatgatatcatggtgtaaaaaaagaaacacatgcgtgcagacacactacacacacacacacacacacacacacacacacacacacatatttgtaacatattgtgaccaaatgggcctcaaagattcaaagattaaaaacaaaaagcttttgatggaaaagatgtgggtggatagtatatttctacaggtgggtcaggtttggtagcagtttgatgtgctgggttctgtcatctgttctgatgagaagatttttatcttctgcagtgctgatggccgggaggaaccattcaaagccactggttattttgtttttcatcaggcgattttcaagattttcatttgtttcagtattgttggttttctcttttctcttttttacactgtggtacatataagcaacttgactagtgacaaatgtacagtagttagatatcacctacatatacatttttccattttatgctctatgatctgaagaacaaaaaaaaaagctttttgacttgtataagatttatgtctactgtaaacattgcggaatttttttttgttcttgttttattgacaatgctattgagtattacagtgtctagaataccctggatggcttctcttgtccacccgatctcccgtgttaccaatgtgtatggtctccttctcccgaaagtgtacttaatctttgctttctttgcacaatgtctttggttgcaagtcataagcctgaggcaaataaaattccagtaatttccaagaatgtggtgttggtactttcctaataaaccgataacgtaccttgaaaaaaaaaaaaaaaaaaa

SEQ ID NO: 182 - protein, 276 aa, Mus musculus
MKRLAARCFAGLLILSPLTVISDSRPADSGKAIEDGNLEEMEEEVRLKKRKRRRNVDKDPVKEDVEKAKKRRGRPPAEKLSPNPPKLTKQMNAIIDTVINYKDSSGRQLSEVFIQLPSRKDLPEYYELIRKPVDFKKIKERIRNHKYRSLGDLEKDVMLLCHNAQTFNLEGSQIYEDSIVLQSVFKSARQKIAKEEESEEESNEEEEEDDEEESESEAKSVKVKIKLNKKEEKGRDTGKGKKRPNRGKAKPVVSDFDSDEEQEENEQSEASGTDNE

SEQ ID NO: 183 - protein, 1679 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKKITGKDIHDTASSVARGLQFQRGLQFCTRASKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 184 - DNA, 5589 bp, Homo sapiens
ggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaaaattacaggaaaagatatccatgacacagccagcagtgtggcacgtgggctacaattccagcgtggccttcagttctgcacacgtgcgtcaaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 185 - protein, 1647 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 186 - DNA, 5779 bp, Homo sapiens
ggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcgtctcgcccttttgcccaggctagagtgcagtggtgcggtcatggttcactgcagcctcaacctcctggactcagcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 187 - DNA, 5703 bp, Homo sapiens
ggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 188 - protein, 1617 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKTLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 189 - DNA, 5329 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 190 - protein, 1616 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKTLKAIEEGTLEEIEEEVRQKKSSRKRKRDSDAGSSTPTTSTRSRDKDDESKKQKKRGRPPAEKLSPNPPNLTKKMKKIVDAVIKYKDSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 191 - DNA, 5326 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaagaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 192 - protein, 1614 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 193 - DNA, 5320 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 194 - protein, 1613 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 195 - DNA, 5317 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 196 - DNA, 6376 bp, Mus musculus
ggcaagtggagcgggtagacagggaggcgggggcgcgcggcgggcgcgtgcggtgggggggggtggcctggcgaagcccagcgggcgcgcgcgcgaggctttcccactcgcttggcagcggcggagacggcttctttgtttcctgaggagaagcgagacgcccactctgtccccgacccctcgtggagggttgggggcggcgccaggaaggttacggcgccgttacctccaggagaccagtgcctgtagctccagtaaagatgtctactccagacccacccttgggtgggactcctcggcctggtccttccccaggccctggtccttcacctggtgcaatgctgggtcctagccctggcccctcaccaggttctgcccacagcatgatggggccaagcccaggacctccttcagcaggacatcccatgcccacccaggggcctggagggtacccccaggacaacatgcatcagatgcacaagcctatggagtccatgcacgagaagggcatgcctgatgacccacgatacaaccagatgaaagggatgggcatgcggtcaggggcccacacaggcatggcacctccacctagtcccatggaccagcattctcaaggttacccctcacccctcggcggctctgaacatgcctccagtcctgtcccagccagtggcccatcttcaggcccccagatgtcctctgggccaggaggggccccactagatggttctgatccccaggccttgggacagcaaaacagaggcccaaccccatttaaccagaaccagctgcatcaactcagagctcagataatggcctacaagatgttggccaggggccagccattgcccgaccacctgcagatggccgtgcaaggcaagcggccgatgcctggaatgcagcaacagatgccaacactacctccaccctcagtgtccgccacaggacccggacctggacccggccctggccctggccctggcccaggaccagcccctccaaattacagtagaccccatggtatgggagggcccaacatgcctcccccaggaccctcaggtgtgccccccgggatgcctggtcagccgcctggagggcctcccaagccatggcctgaaggacccatggccaatgctgctgcccccacaagcaccccacagaagctgattcctccgcaaccaacaggccgtccttcacctgcacctcctgctgtcccgcctgctgcctcacctgtaatgccaccacaaacacagtccccagggcagccagcccagcctgctccattggtgccactgcaccagaagcagagccgaatcacccccatccagaagccccgaggccttgaccctgtggagatcctacaagagcgggagtacaggcttcaggctcgaatcgcacacagaattcaggaacttgaaaacctccctgggtccctggctggggaccttcgaaccaaagcaaccatcgaactcaaggcccttaggttgctgaacttccagaggcagctgcgccaggaggtggtggtgtgcatgcgaagagacacagccctggagacagccctcaatgccaaggcctacaagcgcagcaaacgtcagtcactacgggaggcccgcatcactgagaagttggagaagcagcagaagattgaacaggagcgcaagcgccgccagaagcaccaggagtacctcaacagcattctgcagcatgccaaggacttcagggagtatcacagatcagtcacaggcaaactccagaaactcaccaaggctgtggccacctaccatgccaacactgagcgggagcagaagaaagaaaatgagcgcattgagaaggagcgaatgcggaggcttatggctgaagatgaggagggctaccgcaaactcattgaccagaagaaggacaagcgcctggcctaccttctgcagcagacagatgagtatgtggccaacctcacagagctggtgcggcagcacaaagctgcccaggttgccaaggagaagaagaagaaaaagaaaaagaagaaggcagaaaatgctgaaggacagacacctgctattggaccagatggtgagcctctggatgagaccagccagatgagtgacctccctgtgaaggtgatccacgtggagagtggcaagatcctcactggcacagatgccccaaaagccgggcagctggaagcctggcttgaaatgaacccagggtatgaagtagcccccaggtcagacagtgaagaaagtggctctgaagaggaggaggaggaggaggaagaggagcagcctcagcccgcacagccccctacactgcctgtggaagaaaagaagaagattccagacccagacagcgatgatgtctctgaggtggacgcccgacacattattgagaacgccaagcaagatgtggacgatgagtacggtgtgtcccaggcccttgctcgtggcctgcagtcttactatgctgtggcccatgcagtcacagagagagtagataagcagtccgccctcatggtcaacggtgtcctcaaacagtaccagatcaagggtttggagtggctggtgtccctgtacaacaacaacctgaatggcatcctggctgatgagatggggctggggaagaccatccagaccatcgcgctcatcacatacctcatggagcacaagcgcatcaacgggcctttcctcatcatcgtgcctctctcgacactgtcaaactgggcgtatgaatttgacaagtgggccccctctgtggtgaaggtttcttacaagggctctccagctgcaaggcgagcttttgtcccacagcttcgcagtgggaagttcaacgtcttactgaccacctatgaatatatcatcaaagacaagcatatcctagccaagatccgctggaagtacatgattgtggatgaaggccaccgcatgaaaaaccaccactgcaagttgacgcaggtccttaacacacactacgtggcccctcggcgcctgcttcttacaggcacaccactgcagaacaagctaccggagctctgggccctgcttaacttcctgctccccactatcttcaagagctgcagcaccttcgaacagtggttcaatgcaccctttgccatgactggagaaaaggtggacctgaatgaagaggagactatcctcattattcgtcgcctacacaaagttctgcggcccttcctgctgcggcggctcaagaaggaagttgaagcccagctccctgagaaggtagagtatgtcatcaaatgcgacatgtcagccctgcagcgtgtgctgtaccgtcacatgcaggccaaaggtgtgctgctgactgacggctccgagaaggacaagaagggcaaaggtggcaccaagacactgatgaacactattatgcaactgcgtaagatctgcaaccacccctacatgttccagcacatcgaggagtccttttctgagcacttggggttcaccggcggcatcgtgcaaggattggacctttaccgtgcctcagggaaatttgaacttcttgatagaattctacccaaactccgtgcaacgaaccataaagtgctcctcttttgccaaatgacctccctcatgaccatcatggaagactactttgcataccgtggcttcaaatacctcaggcttgatggaaccacaaaagcagaagaccggggcatgctgttgaaaacctttaatgaacctggctctgagtatttcattttcctgctcagtacccgtgctggggggctgggcctgaatctgcagtcagctgacactgtgatcatctttgacagtgactggaatccccaccaggacctgcaagcacaggatcgagcccatcgcattggacagcagaatgaggtgcgtgttcttcgcctgtgcacggtcaacagtgtggaagagaagatactggctgctgccaaatacaaactcaatgtggatcagaaggtgatccaggcaggcatgttcgaccagaagtcgtccagccatgagaggcgtgccttcctgcaggccatcctggagcacgaggagcaggatgaggaggaagatgaggtgcctgatgatgagaccgtcaaccagatgattgcccggcacgaagaagagtttgacctcttcatgcgcatggacttggaccgccggcgtgaagaagcccgcaaccccaagcggaagccacgcctgatggaagaggatgagctcccatcctggatcatcaaggatgatgccgaggtggagcggctgacatgtgaagaggaagaggagaagatgttcggccgtggttctcgccaccgcaaggaggtagactacagcgactcactgacagagaagcagtggctcaagaccctgaaggctatcgaggagggcacgctggaggagatcgaagaggaggtccggcagaagaaatcttcacgtaagcgtaagcgagacagcgaggccggctcctccaccccgaccaccagcacccgcagccgtgacaaggatgaggagagcaagaagcagaagaaacgtgggcggccacctgctgagaagctgtccccaaacccacctaacctcaccaagaagatgaagaagatcgtggatgctgtgatcaagtacaaagacagcagcagtggacgtcagctcagcgaggtgttcatccagctcccctctcgcaaggagcttcctgagtactatgagctcatccgaaagcctgtggacttcaagaagatcaaggaacgcatccgaaaccacaagtaccgcagcctcaatgacctggagaaggatgtgatgctgctgtgccagaacgctcagacgttcaacctcgagggttccctgatctatgaggactccatcgtcctgcagtctgtcttcaccagcgtacggcagaagattgagaaggaggacgacagtgaaggcgaggaaagcgaggaggaggaggagggcgaggaggaaggctccgagtctgagtcccgctccgtcaaggtgaagatcaagctgggccgcaaggagaaggcccaggaccgactcaaggggggccgccggcggccaagccggggatcccgggccaagccggttgtgagtgacgatgacagtgaggaggagcaggaggaggaccgctcaggaagtggcagtgaggaagactgaaccagacattcctgagtcctgaccccgaggcgctcgtcccagccaagatggagtagcccttagcagtgatgggtagcaccagatgtagtttcgaacttggagaactgtacacatgcaatcttccacatttttaggcagagaagtataggcctgtctgtcggccctggcctggcctcgagtctctaccagcattaactgtctagagaggggacctcctgggagcaccatccacctccccaggccccagtcactgtagctcagtggatgcatgcgcgtgccggccgctccttgtactgtatcttactggacagggccagctctccaggaggctcacaggcccagcgggtatgtcagtgtcactggagtcagacagtaataaattaaagcaatgacaagccaccactggctccctggactccttgctgtcagcagtggctccggggccacagagaagaaagaaagacttttaggaactgggtctaacttatgggcaaagtacttgccttgccaggtgtatgggttttgcattcccatcacccacacaccctaaacaagccaagtcagtgagcttcaagttagagcctccacctcaatgtgtacgtggaaagcaatcaaagatgatgcctagcatccacctctggccctcatgtgcagatgtacacacactgaattacatacacgggacacacacatccacacggaggcagtccatgacttgcactggggagatggtaccataggcgaaagtgccacaggcacagggccaggctaatttagtcctgcagtcctgtgctcttaagatgaaggcacaaagaggaaccccaggcgctccaactagcatgccaggcagtgacaagaccctgcttcaaatgaatcagagcccacattcagtattgccctcttacccgatgcgatgcccatgccctcacatatgaatgtgtatatatacatacatacgtaaaataattcttttttaaattatagacatttttgtgtgaatgttttgcctgaatgtgtgtgtgtgtgtgtgtgtgtgtgtgtgtgtgtgtgtgtgtgtatcaagtacattcctagagcctacagaggtcaagggagggcattggatctggaactggagtcacatgaggctgtgagcaactgtgtgggttcctgggcctttgcaacagcagttagtactcttcaccactgagccatttctccaatctcaaaaagaagcattcttttaaatgaagactgaaataaataagtaggacttgccttgg

SEQ ID NO: 197 - protein, 1617 aa, Mus musculus
MSTPDPPLGGTPRPGPSPGPGPSPGAMLGPSPGPSPGSAHSMMGPSPGPPSAGHPMPTQGPGGYPQDNMHQMHKPMESMHEKGMPDDPRYNQMKGMGMRSGAHTGMAPPPSPMDQHSQGYPSPLGGSEHASSPVPASGPSSGPQMSSGPGGAPLDGSDPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPLVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFREYHRSVTGKLQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQPAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKTLKAIEEGTLEEIEEEVRQKKSSRKRKRDSEAGSSTPTTSTRSRDKDEESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 198 - DNA, 6367 bp, Mus musculus
ggcaagtggagcgggtagacagggaggcgggggcgcgcggcgggcgcgtgcggtgggggggggtggcctggcgaagcccagcgggcgcgcgcgcgaggctttcccactcgcttggcagcggcggagacggcttctttgtttcctgaggagaagcgagacgcccactctgtccccgacccctcgtggagggttgggggcggcgccaggaaggttacggcgccgttacctccaggagaccagtgcctgtagctccagtaaagatgtctactccagacccacccttgggtgggactcctcggcctggtccttccccaggccctggtccttcacctggtgcaatgctgggtcctagccctggcccctcaccaggttctgcccacagcatgatggggccaagcccaggacctccttcagcaggacatcccatgcccacccaggggcctggagggtacccccaggacaacatgcatcagatgcacaagcctatggagtccatgcacgagaagggcatgcctgatgacccacgatacaaccagatgaaagggatgggcatgcggtcaggggcccacacaggcatggcacctccacctagtcccatggaccagcattctcaaggttacccctcacccctcggcggctctgaacatgcctccagtcctgtcccagccagtggcccatcttcaggcccccagatgtcctctgggccaggaggggccccactagatggttctgatccccaggccttgggacagcaaaacagaggcccaaccccatttaaccagaaccagctgcatcaactcagagctcagataatggcctacaagatgttggccaggggccagccattgcccgaccacctgcagatggccgtgcaaggcaagcggccgatgcctggaatgcagcaacagatgccaacactacctccaccctcagtgtccgccacaggacccggacctggacccggccctggccctggccctggcccaggaccagcccctccaaattacagtagaccccatggtatgggagggcccaacatgcctcccccaggaccctcaggtgtgccccccgggatgcctggtcagccgcctggagggcctcccaagccatggcctgaaggacccatggccaatgctgctgcccccacaagcaccccacagaagctgattcctccgcaaccaacaggccgtccttcacctgcacctcctgctgtcccgcctgctgcctcacctgtaatgccaccacaaacacagtccccagggcagccagcccagcctgctccattggtgccactgcaccagaagcagagccgaatcacccccatccagaagccccgaggccttgaccctgtggagatcctacaagagcgggagtacaggcttcaggctcgaatcgcacacagaattcaggaacttgaaaacctccctgggtccctggctggggaccttcgaaccaaagcaaccatcgaactcaaggcccttaggttgctgaacttccagaggcagctgcgccaggaggtggtggtgtgcatgcgaagagacacagccctggagacagccctcaatgccaaggcctacaagcgcagcaaacgtcagtcactacgggaggcccgcatcactgagaagttggagaagcagcagaagattgaacaggagcgcaagcgccgccagaagcaccaggagtacctcaacagcattctgcagcatgccaaggacttcagggagtatcacagatcagtcacaggcaaactccagaaactcaccaaggctgtggccacctaccatgccaacactgagcgggagcagaagaaagaaaatgagcgcattgagaaggagcgaatgcggaggcttatggctgaagatgaggagggctaccgcaaactcattgaccagaagaaggacaagcgcctggcctaccttctgcagcagacagatgagtatgtggccaacctcacagagctggtgcggcagcacaaagctgcccaggttgccaaggagaagaagaagaaaaagaaaaagaagaaggcagaaaatgctgaaggacagacacctgctattggaccagatggtgagcctctggatgagaccagccagatgagtgacctccctgtgaaggtgatccacgtggagagtggcaagatcctcactggcacagatgccccaaaagccgggcagctggaagcctggcttgaaatgaacccagggtatgaagtagcccccaggtcagacagtgaagaaagtggctctgaagaggaggaggaggaggaggaagaggagcagcctcagcccgcacagccccctacactgcctgtggaagaaaagaagaagattccagacccagacagcgatgatgtctctgaggtggacgcccgacacattattgagaacgccaagcaagatgtggacgatgagtacggtgtgtcccaggcccttgctcgtggcctgcagtcttactatgctgtggcccatgcagtcacagagagagtagataagcagtccgccctcatggtcaacggtgtcctcaaacagtaccagatcaagggtttggagtggctggtgtccctgtacaacaacaacctgaatggcatcctggctgatgagatggggctggggaagaccatccagaccatcgcgctcatcacatacctcatggagcacaagcgcatcaacgggcctttcctcatcatcgtgcctctctcgacactgtcaaactgggcgtatgaatttgacaagtgggccccctctgtggtgaaggtttcttacaagggctctccagctgcaaggcgagcttttgtcccacagcttcgcagtgggaagttcaacgtcttactgaccacctatgaatatatcatcaaagacaagcatatcctagccaagatccgctggaagtacatgattgtggatgaaggccaccgcatgaaaaaccaccactgcaagttgacgcaggtccttaacacacactacgtggcccctcggcgcctgcttcttacaggcacaccactgcagaacaagctaccggagctctgggccctgcttaacttcctgctccccactatcttcaagagctgcagcaccttcgaacagtggttcaatgcaccctttgccatgactggagaaaaggtggacctgaatgaagaggagactatcctcattattcgtcgcctacacaaagttctgcggcccttcctgctgcggcggctcaagaaggaagttgaagcccagctccctgagaaggtagagtatgtcatcaaatgcgacatgtcagccctgcagcgtgtgctgtaccgtcacatgcaggccaaaggtgtgctgctgactgacggctccgagaaggacaagaagggcaaaggtggcaccaagacactgatgaacactattatgcaactgcgtaagatctgcaaccacccctacatgttccagcacatcgaggagtccttttctgagcacttggggttcaccggcggcatcgtgcaaggattggacctttaccgtgcctcagggaaatttgaacttcttgatagaattctacccaaactccgtgcaacgaaccataaagtgctcctcttttgccaaatgacctccctcatgaccatcatggaagactactttgcataccgtggcttcaaatacctcaggcttgatggaaccacaaaagcagaagaccggggcatgctgttgaaaacctttaatgaacctggctctgagtatttcattttcctgctcagtacccgtgctggggggctgggcctgaatctgcagtcagctgacactgtgatcatctttgacagtgactggaatccccaccaggacctgcaagcacaggatcgagcccatcgcattggacagcagaatgaggtgcgtgttcttcgcctgtgcacggtcaacagtgtggaagagaagatactggctgctgccaaatacaaactcaatgtggatcagaaggtgatccaggcaggcatgttcgaccagaagtcgtccagccatgagaggcgtgccttcctgcaggccatcctggagcacgaggagcaggatgaggaggaagatgaggtgcctgatgatgagaccgtcaaccagatgattgcccggcacgaagaagagtttgacctcttcatgcgcatggacttggaccgccggcgtgaagaagcccgcaaccccaagcggaagccacgcctgatggaagaggatgagctcccatcctggatcatcaaggatgatgccgaggtggagcggctgacatgtgaagaggaagaggagaagatgttcggccgtggttctcgccaccgcaaggaggtagactacagcgactcactgacagagaagcagtggctcaaggctatcgaggagggcacgctggaggagatcgaagaggaggtccggcagaagaaatcttcacgtaagcgtaagcgagacagcgaggccggctcctccaccccgaccaccagcacccgcagccgtgacaaggatgaggagagcaagaagcagaagaaacgtgggcggccacctgctgagaagctgtccccaaacccacctaacctcaccaagaagatgaagaagatcgtggatgctgtgatcaagtacaaagacagcagcagtggacgtcagctcagcgaggtgttcatccagctcccctctcgcaaggagcttcctgagtactatgagctcatccgaaagcctgtggacttcaagaagatcaaggaacgcatccgaaaccacaagtaccgcagcctcaatgacctggagaaggatgtgatgctgctgtgccagaacgctcagacgttcaacctcgagggttccctgatctatgaggactccatcgtcctgcagtctgtcttcaccagcgtacggcagaagattgagaaggaggacgacagtgaaggcgaggaaagcgaggaggaggaggagggcgaggaggaaggctccgagtctgagtcccgctccgtcaaggtgaagatcaagctgggccgcaaggagaaggcccaggaccgactcaaggggggccgccggcggccaagccggggatcccgggccaagccggttgtgagtgacgatgacagtgaggaggagcaggaggaggaccgctcaggaagtggcagtgaggaagactgaaccagacattcctgagtcctgaccccgaggcgctcgtcccagccaagatggagtagcccttagcagtgatgggtagcaccagatgtagtttcgaacttggagaactgtacacatgcaatcttccacatttttaggcagagaagtataggcctgtctgtcggccctggcctggcctcgagtctctaccagcattaactgtctagagaggggacctcctgggagcaccatccacctccccaggccccagtcactgtagctcagtggatgcatgcgcgtgccggccgctccttgtactgtatcttactggacagggccagctctccaggaggctcacaggcccagcgggtatgtcagtgtcactggagtcagacagtaataaattaaagcaatgacaagccaccactggctccctggactccttgctgtcagcagtggctccggggccacagagaagaaagaaagacttttaggaactgggtctaacttatgggcaaagtacttgccttgccaggtgtatgggttttgcattcccatcacccacacaccctaaacaagccaagtcagtgagcttcaagttagagcctccacctcaatgtgtacgtggaaagcaatcaaagatgatgcctagcatccacctctggccctcatgtgcagatgtacacacactgaattacatacacgggacacacacatccacacggaggcagtccatgacttgcactggggagatggtaccataggcgaaagtgccacaggcacagggccaggctaatttagtcctgcagtcctgtgctcttaagatgaaggcacaaagaggaaccccaggcgctccaactagcatgccaggcagtgacaagaccctgcttcaaatgaatcagagcccacattcagtattgccctcttacccgatgcgatgcccatgccctcacatatgaatgtgtatatatacatacatacgtaaaataattcttttttaaattatagacatttttgtgtgaatgttttgcctgaatgtgtgtgtgtgtgtgtgtgtgtgtgtgtgtgtgtgtgtgtgtgtatcaagtacattcctagagcctacagaggtcaagggagggcattggatctggaactggagtcacatgaggctgtgagcaactgtgtgggttcctgggcctttgcaacagcagttagtactcttcaccactgagccatttctccaatctcaaaaagaagcattcttttaaatgaagactgaaataaataagtaggacttgccttgg

SEQ ID NO: 199 - protein, 1614 aa, Mus musculus
MSTPDPPLGGTPRPGPSPGPGPSPGAMLGPSPGPSPGSAHSMMGPSPGPPSAGHPMPTQGPGGYPQDNMHQMHKPMESMHEKGMPDDPRYNQMKGMGMRSGAHTGMAPPPSPMDQHSQGYPSPLGGSEHASSPVPASGPSSGPQMSSGPGGAPLDGSDPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPLVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFREYHRSVTGKLQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQPAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSEAGSSTPTTSTRSRDKDEESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 200 - DNA, 6364 bp, Mus musculus
ggcaagtggagcgggtagacagggaggcgggggcgcgcggcgggcgcgtgcggtgggggggggtggcctggcgaagcccagcgggcgcgcgcgcgaggctttcccactcgcttggcagcggcggagacggcttctttgtttcctgaggagaagcgagacgcccactctgtccccgacccctcgtggagggttgggggcggcgccaggaaggttacggcgccgttacctccaggagaccagtgcctgtagctccagtaaagatgtctactccagacccacccttgggtgggactcctcggcctggtccttccccaggccctggtccttcacctggtgcaatgctgggtcctagccctggcccctcaccaggttctgcccacagcatgatggggccaagcccaggacctccttcagcaggacatcccatgcccacccaggggcctggagggtacccccaggacaacatgcatcagatgcacaagcctatggagtccatgcacgagaagggcatgcctgatgacccacgatacaaccagatgaaagggatgggcatgcggtcaggggcccacacaggcatggcacctccacctagtcccatggaccagcattctcaaggttacccctcacccctcggcggctctgaacatgcctccagtcctgtcccagccagtggcccatcttcaggcccccagatgtcctctgggccaggaggggccccactagatggttctgatccccaggccttgggacagcaaaacagaggcccaaccccatttaaccagaaccagctgcatcaactcagagctcagataatggcctacaagatgttggccaggggccagccattgcccgaccacctgcagatggccgtgcaaggcaagcggccgatgcctggaatgcagcaacagatgccaacactacctccaccctcagtgtccgccacaggacccggacctggacccggccctggccctggccctggcccaggaccagcccctccaaattacagtagaccccatggtatgggagggcccaacatgcctcccccaggaccctcaggtgtgccccccgggatgcctggtcagccgcctggagggcctcccaagccatggcctgaaggacccatggccaatgctgctgcccccacaagcaccccacagaagctgattcctccgcaaccaacaggccgtccttcacctgcacctcctgctgtcccgcctgctgcctcacctgtaatgccaccacaaacacagtccccagggcagccagcccagcctgctccattggtgccactgcaccagaagcagagccgaatcacccccatccagaagccccgaggccttgaccctgtggagatcctacaagagcgggagtacaggcttcaggctcgaatcgcacacagaattcaggaacttgaaaacctccctgggtccctggctggggaccttcgaaccaaagcaaccatcgaactcaaggcccttaggttgctgaacttccagaggcagctgcgccaggaggtggtggtgtgcatgcgaagagacacagccctggagacagccctcaatgccaaggcctacaagcgcagcaaacgtcagtcactacgggaggcccgcatcactgagaagttggagaagcagcagaagattgaacaggagcgcaagcgccgccagaagcaccaggagtacctcaacagcattctgcagcatgccaaggacttcagggagtatcacagatcagtcacaggcaaactccagaaactcaccaaggctgtggccacctaccatgccaacactgagcgggagcagaagaaagaaaatgagcgcattgagaaggagcgaatgcggaggcttatggctgaagatgaggagggctaccgcaaactcattgaccagaagaaggacaagcgcctggcctaccttctgcagcagacagatgagtatgtggccaacctcacagagctggtgcggcagcacaaagctgcccaggttgccaaggagaagaagaagaaaaagaaaaagaagaaggcagaaaatgctgaaggacagacacctgctattggaccagatggtgagcctctggatgagaccagccagatgagtgacctccctgtgaaggtgatccacgtggagagtggcaagatcctcactggcacagatgccccaaaagccgggcagctggaagcctggcttgaaatgaacccagggtatgaagtagcccccaggtcagacagtgaagaaagtggctctgaagaggaggaggaggaggaggaagaggagcagcctcagcccgcacagccccctacactgcctgtggaagaaaagaagaagattccagacccagacagcgatgatgtctctgaggtggacgcccgacacattattgagaacgccaagcaagatgtggacgatgagtacggtgtgtcccaggcccttgctcgtggcctgcagtcttactatgctgtggcccatgcagtcacagagagagtagataagcagtccgccctcatggtcaacggtgtcctcaaacagtaccagatcaagggtttggagtggctggtgtccctgtacaacaacaacctgaatggcatcctggctgatgagatggggctggggaagaccatccagaccatcgcgctcatcacatacctcatggagcacaagcgcatcaacgggcctttcctcatcatcgtgcctctctcgacactgtcaaactgggcgtatgaatttgacaagtgggccccctctgtggtgaaggtttcttacaagggctctccagctgcaaggcgagcttttgtcccacagcttcgcagtgggaagttcaacgtcttactgaccacctatgaatatatcatcaaagacaagcatatcctagccaagatccgctggaagtacatgattgtggatgaaggccaccgcatgaaaaaccaccactgcaagttgacgcaggtccttaacacacactacgtggcccctcggcgcctgcttcttacaggcacaccactgcagaacaagctaccggagctctgggccctgcttaacttcctgctccccactatcttcaagagctgcagcaccttcgaacagtggttcaatgcaccctttgccatgactggagaaaaggtggacctgaatgaagaggagactatcctcattattcgtcgcctacacaaagttctgcggcccttcctgctgcggcggctcaagaaggaagttgaagcccagctccctgagaaggtagagtatgtcatcaaatgcgacatgtcagccctgcagcgtgtgctgtaccgtcacatgcaggccaaaggtgtgctgctgactgacggctccgagaaggacaagaagggcaaaggtggcaccaagacactgatgaacactattatgcaactgcgtaagatctgcaaccacccctacatgttccagcacatcgaggagtccttttctgagcacttggggttcaccggcggcatcgtgcaaggattggacctttaccgtgcctcagggaaatttgaacttcttgatagaattctacccaaactccgtgcaacgaaccataaagtgctcctcttttgccaaatgacctccctcatgaccatcatggaagactactttgcataccgtggcttcaaatacctcaggcttgatggaaccacaaaagcagaagaccggggcatgctgttgaaaacctttaatgaacctggctctgagtatttcattttcctgctcagtacccgtgctggggggctgggcctgaatctgcagtcagctgacactgtgatcatctttgacagtgactggaatccccaccaggacctgcaagcacaggatcgagcccatcgcattggacagcagaatgaggtgcgtgttcttcgcctgtgcacggtcaacagtgtggaagagaagatactggctgctgccaaatacaaactcaatgtggatcagaaggtgatccaggcaggcatgttcgaccagaagtcgtccagccatgagaggcgtgccttcctgcaggccatcctggagcacgaggagcaggatgaggaggaagatgaggtgcctgatgatgagaccgtcaaccagatgattgcccggcacgaagaagagtttgacctcttcatgcgcatggacttggaccgccggcgtgaagaagcccgcaaccccaagcggaagccacgcctgatggaagaggatgagctcccatcctggatcatcaaggatgatgccgaggtggagcggctgacatgtgaagaggaagaggagaagatgttcggccgtggttctcgccaccgcaaggaggtagactacagcgactcactgacagagaagcagtggctcaaggctatcgaggagggcacgctggaggagatcgaagaggaggtccggcagaagaaatcttcacgtaagcgtaagcgagacagcgaggccggctcctccaccccgaccaccagcacccgcagccgtgacaaggatgaggagagcaagaagcagaagaaacgtgggcggccacctgctgagaagctgtccccaaacccacctaacctcaccaagaagatgaagaagatcgtggatgctgtgatcaagtacaaagacagcagtggacgtcagctcagcgaggtgttcatccagctcccctctcgcaaggagcttcctgagtactatgagctcatccgaaagcctgtggacttcaagaagatcaaggaacgcatccgaaaccacaagtaccgcagcctcaatgacctggagaaggatgtgatgctgctgtgccagaacgctcagacgttcaacctcgagggttccctgatctatgaggactccatcgtcctgcagtctgtcttcaccagcgtacggcagaagattgagaaggaggacgacagtgaaggcgaggaaagcgaggaggaggaggagggcgaggaggaaggctccgagtctgagtcccgctccgtcaaggtgaagatcaagctgggccgcaaggagaaggcccaggaccgactcaaggggggccgccggcggccaagccggggatcccgggccaagccggttgtgagtgacgatgacagtgaggaggagcaggaggaggaccgctcaggaagtggcagtgaggaagactgaaccagacattcctgagtcctgaccccgaggcgctcgtcccagccaagatggagtagcccttagcagtgatgggtagcaccagatgtagtttcgaacttggagaactgtacacatgcaatcttccacatttttaggcagagaagtataggcctgtctgtcggccctggcctggcctcgagtctctaccagcattaactgtctagagaggggacctcctgggagcaccatccacctccccaggccccagtcactgtagctcagtggatgcatgcgcgtgccggccgctccttgtactgtatcttactggacagggccagctctccaggaggctcacaggcccagcgggtatgtcagtgtcactggagtcagacagtaataaattaaagcaatgacaagccaccactggctccctggactccttgctgtcagcagtggctccggggccacagagaagaaagaaagacttttaggaactgggtctaacttatgggcaaagtacttgccttgccaggtgtatgggttttgcattcccatcacccacacaccctaaacaagccaagtcagtgagcttcaagttagagcctccacctcaatgtgtacgtggaaagcaatcaaagatgatgcctagcatccacctctggccctcatgtgcagatgtacacacactgaattacatacacgggacacacacatccacacggaggcagtccatgacttgcactggggagatggtaccataggcgaaagtgccacaggcacagggccaggctaatttagtcctgcagtcctgtgctcttaagatgaaggcacaaagaggaaccccaggcgctccaactagcatgccaggcagtgacaagaccctgcttcaaatgaatcagagcccacattcagtattgccctcttacccgatgcgatgcccatgccctcacatatgaatgtgtatatatacatacatacgtaaaataattcttttttaaattatagacatttttgtgtgaatgttttgcctgaatgtgtgtgtgtgtgtgtgtgtgtgtgtgtgtgtgtgtgtgtgtgtatcaagtacattcctagagcctacagaggtcaagggagggcattggatctggaactggagtcacatgaggctgtgagcaactgtgtgggttcctgggcctttgcaacagcagttagtactcttcaccactgagccatttctccaatctcaaaaagaagcattcttttaaatgaagactgaaataaataagtaggacttgccttgg

SEQ ID NO: 201 - protein, 1613 aa, Mus musculus
MSTPDPPLGGTPRPGPSPGPGPSPGAMLGPSPGPSPGSAHSMMGPSPGPPSAGHPMPTQGPGGYPQDNMHQMHKPMESMHEKGMPDDPRYNQMKGMGMRSGAHTGMAPPPSPMDQHSQGYPSPLGGSEHASSPVPASGPSSGPQMSSGPGGAPLDGSDPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPLVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFREYHRSVTGKLQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQPAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDEEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSEAGSSTPTTSTRSRDKDEESKKQKKRGRPPAEKLSPNPPNLTKKMKKIVDAVIKYKDSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 202 - DNA, 6466 bp, Mus musculus
ggcaagtggagcgggtagacagggaggcgggggcgcgcggcgggcgcgtgcggtgggggggggtggcctggcgaagcccagcgggcgcgcgcgcgaggctttcccactcgcttggcagcggcggagacggcttctttgtttcctgaggagaagcgagacgcccactctgtccccgacccctcgtggagggttgggggcggcgccaggaaggttacggcgccgttacctccaggagaccagtgcctgtagctccagtaaagatgtctactccagacccacccttgggtgggactcctcggcctggtccttccccaggccctggtccttcacctggtgcaatgctgggtcctagccctggcccctcaccaggttctgcccacagcatgatggggccaagcccaggacctccttcagcaggacatcccatgcccacccaggggcctggagggtacccccaggacaacatgcatcagatgcacaagcctatggagtccatgcacgagaagggcatgcctgatgacccacgatacaaccagatgaaagggatgggcatgcggtcaggggcccacacaggcatggcacctccacctagtcccatggaccagcattctcaaggttacccctcacccctcggcggctctgaacatgcctccagtcctgtcccagccagtggcccatcttcaggcccccagatgtcctctgggccaggaggggccccactagatggttctgatccccaggccttgggacagcaaaacagaggcccaaccccatttaaccagaaccagctgcatcaactcagagctcagataatggcctacaagatgttggccaggggccagccattgcccgaccacctgcagatggccgtgcaaggcaagcggccgatgcctggaatgcagcaacagatgccaacactacctccaccctcagtgtccgccacaggacccggacctggacccggccctggccctggccctggcccaggaccagcccctccaaattacagtagaccccatggtatgggagggcccaacatgcctcccccaggaccctcaggtgtgccccccgggatgcctggtcagccgcctggagggcctcccaagccatggcctgaaggacccatggccaatgctgctgcccccacaagcaccccacagaagctgattcctccgcaaccaacaggccgtccttcacctgcacctcctgctgtcccgcctgctgcctcacctgtaatgccaccacaaacacagtccccagggcagccagcccagcctgctccattggtgccactgcaccagaagcagagccgaatcacccccatccagaagccccgaggccttgaccctgtggagatcctacaagagcgggagtacaggcttcaggctcgaatcgcacacagaattcaggaacttgaaaacctccctgggtccctggctggggaccttcgaaccaaagcaaccatcgaactcaaggcccttaggttgctgaacttccagaggcagctgcgccaggaggtggtggtgtgcatgcgaagagacacagccctggagacagccctcaatgccaaggcctacaagcgcagcaaacgtcagtcactacgggaggcccgcatcactgagaagttggagaagcagcagaagattgaacaggagcgcaagcgccgccagaagcaccaggagtacctcaacagcattctgcagcatgccaaggacttcagggagtatcacagatcagtcacaggcaaactccagaaactcaccaaggctgtggccacctaccatgccaacactgagcgggagcagaagaaagaaaatgagcgcattgagaaggagcgaatgcggaggcttatggctgaagatgaggagggctaccgcaaactcattgaccagaagaaggacaagcgcctggcctaccttctgcagcagacagatgagtatgtggccaacctcacagagctggtgcggcagcacaaagctgcccaggttgccaaggagaagaagaagaaaaagaaaaagaagaaggcagaaaatgctgaaggacagacacctgctattggaccagatggtgagcctctggatgagaccagccagatgagtgacctccctgtgaaggtgatccacgtggagagtggcaagatcctcactggcacagatgccccaaaagccgggcagctggaagcctggcttgaaatgaacccagggtatgaagtagcccccaggtcagacagtgaagaaagtggctctgaagaggaggaggaggaggaggaagaggagcagcctcagcccgcacagccccctacactgcctgtggaagaaaagaagaagattccagacccagacagcgatgatgtctctgaggtggacgcccgacacattattgagaacgccaagcaagatgtggacgatgagtacggtgtgtcccaggcccttgctcgtggcctgcagtcttactatgctgtggcccatgcagtcacagagagagtagataagcagtccgccctcatggtcaacggtgtcctcaaacagtaccagatcaagggtttggagtggctggtgtccctgtacaacaacaacctgaatggcatcctggctgatgagatggggctggggaagaccatccagaccatcgcgctcatcacatacctcatggagcacaagcgcatcaacgggcctttcctcatcatcgtgcctctctcgacactgtcaaactgggcgtatgaatttgacaagtgggccccctctgtggtgaaggtttcttacaagggctctccagctgcaaggcgagcttttgtcccacagcttcgcagtgggaagttcaacgtcttactgaccacctatgaatatatcatcaaagacaagcatatcctagccaagatccgctggaagtacatgattgtggatgaaggccaccgcatgaaaaaccaccactgcaagttgacgcaggtccttaacacacactacgtggcccctcggcgcctgcttcttacaggcacaccactgcagaacaagctaccggagctctgggccctgcttaacttcctgctccccactatcttcaagagctgcagcaccttcgaacagtggttcaatgcaccctttgccatgactggagaaaaggtggacctgaatgaagaggagactatcctcattattcgtcgcctacacaaagttctgcggcccttcctgctgcggcggctcaagaaggaagttgaagcccagctccctgagaaggtagagtatgtcatcaaatgcgacatgtcagccctgcagcgtgtgctgtaccgtcacatgcaggccaaaggtgtgctgctgactgacggctccgagaaggacaagaagggcaaaggtggcaccaagacactgatgaacactattatgcaactgcgtaagatctgcaaccacccctacatgttccagcacatcgaggagtccttttctgagcacttggggttcaccggcggcatcgtgcaaggattggacctttaccgtgcctcagggaaatttgaacttcttgatagaattctacccaaactccgtgcaacgaaccataaagtgctcctcttttgccaaatgacctccctcatgaccatcatggaagactactttgcataccgtggcttcaaatacctcaggcttgatggaaccacaaaagcagaagaccggggcatgctgttgaaaacctttaatgaacctggctctgagtatttcattttcctgctcagtacccgtgctggggggctgggcctgaatctgcagtcagctgacactgtgatcatctttgacagtgactggaatccccaccaggacctgcaagcacaggatcgagcccatcgcattggacagcagaatgaggtgcgtgttcttcgcctgtgcacggtcaacagtgtggaagagaagatactggctgctgccaaatacaaactcaatgtggatcagaaggtgatccaggcaggcatgttcgaccagaagtcgtccagccatgagaggcgtgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagatgaggtgcctgatgatgagaccgtcaaccagatgattgcccggcacgaagaagagtttgacctcttcatgcgcatggacttggaccgccggcgtgaagaagcccgcaaccccaagcggaagccacgcctgatggaagaggatgagctcccatcctggatcatcaaggatgatgccgaggtggagcggctgacatgtgaagaggaagaggagaagatgttcggccgtggttctcgccaccgcaaggaggtagactacagcgactcactgacagagaagcagtggctcaaggctatcgaggagggcacgctggaggagatcgaagaggaggtccggcagaagaaatcttcacgtaagcgtaagcgagacagcgaggccggctcctccaccccgaccaccagcacccgcagccgtgacaaggatgaggagagcaagaagcagaagaaacgtgggcggccacctgctgagaagctgtccccaaacccacctaacctcaccaagaagatgaagaagatcgtggatgctgtgatcaagtacaaagacagcagcagtggacgtcagctcagcgaggtgttcatccagctcccctctcgcaaggagcttcctgagtactatgagctcatccgaaagcctgtggacttcaagaagatcaaggaacgcatccgaaaccacaagtaccgcagcctcaatgacctggagaaggatgtgatgctgctgtgccagaacgctcagacgttcaacctcgagggttccctgatctatgaggactccatcgtcctgcagtctgtcttcaccagcgtacggcagaagattgagaaggaggacgacagtgaaggcgaggaaagcgaggaggaggaggagggcgaggaggaaggctccgagtctgagtcccgctccgtcaaggtgaagatcaagctgggccgcaaggagaaggcccaggaccgactcaaggggggccgccggcggccaagccggggatcccgggccaagccggttgtgagtgacgatgacagtgaggaggagcaggaggaggaccgctcaggaagtggcagtgaggaagactgaaccagacattcctgagtcctgaccccgaggcgctcgtcccagccaagatggagtagcccttagcagtgatgggtagcaccagatgtagtttcgaacttggagaactgtacacatgcaatcttccacatttttaggcagagaagtataggcctgtctgtcggccctggcctggcctcgagtctctaccagcattaactgtctagagaggggacctcctgggagcaccatccacctccccaggccccagtcactgtagctcagtggatgcatgcgcgtgccggccgctccttgtactgtatcttactggacagggccagctctccaggaggctcacaggcccagcgggtatgtcagtgtcactggagtcagacagtaataaattaaagcaatgacaagccaccactggctccctggactccttgctgtcagcagtggctccggggccacagagaagaaagaaagacttttaggaactgggtctaacttatgggcaaagtacttgccttgccaggtgtatgggttttgcattcccatcacccacacaccctaaacaagccaagtcagtgagcttcaagttagagcctccacctcaatgtgtacgtggaaagcaatcaaagatgatgcctagcatccacctctggccctcatgtgcagatgtacacacactgaattacatacacgggacacacacatccacacggaggcagtccatgacttgcactggggagatggtaccataggcgaaagtgccacaggcacagggccaggctaatttagtcctgcagtcctgtgctcttaagatgaaggcacaaagaggaaccccaggcgctccaactagcatgccaggcagtgacaagaccctgcttcaaatgaatcagagcccacattcagtattgccctcttacccgatgcgatgcccatgccctcacatatgaatgtgtatatatacatacatacgtaaaataattcttttttaaattatagacatttttgtgtgaatgttttgcctgaatgtgtgtgtgtgtgtgtgtgtgtgtgtgtgtgtgtgtgtgtgtgtatcaagtacattcctagagcctacagaggtcaagggagggcattggatctggaactggagtcacatgaggctgtgagcaactgtgtgggttcctgggcctttgcaacagcagttagtactcttcaccactgagccatttctccaatctcaaaaagaagcattcttttaaatgaagactgaaataaataagtaggacttgccttgg

SEQ ID NO: 203 - protein, 1647 aa, Mus musculus
MSTPDPPLGGTPRPGPSPGPGPSPGAMLGPSPGPSPGSAHSMMGPSPGPPSAGHPMPTQGPGGYPQDNMHQMHKPMESMHEKGMPDDPRYNQMKGMGMRSGAHTGMAPPPSPMDQHSQGYPSPLGGSEHASSPVPASGPSSGPQMSSGPGGAPLDGSDPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPLVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFREYHRSVTGKLQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQPAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSEAGSSTPTTSTRSRDKDEESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 204 - DNA, 6376 bp, Mus musculus; identical to SEQ ID NO: 196

SEQ ID NO: 205 - DNA, 3440 bp, Homo sapiens
gagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaaaaaa

SEQ ID NO: 206 - protein, 418 aa, Homo sapiens
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 207 - DNA, 3347 bp, Homo sapiens
gagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaaaaaa

SEQ ID NO: 208 - protein, 387 aa, Homo sapiens
MSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 209 - DNA, 3415 bp, Homo sapiens
ccttccacctctgccctatctcggcagatgctccacggatttgcacgaactcccgagtcttgacctccctcccctctccgggctgccgggacaactcggggcggccactcttgccaggaggcatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaaaaaa

SEQ ID NO: 210 - protein, 395 aa, Homo sapiens
MLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 211 - protein, 418 aa, Mus musculus
MSVAFAAPRQRGKGEITPAAIQKMLDENNHLIQCIMDYQNKGKASECSQYQQILHTNLVYLATIADSNQNMQSLLPAPPTQTMPMGPGGMSQSGPPPPPRSHNMPSDGMVGGGPPAPHMQNQMNGQMPGPNHMPMQGPGPSQLSMTNSSMNMPSSSHGSMGGYNHSVPSSQSMPVQNQMTMSQGQPMGNYGPRPNMNMQPNQGPMMHQQPPSQQYNMPPGGAQHYQGQQAPMGLMGQVNQGSHMMGQRQMPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQSYGPSQGGPGPQYPNYPQGQGQQYGGYRPTQPGPPQPPQQRPYGYDQGQYGNYQQ

SEQ ID NO: 212 - DNA, 3110 bp, Mus musculus
ccttgctgggagctgcggctcagcgttaaggccaagccggccagcgagggacgcggcccgggagcatcctccccccaccgcgcgccctaaggtggaactgcccggaggcgggcgtcgggcccccagctccgcgggccctggagcgctcgggactcgctgatcgcgggctcggcggcaacatgtctgtggcgttcgcagccccgaggcagcggggcaagggcgaaatcacgcccgccgccatccagaagatgctggatgaaaacaaccatcttattcagtgtataatggactatcagaacaaagggaaggcctcggagtgctcgcagtatcagcagatattgcatacaaacctggtataccttgctacaatagcagactctaatcaaaatatgcagtctctcttaccagcaccgcccacacagactatgccaatgggtcctggagggatgagtcagagtggccctccaccccctccccgctctcacaacatgccttcagatggaatggtgggtgggggccctcctgcaccacacatgcagaaccagatgaacggccagatgcctgggcctaaccatatgccaatgcagggacctggacccagtcagctcagcatgacaaacagctccatgaatatgccttcaagtagccatggctccatgggaggttacaaccattctgtgccgtcatcccagagcatgcccgtgcagaaccagatgacaatgagtcaggggcagccaatgggaaactatggtcccagaccaaacatgaatatgcaaccaaatcaagggccgatgatgcaccagcagcctccttctcagcagtacaatatgccacctggaggggcacagcattaccaaggacagcaggcgcccatggggctgatgggccaagttaaccaaggcagtcacatgatgggccagcgacagatgcctccctacagacctccgcaacagggcccaccacagcagtactcaggccaggaagactattatggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaactcccagtatggccaacagcaagacgcttaccagggaccacctccacagcaaggatacccaccccagcagcagcagtacccgggacagcagggatacccagggcagcagcagagctatggtccttcgcagggcggtccaggtcctcagtatcctaattatcctcagggtcaaggtcagcagtatgggggctatagaccaacacagccaggaccaccccagccaccccagcagaggccttatgggtacgaccagggacagtatggaaattaccagcagtgaaaatgtccttacattccaatagccagtacctattagcaggcacgttgtcacagcactgcaccatggacacccccctgggaagactccttccattccagctaggtttttgggaaaacctttggctaagtggctgcttcgtcagcaagtagctgttatggtttagtttgtaaaggcttcgtagctaccgatgcacctgatttcacgtttctactctagatggcaacattggacagaaaatgcattgacgtgaggagtttgcagcggtttcagaactgtgctgcaaatggactgtcacagcctgaaaggtgtgagcagctgggtgtgtgttcgcggagcttcagggggtttcatacttttccaccgattattttgtaaggggaagggggaaatgtacactttttacagcagcaatattttgtctattatgtttatttcatgtgataaatatgcaaagcggtacactacacactgggcagaatcagaacccctgttaatgtggagtgtggtagatgctcggtgctgtggtgctctgaagacaggcgaggggaggcagaagcccaccacaggcccgctgttagttcttagaggaaactcctctctctcttatctaccagattagcaagggcgctgtgatacagttttttgagtacaaagacattttttaaaaagccttccagttttgtgcattaaaacctttttgtaaatatggtttataatactgttttcaaacgcaaggcaataattatgttgcatctgtgaactttggcaggtttgtgtaaaaggagggaagcctctcttaaaacagcaataacagaaaaggaggaagcgggatgtttttaccttgtcttgtaatcagggagctctcaccacgtcagagaggaggcagcattggtctcaccttactgttttttacattaccatgattggttcatggagcagggaggagtccacgagacttcacacgcttgtgctttaactttcttaactgggcacaagcaaagggcgccttcgtgttcctctcttcatcttagttaatgcgcgaggaaaatgctttgatggccatttctcattcgcactgaaagccgagaggtgacattttacggtttcttgtttttaagcacgacatacttaatcattatttgagactgattattttagctaaatttggggatatgccatggggcaagaaaacatgtactgagagatttctaaacacatctatttaagcatactttaaaaatatctagcccaaaggtaagttgctgtatcctcacagttgtctgcatccagggaatatgactgaatataacatatctttgtaattgaattagtttttgccacttctaactgaaaacagaacagaaggagtgccataaatgcaaagaagcaaagtgtactgttgtcaacatactgtaatcagaggaggggtttcaatgtgtctggatgagagtgtgtgtgtttaaggtcagagtatagggtgttcttcaacttggacagtagaaaataggcatcaagtgtgaaccggtgaggcgtggacagccttcttgtgactgagatgcttgtaagttctgtgccaggttctccaccactgtgtactttattgctatttaaaactgtatcaactctaacgaaagaataaattatttgtgattttaaaaaaaaaaaaaaaaaaaa

SEQ ID NO: 213 - protein, 387 aa, Mus musculus
MSVAFAAPRQRGKGEITPAAIQKMLDENNHLIQCIMDYQNKGKASECSQYQQILHTNLVYLATIADSNQNMQSLLPAPPTQTMPMGPGGMSQSGPPPPPRSHNMPSDGMVGGGPPAPHMQNQMNGQMPGPNHMPMQGPGPSQLSMTNSSMNMPSSSHGSMGGYNHSVPSSQSMPVQNQMTMSQGQPMGNYGPRPNMNMQPNQGPMMHQQPPSQQYNMPPGGAQHYQGQQAPMGLMGQVNQGSHMMGQRQMPPYRPPQQGPPQQYSGQEDYYGDQYSHGGQGPPEGMNQQYYPDGNSQYGQQQDAYQGPPPQQGYPPQQQQYPGQQGYPGQQQSYGPSQGGPGPQYPNYPQGQGQQYGGYRPTQPGPPQPPQQRPYGYDQGQYGNYQQ

SEQ ID NO: 214 - DNA, 3017 bp, Mus musculus
ccttgctgggagctgcggctcagcgttaaggccaagccggccagcgagggacgcggcccgggagcatcctccccccaccgcgcgccctaaggtggaactgcccggaggcgggcgtcgggcccccagctccgcgggccctggagcgctcgggactcgctgatcgcgggctcggcggcaacatgtctgtggcgttcgcagccccgaggcagcggggcaagggcgaaatcacgcccgccgccatccagaagatgctggatgaaaacaaccatcttattcagtgtataatggactatcagaacaaagggaaggcctcggagtgctcgcagtatcagcagatattgcatacaaacctggtataccttgctacaatagcagactctaatcaaaatatgcagtctctcttaccagcaccgcccacacagactatgccaatgggtcctggagggatgagtcagagtggccctccaccccctccccgctctcacaacatgccttcagatggaatggtgggtgggggccctcctgcaccacacatgcagaaccagatgaacggccagatgcctgggcctaaccatatgccaatgcagggacctggacccagtcagctcagcatgacaaacagctccatgaatatgccttcaagtagccatggctccatgggaggttacaaccattctgtgccgtcatcccagagcatgcccgtgcagaaccagatgacaatgagtcaggggcagccaatgggaaactatggtcccagaccaaacatgaatatgcaaccaaatcaagggccgatgatgcaccagcagcctccttctcagcagtacaatatgccacctggaggggcacagcattaccaaggacagcaggcgcccatggggctgatgggccaagttaaccaaggcagtcacatgatgggccagcgacagatgcctccctacagacctccgcaacagggcccaccacagcagtactcaggccaggaagactattatggggaccaatacagtcatggtggacaaggtcctccagaaggcatgaaccagcaatattaccctgatggaaactcccagtatggccaacagcaagacgcttaccagggaccacctccacagcaaggatacccaccccagcagcagcagtacccgggacagcagggatacccagggcagcagcagagctatggtccttcgcagggcggtccaggtcctcagtatcctaattatcctcagggtcaaggtcagcagtatgggggctatagaccaacacagccaggaccaccccagccaccccagcagaggccttatgggtacgaccagggacagtatggaaattaccagcagtgaaaatgtccttacattccaatagccagtacctattagcaggcacgttgtcacagcactgcaccatggacacccccctgggaagactccttccattccagctaggtttttgggaaaacctttggctaagtggctgcttcgtcagcaagtagctgttatggtttagtttgtaaaggcttcgtagctaccgatgcacctgatttcacgtttctactctagatggcaacattggacagaaaatgcattgacgtgaggagtttgcagcggtttcagaactgtgctgcaaatggactgtcacagcctgaaaggtgtgagcagctgggtgtgtgttcgcggagcttcagggggtttcatacttttccaccgattattttgtaaggggaagggggaaatgtacactttttacagcagcaatattttgtctattatgtttatttcatgtgataaatatgcaaagcggtacactacacactgggcagaatcagaacccctgttaatgtggagtgtggtagatgctcggtgctgtggtgctctgaagacaggcgaggggaggcagaagcccaccacaggcccgctgttagttcttagaggaaactcctctctctcttatctaccagattagcaagggcgctgtgatacagttttttgagtacaaagacattttttaaaaagccttccagttttgtgcattaaaacctttttgtaaatatggtttataatactgttttcaaacgcaaggcaataattatgttgcatctgtgaactttggcaggtttgtgtaaaaggagggaagcctctcttaaaacagcaataacagaaaaggaggaagcgggatgtttttaccttgtcttgtaatcagggagctctcaccacgtcagagaggaggcagcattggtctcaccttactgttttttacattaccatgattggttcatggagcagggaggagtccacgagacttcacacgcttgtgctttaactttcttaactgggcacaagcaaagggcgccttcgtgttcctctcttcatcttagttaatgcgcgaggaaaatgctttgatggccatttctcattcgcactgaaagccgagaggtgacattttacggtttcttgtttttaagcacgacatacttaatcattatttgagactgattattttagctaaatttggggatatgccatggggcaagaaaacatgtactgagagatttctaaacacatctatttaagcatactttaaaaatatctagcccaaaggtaagttgctgtatcctcacagttgtctgcatccagggaatatgactgaatataacatatctttgtaattgaattagtttttgccacttctaactgaaaacagaacagaaggagtgccataaatgcaaagaagcaaagtgtactgttgtcaacatactgtaatcagaggaggggtttcaatgtgtctggatgagagtgtgtgtgtttaaggtcagagtatagggtgttcttcaacttggacagtagaaaataggcatcaagtgtgaaccggtgaggcgtggacagccttcttgtgactgagatgcttgtaagttctgtgccaggttctccaccactgtgtactttattgctatttaaaactgtatcaactctaacgaaagaataaattatttgtgattttaaaaaaaaaaaaaaaaaaaa

SEQ ID NO: 215 - protein, 344 aa, Mus musculus
MSVAFAAPRQRGKGEITPAAIQKMLDENNHLIQCIMDYQNKGKASECSQYQQILHTNLVYLATIADSNQNMQSLLPAPPTQTMPMGPGGMSQSGPPPPPRSHNMPSDGMVGGGPPAPHMQNQMNGQMPGPMMHQQPPSQQYNMPPGGAQHYQGQQAPMGLMGQVNQGSHMMGQRQMPPYRPPQQGPPQQYSGQEDYYGDQYSHGGQGPPEGMNQQYYPDGHNDYGYQQPSYPEQGYDRPYEDSSQHYYEGGNSQYGQQQDAYQGPPPQQGYPPQQQQYPGQQGYPGQQQSYGPSQGGPGPQYPNYPQGQGQQYGGYRPTQPGPPQPPQQRPYGYDQGQYGNYQQ

SEQ ID NO: 216 - DNA, 2888 bp, Mus musculus
ccttgctgggagctgcggctcagcgttaaggccaagccggccagcgagggacgcggcccgggagcatcctccccccaccgcgcgccctaaggtggaactgcccggaggcgggcgtcgggcccccagctccgcgggccctggagcgctcgggactcgctgatcgcgggctcggcggcaacatgtctgtggcgttcgcagccccgaggcagcggggcaagggcgaaatcacgcccgccgccatccagaagatgctggatgaaaacaaccatcttattcagtgtataatggactatcagaacaaagggaaggcctcggagtgctcgcagtatcagcagatattgcatacaaacctggtataccttgctacaatagcagactctaatcaaaatatgcagtctctcttaccagcaccgcccacacagactatgccaatgggtcctggagggatgagtcagagtggccctccaccccctccccgctctcacaacatgccttcagatggaatggtgggtgggggccctcctgcaccacacatgcagaaccagatgaacggccagatgcctgggccgatgatgcaccagcagcctccttctcagcagtacaatatgccacctggaggggcacagcattaccaaggacagcaggcgcccatggggctgatgggccaagttaaccaaggcagtcacatgatgggccagcgacagatgcctccctacagacctccgcaacagggcccaccacagcagtactcaggccaggaagactattatggggaccaatacagtcatggtggacaaggtcctccagaaggcatgaaccagcaatattaccctgatggtcataatgattacggttatcagcaaccgtcgtatcctgaacaaggctacgataggccttatgaggattcctcacaacattactacgaaggaggaaactcccagtatggccaacagcaagacgcttaccagggaccacctccacagcaaggatacccaccccagcagcagcagtacccgggacagcagggatacccagggcagcagcagagctatggtccttcgcagggcggtccaggtcctcagtatcctaattatcctcagggtcaaggtcagcagtatgggggctatagaccaacacagccaggaccaccccagccaccccagcagaggccttatgggtacgaccagggacagtatggaaattaccagcagtgaaaatgtccttacattccaatagccagtacctattagcaggcacgttgtcacagcactgcaccatggacacccccctgggaagactccttccattccagctaggtttttgggaaaacctttggctaagtggctgcttcgtcagcaagtagctgttatggtttagtttgtaaaggcttcgtagctaccgatgcacctgatttcacgtttctactctagatggcaacattggacagaaaatgcattgacgtgaggagtttgcagcggtttcagaactgtgctgcaaatggactgtcacagcctgaaaggtgtgagcagctgggtgtgtgttcgcggagcttcagggggtttcatacttttccaccgattattttgtaaggggaagggggaaatgtacactttttacagcagcaatattttgtctattatgtttatttcatgtgataaatatgcaaagcggtacactacacactgggcagaatcagaacccctgttaatgtggagtgtggtagatgctcggtgctgtggtgctctgaagacaggcgaggggaggcagaagcccaccacaggcccgctgttagttcttagaggaaactcctctctctcttatctaccagattagcaagggcgctgtgatacagttttttgagtacaaagacattttttaaaaagccttccagttttgtgcattaaaacctttttgtaaatatggtttataatactgttttcaaacgcaaggcaataattatgttgcatctgtgaactttggcaggtttgtgtaaaaggagggaagcctctcttaaaacagcaataacagaaaaggaggaagcgggatgtttttaccttgtcttgtaatcagggagctctcaccacgtcagagaggaggcagcattggtctcaccttactgttttttacattaccatgattggttcatggagcagggaggagtccacgagacttcacacgcttgtgctttaactttcttaactgggcacaagcaaagggcgccttcgtgttcctctcttcatcttagttaatgcgcgaggaaaatgctttgatggccatttctcattcgcactgaaagccgagaggtgacattttacggtttcttgtttttaagcacgacatacttaatcattatttgagactgattattttagctaaatttggggatatgccatggggcaagaaaacatgtactgagagatttctaaacacatctatttaagcatactttaaaaatatctagcccaaaggtaagttgctgtatcctcacagttgtctgcatccagggaatatgactgaatataacatatctttgtaattgaattagtttttgccacttctaactgaaaacagaacagaaggagtgccataaatgcaaagaagcaaagtgtactgttgtcaacatactgtaatcagaggaggggtttcaatgtgtctggatgagagtgtgtgtgtttaaggtcagagtatagggtgttcttcaacttggacagtagaaaataggcatcaagtgtgaaccggtgaggcgtggacagccttcttgtgactgagatgcttgtaagttctgtgccaggttctccaccactgtgtactttattgctatttaaaactgtatcaactctaacgaaagaataaattatttgtgattttaaaaaaaaaaaaaaaaaaaa

SEQ ID NO: 217 - protein, 313 aa, Mus musculus
MSVAFAAPRQRGKGEITPAAIQKMLDENNHLIQCIMDYQNKGKASECSQYQQILHTNLVYLATIADSNQNMQSLLPAPPTQTMPMGPGGMSQSGPPPPPRSHNMPSDGMVGGGPPAPHMQNQMNGQMPGPMMHQQPPSQQYNMPPGGAQHYQGQQAPMGLMGQVNQGSHMMGQRQMPPYRPPQQGPPQQYSGQEDYYGDQYSHGGQGPPEGMNQQYYPDGNSQYGQQQDAYQGPPPQQGYPPQQQQYPGQQGYPGQQQSYGPSQGGPGPQYPNYPQGQGQQYGGYRPTQPGPPQPPQQRPYGYDQGQYGNYQQ

SEQ ID NO: 218 - DNA, 2795 bp, Mus musculus
ccttgctgggagctgcggctcagcgttaaggccaagccggccagcgagggacgcggcccgggagcatcctccccccaccgcgcgccctaaggtggaactgcccggaggcgggcgtcgggcccccagctccgcgggccctggagcgctcgggactcgctgatcgcgggctcggcggcaacatgtctgtggcgttcgcagccccgaggcagcggggcaagggcgaaatcacgcccgccgccatccagaagatgctggatgaaaacaaccatcttattcagtgtataatggactatcagaacaaagggaaggcctcggagtgctcgcagtatcagcagatattgcatacaaacctggtataccttgctacaatagcagactctaatcaaaatatgcagtctctcttaccagcaccgcccacacagactatgccaatgggtcctggagggatgagtcagagtggccctccaccccctccccgctctcacaacatgccttcagatggaatggtgggtgggggccctcctgcaccacacatgcagaaccagatgaacggccagatgcctgggccgatgatgcaccagcagcctccttctcagcagtacaatatgccacctggaggggcacagcattaccaaggacagcaggcgcccatggggctgatgggccaagttaaccaaggcagtcacatgatgggccagcgacagatgcctccctacagacctccgcaacagggcccaccacagcagtactcaggccaggaagactattatggggaccaatacagtcatggtggacaaggtcctccagaaggcatgaaccagcaatattaccctgatggaaactcccagtatggccaacagcaagacgcttaccagggaccacctccacagcaaggatacccaccccagcagcagcagtacccgggacagcagggatacccagggcagcagcagagctatggtccttcgcagggcggtccaggtcctcagtatcctaattatcctcagggtcaaggtcagcagtatgggggctatagaccaacacagccaggaccaccccagccaccccagcagaggccttatgggtacgaccagggacagtatggaaattaccagcagtgaaaatgtccttacattccaatagccagtacctattagcaggcacgttgtcacagcactgcaccatggacacccccctgggaagactccttccattccagctaggtttttgggaaaacctttggctaagtggctgcttcgtcagcaagtagctgttatggtttagtttgtaaaggcttcgtagctaccgatgcacctgatttcacgtttctactctagatggcaacattggacagaaaatgcattgacgtgaggagtttgcagcggtttcagaactgtgctgcaaatggactgtcacagcctgaaaggtgtgagcagctgggtgtgtgttcgcggagcttcagggggtttcatacttttccaccgattattttgtaaggggaagggggaaatgtacactttttacagcagcaatattttgtctattatgtttatttcatgtgataaatatgcaaagcggtacactacacactgggcagaatcagaacccctgttaatgtggagtgtggtagatgctcggtgctgtggtgctctgaagacaggcgaggggaggcagaagcccaccacaggcccgctgttagttcttagaggaaactcctctctctcttatctaccagattagcaagggcgctgtgatacagttttttgagtacaaagacattttttaaaaagccttccagttttgtgcattaaaacctttttgtaaatatggtttataatactgttttcaaacgcaaggcaataattatgttgcatctgtgaactttggcaggtttgtgtaaaaggagggaagcctctcttaaaacagcaataacagaaaaggaggaagcgggatgtttttaccttgtcttgtaatcagggagctctcaccacgtcagagaggaggcagcattggtctcaccttactgttttttacattaccatgattggttcatggagcagggaggagtccacgagacttcacacgcttgtgctttaactttcttaactgggcacaagcaaagggcgccttcgtgttcctctcttcatcttagttaatgcgcgaggaaaatgctttgatggccatttctcattcgcactgaaagccgagaggtgacattttacggtttcttgtttttaagcacgacatacttaatcattatttgagactgattattttagctaaatttggggatatgccatggggcaagaaaacatgtactgagagatttctaaacacatctatttaagcatactttaaaaatatctagcccaaaggtaagttgctgtatcctcacagttgtctgcatccagggaatatgactgaatataacatatctttgtaattgaattagtttttgccacttctaactgaaaacagaacagaaggagtgccataaatgcaaagaagcaaagtgtactgttgtcaacatactgtaatcagaggaggggtttcaatgtgtctggatgagagtgtgtgtgtttaaggtcagagtatagggtgttcttcaacttggacagtagaaaataggcatcaagtgtgaaccggtgaggcgtggacagccttcttgtgactgagatgcttgtaagttctgtgccaggttctccaccactgtgtactttattgctatttaaaactgtatcaactctaacgaaagaataaattatttgtgattttaaaaaaaaaaaaaaaaaaaa

SEQ ID NO: 219 - DNA, 4612 bp, Homo sapiens
cttccccccctccgcgactgcggataatgagcgcctcgggccgcccagcgcagccggagtatccacctcgatgaccacgggctgagccccgcgccgccaccatgtccgtggccttcgcgtctgcccggccaagaggcaaaggggaggttacgcagcaaaccatccagaagatgctggacgagaaccaccacctgatccagtgcatcctggagtaccagagcaagggcaagacggccgagtgcacgcagtaccagcagatcctgcaccggaacctggtatacctggccacgatcgcagactccaaccagaacatgcagtccctgcttcctgccccgcccacgcagaacatgaacctgggccctggagccctgactcagagcggctccagccagggcctgcactctcagggcagcctgagtgacgccatcagcacgggcctgccaccctcctccctcctgcagggccagattggcaacgggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggtatgacgccgagcgcacaccactggcgtgagacagcgcttggtggtgtgatacttttggtgctgtgtatagtattgtatgtcggtacacggagaggtatcctttttttgtcccccgcccccttctcaatgtttctagctagctttgggggtcattttgtcatcagagcattctgtgcccagggacaggacagatctcgaggacaccacagtccacctgttcccgtcaacagacgttaggtctcattttcctcctcatgcagtgttgtagtgtgggttgtcaacttttctttaactggctacgccacagctggacacacatgcagcccctggagggcagcctcttcctgtgcctcgatggggtgggtgggagggcatcttctgtgcgttgggtcagtttctgttacgtaacgaaaaggataaacatctcccacgggagaggccacagatggccacttccagagcttgcccattgcctgtctctcgccaattccgtttatccaaaaaggtacatgtttttgtattaaaaagtaaacagggatcagtgactgtattccaaataaatatgaatccctaagggccgtggacaaattgcctaacccagggccagcggtattgctgaaggaaaggggcagctctctgggaagtgggccctcagagattactctggctttgacccttgtttagctgatggtcatttctgggattggaatatttaataagcccaattctaagttgataggtaattttaaatattcaaaccaaatcttcccaacagttggcaagttgtttattttatattatttcttccaggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaatcatcctataaagtgagttttcatgaagaaaaaaaaaaaaaaaaaa

SEQ ID NO: 220 - protein, 396 aa, Homo sapiens
MSVAFASARPRGKGEVTQQTIQKMLDENHHLIQCILEYQSKGKTAECTQYQQILHRNLVYLATIADSNQNMQSLLPAPPTQNMNLGPGALTQSGSSQGLHSQGSLSDAISTGLPPSSLLQGQIGNGPSHVSMQQTAPNTLPTTSMSISGPGYSHAGPASQGVPMQGQGTIGNYVSRTNINMQSNPVSMMQQQAATSHYSSAQGGSQHYQGQSSIAMMGQGSQGSSMMGQRPMAPYRPSQQGSSQQYLGQEEYYGEQYSHSQGAAEPMGQQYYPDGHGDYAYQQSSYTEQSYDRSFEESTQHYYEGGNSQYSQQQAGYQQGAAQQQTYSQQQYPSQQSYPGQQQGYGSAQGAPSQYPGYQQGQGQQYGSYRAPQTAPSAQQQRPYGYEQGQYGNYQQ

SEQ ID NO: 221 - DNA, 4717 bp, Homo sapiens
cttccccccctccgcgactgcggataatgagcgcctcgggccgcccagcgcagccggagtatccacctcgatgaccacgggctgagccccgcgccgccaccatgtccgtggccttcgcgtctgcccggccaagaggcaaaggggaggttacgcagcaaaccatccagaagtttttgaagaatgccggccagtcatcgagtgcccttggtttgggtacaaggtgcgttttcctaacttgcgggtctgaaagtgcgtccattcccccttcacgcctggttgcggtttcggcggactagaatttctacgcagaagtctccctcaggatcagaccgtagcccttccggaaacctccatgatgctggacgagaaccaccacctgatccagtgcatcctggagtaccagagcaagggcaagacggccgagtgcacgcagtaccagcagatcctgcaccggaacctggtatacctggccacgatcgcagactccaaccagaacatgcagtccctgcttcctgcccctgagtgacgccatcagcacgggcctgccaccctcctccctcctgcagggccagattggcaacgggccgagccacgtgtccatgcagcagacggcgcctaacacgctgcccaccacctccatgagcatctctgggcccggctacagccacgcgggacccgcctcgcagggcgtccccatgcaggggcaaggcaccatcggcaactacgtgtctcggaccaacatcaacatgcagtccaacccagtctccatgatgcagcagcaggcggccacgtcgcactacagctcggcgcagggcggcagccagcactaccagggccagtcgtccatcgccatgatggggcagggcagccaggggagcagcatgatggggcagcggcccatggcgccctaccggccctcccagcaaggctcttcccagcagtacctgggccaggaggagtactatggcgagcagtacagccacagccagggcgccgcggagcccatgggccagcagtactaccccgacggccatggcgattacgcctaccagcagtcatcctacacggagcagagctacgaccggtccttcgaggagtccacgcagcactactatgaggggggaaactcccagtacagccagcagcaggccgggtaccagcagggtgccgcgcagcagcagacgtactcccagcagcagtaccccagccagcagagctaccccgggcagcagcagggctacgggtctgcccagggagccccgtcacagtaccccggctaccagcaaggccaaggccagcagtacggaagctaccgagcaccgcagacagcgccgtctgcccagcagcagcggccctacggctatgaacagggccagtatggaaattaccagcagtaagggacacacattctggctggagcccttgtggtagcgtgttcatccaggggccggatgggctggcggcagctctggtgaattgtgacatgttggttacctgttcgcccagtgccacgtctgcatgtgaagcgtgctcatttcatgctgggtatgacgccgagcgcacaccactggcgtgagacagcgcttggtggtgtgatacttttggtgctgtgtatagtattgtatgtcggtacacggagaggtatcctttttttgtcccccgcccccttctcaatgtttctagctagctttgggggtcattttgtcatcagagcattctgtgcccagggacaggacagatctcgaggacaccacagtccacctgttcccgtcaacagacgttaggtctcattttcctcctcatgcagtgttgtagtgtgggttgtcaacttttctttaactggctacgccacagctggacacacatgcagcccctggagggcagcctcttcctgtgcctcgatggggtgggtgggagggcatcttctgtgcgttgggtcagtttctgttacgtaacgaaaaggataaacatctcccacgggagaggccacagatggccacttccagagcttgcccattgcctgtctctcgccaattccgtttatccaaaaaggtacatgtttttgtattaaaaagtaaacagggatcagtgactgtattccaaataaatatgaatccctaagggccgtggacaaattgcctaacccagggccagcggtattgctgaaggaaaggggcagctctctgggaagtgggccctcagagattactctggctttgacccttgtttagctgatggtcatttctgggattggaatatttaataagcccaattctaagttgataggtaattttaaatattcaaaccaaatcttcccaacagttggcaagttgtttattttatattatttcttccaggacctacttgctcagatctccaagcaagcatttcttttcttttagggatgtctgaaagtcacatccagttacattactgtgttctttctaatgaaaagtaaaggttttatatagagaaacttgagtaatttttacatttctaagacattaaatcccatttaaattctgtgtgaacattaaagacagcacacttgcaaaagtatggtcaaaggaaaaaaatcccacatttcaattaacaagtagcatggacatttgatcaacctttagttggaataataatattcatatttgctatgaatccttttaaaaaaatctttggataaatgctgacagatttccaagaactaccaagaaaatacaagagatatccaatgcttgatatatgaggcctagtaataacgatatttctctttaattgatgttttgttttaaaagttaaaagtaattcttggcgtggtggttcacgcctgtaatcccagcactttgggaggccgaagcgggcggatcacctgaggtcgggagttcgagaccagcctgaccaacatggagaaaccccgtccctactaaaaatacaaaattagccaggtatggtggtgcatacctgtaatcccagctactcgggaacctgaggcaggagaatggcttgaacccaggagacagaggttgtggtggggcaagatcgcaccattgcacccgagcctaggcaacaagagtgaaattccgtctcaaaaaaataaataaataaataaataaataagttaaaattaattctttatccagagtcgggtgctttagaatttataagtcacttatgtgttttgcttgaattaattctgacagcccctatgaggaaatctggaggcaggtaacagttcccattttagagatgaagaactgaggcacagattaaaggacttgcctgtgttgaataccagtcctgttctaggacattctcccctctcctaggagacggatgtcacgcacaaatggggagagaagtgtttattttgtaggcactaagggtttctaaaacccttaacactggtaagggctcaaaaataaacgtatgtgttcatattcgatcaccgaaatgagagttcttaattgctaattgacaaacgcgttagcaatttcagttagggagtcatctcccttgattgtgttcttttcctgtcaattttcatagacctaatttgcaaactcaatcggggactaaaatttcccactgaaaatgttaaacattttagataactgtgaagatagtttatttttattccttgccaatctgggaatatgccttttttgtgtgtttgtgtgtttttttaagtgctgtattaataatactttctgaaagaaaaggacacttaccccaaaacttcaatctgaaatgtcttacattaagaatatcttgaatgttgtgtatatattttaaaaagcactttgcaaaatagtttgtacatttatttcctaatttatacatgatttttggtgttaatatatttaatgattaataacagaatgtttatttaatgtgctgtccatttttatgtaatattatggggaaagtgatgccagcagttccttttcattattctatcttctgtcatatgaatgttgagcaaagcttaggccaacatgaattgtttgtgaagtgtggttgatggtgctttgtttttttctgactacttctatggaaggccagtgaagaagcaaaggaagacatgaaaattgacgctcattcttcttcctattgttccctgacatccagcaaattgtgaatttgaaaaatgatggccagttttcagaagtgctgacaaattcatattggtatgcaaaagctcatcacccattaaggtttgttgttgaatcaacagtactcagcatattaaaacagtacatcagaactcatgccaacagtctttatgatgggattaaggtggacaagatctcctaagatctgtgaatgggattaaggtggacaagatctcctaagatctgaaaagaaaccttaatacgctcatatggttggagtgttaagtgaacctctgattttgtcagggtttttctacgtgtaggcgtgaatagggggcaccccttcaaaactgtacaaagaagacgactgttttccatttccatttaaacatttttagccacttcatttctatttattgaacaggtcaaatttgtcttgttatttgtgagtacagtacatttaaaaaacatccttatcggttatttttttttcagtcggagtttgacgtataaattgtttatgcttttggtgtaatctcttaataaactggttcttcaaaaatcatcctataaagtgagttttcatgaagaaaaaaaaaaaaaaaaaa

SEQ ID NO: 222 - protein, 265 aa, Homo sapiens
MQQTAPNTLPTTSMSISGPGYSHAGPASQGVPMQGQGTIGNYVSRTNINMQSNPVSMMQQQAATSHYSSAQGGSQHYQGQSSIAMMGQGSQGSSMMGQRPMAPYRPSQQGSSQQYLGQEEYYGEQYSHSQGAAEPMGQQYYPDGHGDYAYQQSSYTEQSYDRSFEESTQHYYEGGNSQYSQQQAGYQQGAAQQQTYSQQQYPSQQSYPGQQQGYGSAQGAPSQYPGYQQGQGQQYGSYRAPQTAPSAQQQRPYGYEQGQYGNYQQ

SEQ ID NO: 223 - DNA, 4395 bp, Mus musculus
ggcacggcggggcggggcagggcgggcggaaccaccgaagctcagcacagggggcggtgtaccggctaccggctggacgaagagcgcaggccgggtgcagggggcctccgcgcggtatcctgacctgggaggcagtcgcgtaaggcgtggggacgcgggggactcgagcgcgcattggcgacaggcaggcgggcgagcccacggcaccgcgccccccgtgtccccgcccccgctctgcggagaatgggcacctcgggccgcggggcgcagccggagaataaaccccaatgatcacgggctgagtccgcgccaccaccatgtccgtggccttcgcgtcggcgcggccgagaggcaaaggggaggtcactcagcagaccatccagaagatgctggatgagaaccaccacctgatccagtgcatcctggactaccagagcaagggcaagaccgccgagtgcacgcagtaccagcagatcctgcaccggaacctggtctacctagccaccatagcagactccaatcagaacatgcagtccctgcttcccgcgcctccaacacagaacatgaacctcgggcccggagcactgagtcagagtggttccagccagggcctgcacccccagggcagcctcagcgataccgtcagcacaggcctgccccccgcctccctcatgcagggccagatcggtaacggtccaaaccacgtgtccatgcagcagacggctcagagcacactgcccacaacctccatgagcttgtcaggcagtggccatggtactggccctgggtacagccactcggggcctacctcgcagagtgtccccatgcaaggccaaggtgccatcagcaactatgtgtctcggaccaacatcaacatgcagtctaacccagtctccatgatgcaccagcaggcagccacgtcccactacaactcagcacagggtggaagccagcattaccagggccaggcacccattgccatgatgggccagggtggccaaggaggcagcatgatggggcagcggcccatggcgccctacagaccctcccagcaaggctcttcccagcagtacctgggccaagaggagtactacagcgaacagtacagccacagccagggctccgcagagcccatgagtcaacagtactacccggatggccacggtgactacgcctatcagcagtcgtcctacacagagcagagctacgaccgctcctttgaggatcccacacagcactactacgaggggggaaactcccagtacagtcagcagcaggctgggtaccagcagggcacagcacagcagcagacctactcccagcaacagtatcccaaccagcagagctacccggggcagcagcagggctacggtcctgcccagggagccccctcacagtactcaagctaccagcaaggacaaggtcagcagtatggaagctacagaacatcgcagacgggaccttctgcccagcagcagcggccttacggctatgaacagggccagtatggaaattaccagcaataaagaacaagcattgtctttggacccttcatagtagtatgttctggacaagccggtggcagttctgatgagtagcgacatgttggtcaccctctctgcccagtgccgtgtctgcatgagaggcaggctggtttcatgctgggcgtgatgctgtgtgcaccactgactgcgatatggcgtgacatgtctggtgctgtgtaaagtattgtatatcggtacgatggggaggttgtcctgtttgtgtcccctgcccgctccctgatgttcttagctagcttgggggggggttaccgtgtcatcacatgttctgtgcctggtgatgagacaatgtctaagagacatcatggtccatgctgctgtgaacagactcagtctgccccctctcataccattgttgcaaagtggactgtaaatgtttcttcaactggcggctcatagcttgacatacatacaccgctaggtgaccatttcttctgtgcctaagtagggcttgaggacaccttctgtgtcttgggtcatgtcactataacaaggaagatgtgctttgtgtgcaaggaccatgagctgtcctttccagaacttaccaattgcctgtgtctctccagtttccatgatcccaaaggatgtctttgtattagcgagtaaagaaggatcgatgactattccaaatgacagtcggtgagagtgtgggcatcgtgaggggagctttcactaaggagggcgctgtctgaagagcaattcttgctgtctccgagctgcttgtgtgtagtatggctttggcccttggcgtcatctctaggatttgagtgtgcccaaacctaagtttatagagaatttaaagtactcatgtttaattttacaagcagttggcaagtgtttatattacttcttcaggacctctgagttcagattgccaagcagatgttcctttgcgtttagggaagtctgaaatccacactgcatttttaatgaatccaaataactttattacgttctttcaaatgaaaaggacaagttttatacagtgagaattgggtgattttttttttttttacattcctaggatgtttaatctcgttttaattctgtgcaaacatgagagacagcctttttgaaaaggttctatcaaaggaaaacaccgcatataatgcagcaggcatatttttcagcatttatttagataataacaatgttactatgagaagaaaagaacaaccttgaagatgagtgctcagaacaaccaagaacatacaaaaccatccccaaggatgcagggcttggtacatcagacctgtccaccaggatgcttttgctttatttgtgtcttatatgtagcccagactggcctcaaactcactacatagctgaggctgaacttaatgatcccccagcctccactcccgggtactgagaccacgggcatgcaccaccacatctgttttcagctgatagtttttaaaatataaaacttacctgtagctcagtagtaaggcacctttgtggagtttgcttgaattaatcttgacagtcttgctggaacttacagtgcaagctccatttacttacaggagaatcaagggccggatcaaaggacttgtctgtgtcggctgccgtcttactctaggacattctccctctccttgggaccattatcaacaaccatgggcatatgtgtctcataggcacagggtttaggaaacacacaggcaagggctgactacatgacggctttaactttacagaaacaagtttctgatcgctacatggcagaagtattagcaacttgattttagggactcatcatctctttagctccttccctttctggcaatttttataaaactagcctacaagctcacttgggggctaaatatcccattgaaaatgtcgaaacattttaagtaactgtgaaatggtttttattccttgccaatctgggaatatgccttttatgtatgcatacatgtgcaagtgtgtacgtgtgtgtgtgtgtgtgtgtgtgtatgtatgtgtgtgtatgtgtgtatatatatgtgtgtatgttaaagtgctgtattagtgtgtatgtgtgtgtgtatatgtaaagtgctgtgttagtgtgtgttaatactttttgaaagaaaagaacacttaaaatatgtatcaccccaaaagttcaatttgaaatgtcttacattaagaatttcttgaatgttgtgtatatatttttaaaagcactttgtgaaatagtttgtacatttatttcctaatttatacctgattttggtgttaatatatttaatgattaatattgtttatttaatgttttattgatttttatgtaattttgtgggggaaagtgatgccagtctttttcattgcctgtattatagcttttcttctgtaacatgaatgtttgaaaagtcctaggctgaaatgaacccttcgtgcaggtgtggttgactgtgttttgttttcaatggttcctcctactgaaggccagaaaagatgcaaagggagatttggaaatcgctgctcattcttcctcctgtttcccagcatccgttcaatacttggtgaacttgaccactgaggactggggttttcagatgtgctgaccactacgcgctgcgcttgtcaggggctatgggtggatggacatctctgcagacttagcatatagcacagtgggagatgggagatgtccgcagaggcactgggcagacacaggcctggcccagaaaggaggtgttttcctttcctgttgtacctgttctcagacgtgggcttcagtgactgagtgtccgttcaaacttgtaaaaagaggaagactttccatttccattaaaacacttttttagccattaaaaaaaaaaaaaaaaaaaaaaaaaaa

SEQ ID NO: 224 - protein, 402 aa, Mus musculus
MSVAFASARPRGKGEVTQQTIQKMLDENHHLIQCILDYQSKGKTAECTQYQQILHRNLVYLATIADSNQNMQSLLPAPPTQNMNLGPGALSQSGSSQGLHPQGSLSDTVSTGLPPASLMQGQIGNGPNHVSMQQTAQSTLPTTSMSLSGSGHGTGPGYSHSGPTSQSVPMQGQGAISNYVSRTNINMQSNPVSMMHQQAATSHYNSAQGGSQHYQGQAPIAMMGQGGQGGSMMGQRPMAPYRPSQQGSSQQYLGQEEYYSEQYSHSQGSAEPMSQQYYPDGHGDYAYQQSSYTEQSYDRSFEDPTQHYYEGGNSQYSQQQAGYQQGTAQQQTYSQQQYPNQQSYPGQQQGYGPAQGAPSQYSSYQQGQGQQYGSYRTSQTGPSAQQQRPYGYEQGQYGNYQQ

SEQ ID NO: 225 - DNA, 5741 bp, Homo sapiens
gcgcggccagagcggccggggacaggctccgaggcaggcccgacccgcctccccggcgccgccgtggctcgacggagaccagctaggctggcccccaagaggaccctttccaagtccccagctgggggccctgtgtagacctggagtggacacgcccctccttcccttcatgattcgtttgtagcgcagtggcgatggatgatgaggatgggagatgcttactagacgtgatttgtgacccacaggccctcaatgacttcttgcatggatccgagaagcttgacagtgatgacctcctggataatcccggggaggcccaaagtgccttctatgaaggtcctgggctccatgtgcaagaagcttccggcaaccacctgaacccagagcccaaccagccggcccccagtgtggacctagacttcctggaagatgacatcctgggctctcctgcgacagggggcggcggcgggggcagtgggggcgctgaccagccctgtgacatcctccagcagagcctccaagaggccaacatcacggagcagacgctggaggccgaggctgagctggacctgggtcccttccagctgcccaccctgcagcctgcggatggcggggcaggcccgacgggcgctggaggggcagcggccgtggctgcggggccccaagccctcttcccaggcagcaccgacctgctggggctgcagggcccgcctaccgtgctgacccaccaggccctggtgccgccccaggacgtggtcaacaaggccctgagtgtgcagcccttcctgcagcctgtgggcctgggcaatgtgacactgcagcccatcccgggcctccaaggcctgcccaatggcagccctgggggtgccacggcggccacactgggcctggcgcccatccaggtggtgggccagcccgtcatggcgctcaacacgcccacctcccagctcctggccaagcaggtgcccgtcagcggctacctggcctcggcggctggcccctcggagcccgtgacgctggcgtcggccggtgtctcgccacagggggctggcctggtcatccagaagaacctctcggccgctgtggccaccacgctcaatgggaactctgtgttcggaggcgcgggggccgcctcggctcccaccgggacgccctcgggacagccgctggcggtggccccaggcctcggctcgtcgccactggtcccggcgcccaacgtgatcctgcatcgcacacccacgcccatccagcccaagcccgcgggggtgctgccgcccaagctctaccagctgacgcccaagccgtttgcgcccgcgggcgccacgctcaccatccagggcgagccgggggcgctcccgcagcagcccaaggccccgcagaacctgacgttcatggcggcggggaaggcgggccagaacgtggtgctgtcgggcttccccgcgcctgcgctgcaagcgaacgtcttcaagcagccaccggccaccaccaccggagcggccccgccgcagccccccggggccctgagcaaacccatgagcgtccacctcctgaaccaaggcagcagcatcgtcatccccgcccagcacatgctgccgggccagaaccagttcctactgcctggcgccccggcggtccagctcccgcagcagctctcagccctgccggccaacgtgggcgggcagatcctggcggccgctgccccccacacaggtggacagctcatcgcgaaccccatcctcacaaaccagaacctggcgggcccactgagcctgggccccgtgttggccccccactccggggcccacagcgcgcacatcctctccgccgctcccatccaggtgggccagcctgcgctcttccagatgcccgtgtcgctggcggcgggcagcctgcccacgcagagccagccagcgcccgccgggccggccgccaccactgtcctccagggggtcaccctgccccccagcgccgtggccatgctcaacacccccgacggcctggtgcagccggccacccctgccgctgccaccggggaggccgcgcctgtcctcacggtgcagcctgccccccaggcgccccccgcggtcagcacacccctgcccctgggcctccagcagccgcaggcgcagcagcccccgcaggcccccaccccacaggccgccgccccgcctcaggccaccaccccccagcccagccctggcctggcgtctagcccggagaagatcgtcctggggcagccgccctctgccacccccacggccatcctcactcaggactccctgcagatgttcctgccccaggagaggagccagcagcccctctccgcagagggcccccacctctccgtgcctgcctcggtcatagtcagcgccccgcctcccgcccaagacccagccccagccacccccgtcgccaaaggagctggcctcggccctcaggcccccgacagccaggcttccccggctccggccccccagatcccggcagcggctccgctgaagggcccaggcccctcttcgtccccgtcactacctcaccaggcccctctgggggacagcccccacctgccctccccacaccccacccggcccccttcccgcccaccctcccggccacagagtgtgtcccgccctccctcagagccacccttgcacccttgccccccaccccaggcccccccaactctgcctggcatctttgtcatccaaaaccagctaggcgttcccccgcctgccagcaacccggcccctactgccccaggcccgccgcagccgcctctccgcccccagtcccagccgcctgagggaccgctgcccccagccccccacctccctccatcctccacctcctctgctgtggcctcctcctctgagacgtcctccaggttgccagcccctacgccatccgacttccagctccagttcccacccagccaggggccccacaagtcccccactccccctccaaccctccacctggtccctgagccggcagcaccccccccaccgcctcctcggaccttccagatggtgaccacccccttcccagcgctgccccagccgaaggctcttctcgagagatttcaccaggtgccgtccggaatcatcctccagaacaaggctgggggggcccctgccgccccgcagacctccaccagcctggggcccctcaccagccccgctgcgtctgtgctggtcagtgggcaggccccatctgggacccccactgcccccagccacgcccccgccccggcacccatggccgccacaggcctccctcctctgcttccagccgagaacaaggcttttgccagcaacctcccgaccctgaatgtggccaaggccgcttcctccgggccagggaagccctccgggctgcagtatgagagcaaactgagtggcctgaagaagccccccacgcttcagcccagcaaggaagcctgtttcctggagcatttgcacaaacaccagggctccgtcctgcaccccgactacaagacggccttcccctcctttgaggacgccctgcatcgcctcctgccctaccatgtctaccagggcgccctcccctcccccagtgactaccacaaagtggacgaggagtttgagacggtctccacgcagctgctgaaacgcacccaggccatgctcaataaatatcggctcctgctcctggaggagtcccggagggtgagcccctcagcggagatggtaatgatcgaccgaatgttcattcaggaggagaagaccacccttgccttggataaacagctggccaaggagaagccggacgagtacgtgtcttcctcccgctcgctcggcctccccatcgcagcctcttccgagggtcatcggcttcccggccacggccccctgtcgtcttcagctcccggggcctccacccagccccctccacacctgcccaccaagcttgtgatccggcacggcggggcaggcggctccccttcggtcacctgggcccgggcgtcctcctccctgtcctcctcttcctcctcctcctctgccgcctcctccttggacgccgacgaggacggccccatgccctcccgcaaccgcccgcccatcaagacctacgaggcccggagccgcatcgggctcaagctcaagatcaagcaggaagccgggctcagcaaggtcgtgcacaacacggccctggaccccgtgcaccagcccccgccaccccccgctaccctcaaggtggccgagcccccgccacggccgccaccaccaccgccgcccacgggccagatgaacggcacggtggaccacccgccgcctgccgcccccgagcgcaagcccctgggcaccgccccgcactgcccgcgcctgccactgcgcaagacctaccgcgagaacgtggggggccctggcgcgccggaggggacgcccgcaggcagggcacggggaggcagcccggcgccgctgcccgccaaagtggacgaggccaccagcgggctcatccgcgagctggcggccgtggaggacgagctgtaccagcgtatgctgaagggccccccgccagagcccgcagccagcgccgcccaaggcaccggggaccccgactgggaggcgcccgggctgccccctgccaagcggcgcaagtccgagtcgcccgacgtggaccaggccagcttctccagcgacagcccgcaggatgacacgctcaccgagcacctgcagagcgccatcgacagcatcctgaacctgcagcaggcccccggccggacgcccgcgccctcgtacccccacgctgcctcggccggcacccccgcatccccgccgcccctgcacaggcccgaggcctacccaccctccagtcacaacggtggcctcggcgccaggacgttgaccagataacaccgggccgcctccccttccccgtcccctcctcccgaagacgccgggacagtcgggtgtccgccctcagcctcctggggactcgagccggggatcccctgacggtttttcttgcctaagttatttgagtcacaaaggcctccttccctgccgcctgcttcagctgggttgctggggggtgggcgtggatttagggagggggctgtgatgtaaaacgtctcccctgccaaaggaggggcaaagtgctgtgtcagttcctgtttcttcccatttcctggcacactctgcccctctgtccgggggacacgcgcatgtgtttgccagggatggggccaccgggttgatgccaacgctccgggtgcctgtcttgtctgtgtggcttctcagatggtggagggtgctgggagctggcagggtccttccagacagtctcagcctctccccgccgcccccaacaggctgtcaaacaaaaccggagagggggtgggggagccagcctcccagcgtgctgtgcccgcaggcacccgtgtgacatccgcacgtccagctccgtgacctgtgtgtgtgtgtgtgtgcacaagtgagtgagagatttcgaacgcccacccctcgactttgaaatctgagcaaaacaagaaactggggtcttcctctcccccgaacctctccccagctagtcttccctctgttcttcctgcctccagccgcccgcgccagattttgaaatctcggagacaaaactagtactgtaagataaatttttttgtactgtatttattgtgtataacgatttttttaaaggagaattctgtacatttagaactcttgtaaattaaaaaccgatcctttttttaaaactgtaaa

SEQ ID NO: 226 - protein, 1560 aa, Homo sapiens [sequence omitted]

SEQ ID NO: 227 - DNA, 5360 bp, Mus musculus
gctggccccacaaaggacattatcaaagtccccagcctggggccctgtgtagacctggagtggccaccgcacccttcccttcatgattcgttcatagcacagtggaaatggatgatgaggatgggagatgcttactagacgtgatttgtgatcctcaggccctcaatgatttcttgcatggatccgagaagctggacagcgatgacctcctggatgcccctgtggaggcccaaagtgccttctatgaaggtcctgggctccatgtgcaggaagctgccgccaaccacctaaaccctgagcccagccagcctgcccccagcgtggacctggacttcctagaagatgatatcttgggctcccctgcagcaggaggaggtggagggggcggcggggccccagaccagccctgtgacatccttcagcagagtcttcaggaggccaacatcacagaacagaccctggaggctgaggctgaactggacctgggccccttccagctgcccaccctacagcccgctgacaatggggcaggtgctactggagccgcaggagccacggcagtgactgcaggaccccaggctctcttcccaggcagcgcggatctgctggggctgcaagccccgcccactgtactgacccaccaggccctggtgccaccccaggatgtggtcaacaaggccttgagcgtccagcccttcctgcagcctgtgggcctgggcaatgtgacccttcagcccatttcaggcctccagggccttcccaatggcagtcctgggaatgctgcagcagccaccttgggtctgacacctattcaagtggtgggccagcccgtcatggctctcaacccacccacctcccagctcttggcaaagcaggtacctgtcagtggctacctggcctcagcagctggtccttcagagccagtgacactggcatctgccggcgtgtccccccagggagccggcctggtcatccagaaaaatcttccagccgcagtgaccaccacactcaacgggaactcggtgtttgccgggacaggggctgccactgcagcagccagtggggcaccctcgggacagccgctggcggtggccccgggccttggcacatcaccactggtacaagcacccagtgtgattttacacagaacccctacgcctatccagcccaagcctacaggggtcctgccctccaaactctaccagctgacacccaagccctttccccctaccggagccacccttaccatccagggtgaaccaggcaccttgccccagcagcctaaggccccccagaacctgacttttatggccacgggcaaagctggccagaatgtggtgctgtctggcttcccggcaccggctttgcaggcgaatgtgttcaagcagccaccagtcaccaccacggggacagccccgccacagccaccaggggccctcagcaaacccatgagcgtccacctcctcaatcaaggcagcagcatcgtgatcccagcccagcacatgctgcctggccagaaccagttcttgctgccaggcaccccagccgtacaactccctcagtcactctctgcactgcctgccaacgtgggaggccagatcctcacagctgcagcaccacacgcaggtggacagctcattgccaaccctatcctcaccaaccagaacctggcaggcccactgagtctgggcccagtgctggcaccccactctggggcacacagcgctgcacacatcctctctgcagctcccatccaggtgggccagcctgccctcttccagatgcctgtgtcactggccactggcagcctgcctactcagagccagccggctcccactggccccacagccaccaccgtcctccagggcgtcaccctgcctcccagtgctgtggccatgcttaacacgcctgatgggctagtgcaaccctccactccagctgccaccactggggaggccacaccagttctggccgttcagcctgcaacccaggtgccccctgctgtcaccacaccactgcctatgggtctccaacagccacaggcacagcagcctccacaggtccctactccacaggcggccacccagcctcaggccacccctcctcaggccagcccaagcctggcttccagcccagagaagatagtcctggggcaggcgccccctgcggccacaacggccatcctcactcaggattccctacagatgttcctgccccaggagaggagccagcagcccctctctacagagggtccccacctctcggtgcctgcctccgtcatagtcagcgccccgcctcctgcccaagacccagccctggccacgcccgtcaccaaaggagctggcctcggcgctcagaccccggacagccgggcttccccagctccggctccccagatccctgcagctgctccactgaaagcccctggccccgcctcctccccctcactacctcaccaggcccccctgggagacagtccccacatgccctccccacaccctgccaggcccccttcccgcccaccctcaagaccccactcacgccctccatcccagccccagagcctgacctgcccaccctctgagcccaccctgcacccttgccctccaccccagggtcccccaactctacctggcatctttgtcatccagaatcaattgggcgccccaccaccagccagcaccccagcctccacagccccgggcccaccccagcctcctctgcgacccccatcccagcctccagagggcccactgcccccagcctcccacctccctcctgcctccaccccctcggccgtggcctcctcctctgagccttctgccaggttgccggtccccacaccccctgacttccaactccagttcccaccgagccagggaccccataagtcccctactccgccaccagccctccacatggtccctgagcccacggcaccccctcctccaccacctcggaccttccagatggtaaccgcccccttcccagcgttgccccagccaaaagcacttctggaacgattccaccaggtgccatctgggattattctccagaataaggctgggggtactcccaccaccccacagacatccaccaccctggggaccctcaccggtcctactgcctctgtgctagtcagtggacaggcaccacctgggactcctgccgcctctagccatgtcccagcctccacacctatggccaccacaggcctccctcctctacttcctgccgaaaacaaagcttttgccagcaaccttccaaccctgagtgtggccaaagctaccgtgtctgggccagggaagcccccagcaattcagtatgacagcaagttgtgtagcttgaagaaacagcccctactgcaacccagcaaagaagcctgcttcctggagcatctgcacaaacaccagggctctgtcctgcaccccgattacaagacagccttcccctcctttgaggacgccctccatcgcctcctgccctaccatgtctaccaaggcgccctcccctcccccaacgactaccataaagtggatgaagaatttgagactgtctctacgcagctgctcaaacgcacccaggccatgctcaataaatatcggcttttgcttctggaagagtccaggagagtcagtccttctgcggagatggttatgatcgaccgaatgttcattcaggaggagaagaccacccttgccttggataagcagcttgccaaggagaagcctgatgagtacgtgtcttcctcccgctcccttggcttccctgtcccagtgtcttccgagggccaccggctccccagccatggccagtcgtcttcatcctccacatctggaacgtctgcccagccccctcctcatctgcccaccaagctagtgatccggcacggtggggccggcggctctccctcagtgacctgggcccgggcatcctcctccttgtcatccacttcctcatcctcctcctcatcctctgctgcctcatccctggacgcagatgaggacggccccatgcccacccgtaaccggccacccatcaagacctatgaggcccggagccgcattggtctcaaactcaagatcaaacaagaggcggggctcagcaaggtggtgcacaacactgcactggatcctgtgcatcagcccttgccggctccaaccccagcgaaaggggcggagcctccgccacacccagctccgcccccactccctcctgctacccaggcgcagatgaatggcactctggaccatcccccacccgcagtacgcaaacccacggtgcctgcgtcctgcccacgtctaccactacgcaagacctaccgagaaaacatgggcaatcctggtgccgccgagggtgcacagggacggccgcggggtgcgggcagccccaccccactgcccaccaaggtagacgaagccaccagtgggctgatccgggagctggcagcggtggaggatgaactatatcagcgggttctgaagggcggcccaccacccccggagactccagcctccgctaccagccagggccccactgaacccagttgggaagcacccgtgctacccccagccaaacgacgcaagtctgagtccccggacgtggaccaggccagcttctctagtgacagcccgcaggatgatacacttactgagcatttgcagagtgccatcgacagcatccttaacctgcagcaggcccccggccggacacccgcaggcccatacccccatacggggcccacgcctggcacccccacatccccagcgcccctgcacaggcctgacgccttcccaccctctagtcacaatggtggcctcggtgccaggacgttgaacagataacaccgggctgcttctgcagccctcatagagtgcccccaaccccacttccaggagagcagcctgaccgccgacctccacctctaaggggcactaacccagttcccctgacaattcttgcctaagttattttgagtcacaaaggcctccccaccttcctgcttccacgttggctagagatttggaatggggcgtgggttttctaggggaaggtgggctataaggtacaacgtccccctggcacaagccaggacaggggatacatgagtgttgcctaggactgggcttctaggttgatgcactggtaacatctgaaaacaaggtcttgtctgattggcttcgtggatcactgtccggggcactcagagccgggagagatcttctgaaaggctcaactctcatcctgttgcccacagagcctgaaagattaggaagcaaggactcaagccagtgtcccaaagtacctacatcccatccatacgtgcactcaccggagtcatcctgtgtatgtgtgcgtgc

SEQ ID NO: 228 - protein, 1578 aa, Mus musculus
MDDEDGRCLLDVICDPQALNDFLHGSEKLDSDDLLDAPVEAQSAFYEGPGLHVQEAAANHLNPEPSQPAPSVDLDFLEDDILGSPAAGGGGGGGGAPDQPCDILQQSLQEANITEQTLEAEAELDLGPFQLPTLQPADNGAGATGAAGATAVTAGPQALFPGSADLLGLQAPPTVLTHQALVPPQDVVNKALSVQPFLQPVGLGNVTLQPISGLQGLPNGSPGNAAAATLGLTPIQVVGQPVMALNPPTSQLLAKQVPVSGYLASAAGPSEPVTLASAGVSPQGAGLVIQKNLPAAVTTTLNGNSVFAGTGAATAAASGAPSGQPLAVAPGLGTSPLVQAPSVILHRTPTPIQPKPTGVLPSKLYQLTPKPFPPTGATLTIQGEPGTLPQQPKAPQNLTFMATGKAGQNVVLSGFPAPALQANVFKQPPVTTTGTAPPQPPGALSKPMSVHLLNQGSSIVIPAQHMLPGQNQFLLPGTPAVQLPQSLSALPANVGGQILTAAAPHAGGQLIANPILTNQNLAGPLSLGPVLAPHSGAHSAAHILSAAPIQVGQPALFQMPVSLATGSLPTQSQPAPTGPTATTVLQGVTLPPSAVAMLNTPDGLVQPSTPAATTGEATPVLAVQPATQVPPAVTTPLPMGLQQPQAQQPPQVPTPQAATQPQATPPQASPSLASSPEKIVLGQAPPAATTAILTQDSLQMFLPQERSQQPLSTEGPHLSVPASVIVSAPPPAQDPALATPVTKGAGLGAQTPDSRASPAPAPQIPAAAPLKAPGPASSPSLPHQAPLGDSPHMPSPHPARPPSRPPSRPHSRPPSQPQSLTCPPSEPTLHPCPPPQGPPTLPGIFVIQNQLGAPPPASTPASTAPGPPQPPLRPPSQPPEGPLPPASHLPPASTPSAVASSSEPSARLPVPTPPDFQLQFPPSQGPHKSPTPPPALHMVPEPTAPPPPPPRTFQMVTAPFPALPQPKALLERFHQVPSGIILQNKAGGTPTTPQTSTTLGTLTGPTASVLVSGQAPPGTPAASSHVPASTPMATTGLPPLLPAENKAFASNLPTLSVAKATVSGPGKPPAIQYDSKLCSLKKQPLLQPSKEACFLEHLHKHQGSVLHPDYKTAFPSFEDALHRLLPYHVYQGALPSPNDYHKVDEEFETVSTQLLKRTQAMLNKYRLLLLEESRRVSPSAEMVMIDRMFIQEEKTTLALDKQLAKEKPDEYVSSSRSLGFPVPVSSEGHRLPSHGQSSSSSTSGTSAQPPPHLPTKLVIRHGGAGGSPSVTWARASSSLSSTSSSSSSSSAASSLDADEDGPMPTRNRPPIKTYEARSRIGLKLKIKQEAGLSKVVHNTALDPVHQPLPAPTPAKGAEPPPHPAPPPLPPATQAQMNGTLDHPPPAVRKPTVPASCPRLPLRKTYRENMGNPGAAEGAQGRPRGAGSPTPLPTKVDEATSGLIRELAAVEDELYQRVLKGGPPPPETPASATSQGPTEPSWEAPVLPPAKRRKSESPDVDQASFSSDSPQDDTLTEHLQSAIDSILNLQQAPGRTPAGPYPHTGPTPGTPTSPAPLHRPDAFPPSSHNGGLGARTLNR

SEQ ID NO: 229 - DNA, 6784 bp, Homo sapiens
ccctgccctccccgagctcggtcccggccactccctccgcagctgggcgtcgccggccgcgctggggcgagaaccgaagtttggaggtagacgagcaggcgagcggtttgcccgggcgcagagcatgaaggccgggcgggcgcggggagcggcgccccggcccggcgcgggggtgagcgagagagagagcggagcgcgtgtggccggcgccgctcggccgggagctcccgcgctccggcccccggccccgcgcccgccgccgccgccgccgccgcccctgttgcgatggcgcagaaaccccgttgacaaggcactgctttttcatgacgcaaaacgtcatattatttcacaaaaagcccagcgatttcacctgaagaagcttgggaactcctgccaaaaattgtagcacttctcacattgcaatgttgtcatggatgatgatgatgactcgtgtctccttgatcttattggagacccacaagcattgaactattttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggctcagaaaaaatgtctgaatcagacttcccccatttctgctcccaagaccacagacggcctgaggcaagcacagatccctgggctcttgagcaccacactgccagggcaggattctggaagcaaagttatatccgcatccttaggaaccgcacaaccacagcaggaaaaagtagttggatcatctcctggccatccagctgtgcaggtggagagtcattcgggaggacaaaaaaggcctgctgcgaaacagctaacgaaaggagctttcattctccagcagttgcagagggaccaagcccacactgtgacaccagacaaaagtcacttccgatcactaagtgatgcggtacagagactgctctcctaccacgtgtgccagggctccatgcccactgaagaagacttgagaaaagtggacaatgaatttgagacagttgccactcagctcctaaaaaggacccaagctatgcttaacaaatacagatgcctgctcctagaagatgccatgcgaatcaatccctctgctgagatggtgatgatcgataggatgttcaaccaggaggaaagagcttccctgtcccgagacaagcgtttggcacttgtagaccctgagggttttcaggctgatttctgttgttccttcaaacttgataaagctgctcatgagacacagtttggccggagtgaccagcatggcagtaaagcaagcagctctctgcaaccgccagccaaggcccaaggcagagaccgagccaaaaccggtgtgacggaacccatgaatcatgaccagtttcatctagtgcctaatcacatcgtggtctctgcagaaggaaacatttctaaaaaaacagaatgccttggcagagcactgaaatttgacaaagtgggcttagtgcagtaccagagcacgtctgaagagaaggccagccggagagagcctctgaaggccagtcagtgctctcccggccctgaggggcaccggaaaacctcatccagatcggatcatggtactgagagcaaactgtcaagcatcctagcagattcgcacttggagatgacgtgtaacaattccttccaggacaaaagtctgaggaattctccaaagaatgaagttttacacacagacatcatgaaagggtcaggcgaaccccagccagatctccagctgacaaagagcttggaaaccacatttaagaacatcttggaactcaaaaaggcgggacggcagccccagagtgaccccacggttagcggctctgttgagttagatttccccaacttttctcctatggcttcacaggaaaactgcctggaaaagttcatcccggaccacagtgaaggtgttgtagaaactgactccattttagaagcagctgtaaatagtatcctagagtgttaatagcagcagtcctccccctaccccgccccgagaccccaccccgagaccccaccccggaccagttacattcgttcctggcaaaagcaaatggaaatggtctcctgtctccagcctgcttgatctttcatcacaggttattctttctaatctcaatcctgttctttgtttaagagcaatacttgtcgtgattacagggagatcctttagtaaaattaatccttggcagaaagcagtctgataggccccactcatttcaagtgttatgaaagtgcttataggcattttgtttatttgttttgttttttaaaaacactgtaactcaatgagaccacagtatacttggcccttggtaaaattttgacaatcataagtcatttgaaaagaacagacttactaaaatcaaacgagacggatagaagctactttttaaagaatatcccactgcatctgcaaatttagttttgggtttttttattattattattttgagtttttttgtgtgtgttttgttgttattgttgaggggaagaccacatggttcttccccctcagccatctttgagcagtaaattgctggctgtgctgccagggacccgcagccctggtggaaaagccagtagcacatacgcagggcattgcagggcttccctattgatggttcaagtgcttttctgatgcttccggagcaaaacctcatgcttttaggcatatctatgttgaatttcacctagggaatgttctgttcttagttacagcagcaaaatttgaaataatttcaccaggctaaataaaggaaaatggaaaccagttaagaggcacagtgtacagaggaggccgggatagagccatgagggttataatattaatatgtatatatgtaaaagcatatatatgttaactattgagaaaaaacaagttttgcattttataattggatatagtcaacatataatgtatgtttttgtttgttgctggattttgtttcatttaacctctctttgcaccctctcccacaacaaataccaagcatcaaaagcactttcatttgaaaattattatgttgtaatttttcagtttaaactttaaggagactctggccttgtttatgcttcttgtctgagaacagtagtgacccctggcagcaattcattaccaaaacacagacaaaccaaaggtaaccagctagcccaccactgaaaggaaagatctgagacatgggattcccatttgagagccaaaggatatgccctgtcatggtttctgtttggcctgtgttcatattagtgagcatggcttactgctttatttatttttatttcttgtcagggagtattctccgttttcctttctcgtatacctgccccaggttatcccatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgcccctgtgtcccactacacacagaaaaccctgtgagatggccagtcttcataatagcaacgtaccttcaccccagccacatgccccagccaatacaaattggaaaatctggcccattttagggttaccattttttccttatttgtgccaatgtccaagttgcagatttcccctttttcctgtattgtaacatattagataagttggtgtcgccagttggtactttctgtttgggtagtcctagggtaacaccctgccctaaactccatgatttcataggcttttcttcccttggggctcatgctcccctaattcctagcaagatgatccttcctaatcaaattcttctcattgcagaactttatccctggaagccttcatgtgggctgctagtgagttacattaattactgcaaatcagtggaattctcaagagacaagataagcttcatgtacatttgtcacctctctttcttccctatcctgccctgctgtcccaatcctagcttttctatataccatcctaaagggtttttaagccctaacacttgtctagcaaatggagagcctaatttaccaaaatgaaacttgtaaatttttgtgtcattgtatgtaagtttactttttatggaggaaggattctagataatgacaaatgaagattatgacatgtatttcactcctgtgattaggttctacgcacatgggtcataactcgcatgtcgagccccctctagtgaagggtaggagagctcagcctcggatggccaacattcagttgttcaggttcattcgtcaaagttaagttttagaactatttgtactcagtaacaaaaatcattttctttttttttttttttttctgttgtggaaaagcgtgaatttgttattaagcatttgattttctgtgtccttaagtacttcctgaagatgaagcaaaattttaatctggcaattatgaaaaagaaatattttagctctgaaggatttagtagattctgttagattagggaggccttacagactgactttacttaaagaggacgcgtcactcgctgtcagtgtggtgtgggctttatttgcttaaataccttcatttgtatagtacgtctcacttgaaattgctttgtatacattttgtaaaaatatttataaaatgttttgtaaaaaaaaaaaaactataacaaattgcagtttattttgttatgttggataaatactgttaaaagaaaccagtcagtaactatattgttaatccatggttaggaaatgtttagttggagattacaaattgaaacaaccattgcaatacagccaaagatttgggaaaatgtg

SEQ ID NO: 230 - DNA, 6517 bp, Homo sapiens
ggcatcttttcaggatttcattcctacgtccaactgccgttcacaactgccctttccaactgctccagaactcttggccctggcattccgtgatgtaaattattccacacatggctcaaaagggtgtgaagctgtgtgccaggtgtcggatcactagtttgtcatggatgatgatgatgactcgtgtctccttgatcttattggagacccacaagcattgaactattttctacatggacctagtaataaatctagcaatgatgacttgactaatgcaggatattctgcagccaattcaaattcaattttcgccaactctagtaatgctgatcctaagtcatccctcaaaggtgtaagcaaccagcttggagaagggcccagtgatggactgccactttcaagtagcctccagtttcttgaagatgaactcgagtcttctcctcttcctgatctcactgaggaccaacctttcgacattcttcagaaatccttgcaagaggccaatatcactgaacagacattggcagaagaggcatatttggatgccagtataggttcaagccaacagtttgcacaagctcagcttcatccttcttcatcagcatcctttactcaggcttctaatgtttctaattactcaggtcagacgctgcagcctataggggtgacgcatgtgcctgttggagcatcgtttgcaagcaatacagtgggtgtacaacatggctttatgcaacatgtggggatcagtgttcccagccagcatttgtctaatagcagtcagattagtggttctggtcaaatacagttaattgggtcatttggtaatcatccttccatgatgactattaataacctagatggatctcaaatcatattaaagggcagcgggcagcaagccccatcaaatgtgagtggagggctcctggttcatagacagactcctaatggcaactccttgtttgggaactctagttccagtccagtagcacagcctgttaccgttccatttaacagcacaaattttcaaacatctttacctgtgcataacatcatcatacaaaggggtcttgcaccaaattcaaataaagtcccaattaatatacagccaaagcctatccagatgggtcagcaaaatacatacaatgtgaacaatttgggaattcagcagcaccacgtacaacaagggatctcttttgcttctgcaagctcaccccagggctcagtagttggtccacacatgtctgtgaacattgtaaaccaacagaacacaagaaagccagtcacctcacaggcagtgagcagcactgggggcagtattgttattcattcccccatgggccaacctcacgcaccccaaagtcagttccttatacctacaagcctttctgtcagttccaactcggtacaccacgtccagactataaatgggcaacttcttcaaactcaaccctctcagctcatttctggccaagtggcctcagagcatgtcatgttgaacagaaactcttccaacatgctcaggaccaaccaaccatatactggaccgatgcttaacaaccagaatactgctgtccacttagtgtctgggcagacatttgctgcctctggaagtccagtgatagccaatcatgcctctcctcagcttgtgggtggacagatgcccttgcagcaggcatccccaactgtattacacctgtcacctgggcagagcagcgtttcccaaggaagacctggcttcgccaccatgccatcggtgacaagcatgtcaggacctagtcggttccctgctgtcagctcagccagcactgcccatcctagtcttgggtctgcagttcagtctggttcatcaggatcaaactttacaggagatcagctgacccagccaaacaggactccagtaccagtcagtgtgtctcatcgtcttccagtttcttcttccaagtctaccagcaccttcagtaacacacctggaacaggaacccagcaacaattcttctgccaggctcagaaaaaatgtctgaatcagacttcccccatttctgctcccaagaccacagacggcctgaggcaagcacagatccctgggctcttgagcaccacactgccagggcaggattctggaagcaaagttatatccgcatccttaggaaccgcacaaccacagcaggaaaaagtagttggatcatctcctggccatccagctgtgcaggtggagagtcattcgggaggacaaaaaaggcctgctgcgaaacagctaacgaaaggagctttcattctccagcagttgcagagggaccaagcccacactgtgacaccagacaaaagtcacttccgatcactaagtgatgcggtacagagactgctctcctaccacgtgtgccagggctccatgcccactgaagaagacttgagaaaagtggacaatgaatttgagacagttgccactcagctcctaaaaaggacccaagctatgcttaacaaatacagatgcctgctcctagaagatgccatgcgaatcaatccctctgctgagatggtgatgatcgataggatgttcaaccaggaggaaagagcttccctgtcccgagacaagcgtttggcacttgtagaccctgagggttttcaggctgatttctgttgttccttcaaacttgataaagctgctcatgagacacagtttggccggagtgaccagcatggcagtaaagcaagcagctctctgcaaccgccagccaaggcccaaggcagagaccgagccaaaaccggtgtgacggaacccatgaatcatgaccagtttcatctagtgcctaatcacatcgtggtctctgcagaaggaaacatttctaaaaaaacagaatgccttggcagagcactgaaatttgacaaagtgggcttagtgcagtaccagagcacgtctgaagagaaggccagccggagagagcctctgaaggccagtcagtgctctcccggccctgaggggcaccggaaaacctcatccagatcggatcatggtactgagagcaaactgtcaagcatcctagcagattcgcacttggagatgacgtgtaacaattccttccaggacaaaagtctgaggaattctccaaagaatgaagttttacacacagacatcatgaaagggtcaggcgaaccccagccagatctccagctgacaaagagcttggaaaccacatttaagaacatcttggaactcaaaaaggcgggacggcagccccagagtgaccccacggttagcggctctgttgagttagatttccccaacttttctcctatggcttcacaggaaaactgcctggaaaagttcatcccggaccacagtgaaggtgttgtagaaactgactccattttagaagcagctgtaaatagtatcctagagtgttaatagcagcagtcctccccctaccccgccccgagaccccaccccgagaccccaccccggaccagttacattcgttcctggcaaaagcaaatggaaatggtctcctgtctccagcctgcttgatctttcatcacaggttattctttctaatctcaatcctgttctttgtttaagagcaatacttgtcgtgattacagggagatcctttagtaaaattaatccttggcagaaagcagtctgataggccccactcatttcaagtgttatgaaagtgcttataggcattttgtttatttgttttgttttttaaaaacactgtaactcaatgagaccacagtatacttggcccttggtaaaattttgacaatcataagtcatttgaaaagaacagacttactaaaatcaaacgagacggatagaagctactttttaaagaatatcccactgcatctgcaaatttagttttgggtttttttattattattattttgagtttttttgtgtgtgttttgttgttattgttgaggggaagaccacatggttcttccccctcagccatctttgagcagtaaattgctggctgtgctgccagggacccgcagccctggtggaaaagccagtagcacatacgcagggcattgcagggcttccctattgatggttcaagtgcttttctgatgcttccggagcaaaacctcatgcttttaggcatatctatgttgaatttcacctagggaatgttctgttcttagttacagcagcaaaatttgaaataatttcaccaggctaaataaaggaaaatggaaaccagttaagaggcacagtgtacagaggaggccgggatagagccatgagggttataatattaatatgtatatatgtaaaagcatatatatgttaactattgagaaaaaacaagttttgcattttataattggatatagtcaacatataatgtatgtttttgtttgttgctggattttgtttcatttaacctctctttgcaccctctcccacaacaaataccaagcatcaaaagcactttcatttgaaaattattatgttgtaatttttcagtttaaactttaaggagactctggccttgtttatgcttcttgtctgagaacagtagtgacccctggcagcaattcattaccaaaacacagacaaaccaaaggtaaccagctagcccaccactgaaaggaaagatctgagacatgggattcccatttgagagccaaaggatatgccctgtcatggtttctgtttggcctgtgttcatattagtgagcatggcttactgctttatttatttttatttcttgtcagggagtattctccgttttcctttctcgtatacctgccccaggttatcccatttctgttgttacctttattcttaatgtcattgtaaccatcacttatctcctctcattgggaaagctacatgatagtatttttatgcactcttctcccacacatacacacacgtgcatgtatctgagctgctcggatccagaggtcatttttgttacagtgtgtgcacactcactctccttcttagtgtgcatactctctcatttattctgtttatctccctggctctggaggtgcagccactggtcttcactttaatgtgttgccagaatctgcttctggctgtcgccaacatggggatgacccccattgtcatcatgttgggcatttcttttccagattggcctgtgatggaaaggaaggcttctaattagaaaacacagcaacagaagacctataccccggtgcccctgtgtcccactacacacagaaaaccctgtgagatggccagtcttcataatagcaacgtaccttcaccccagccacatgccccagccaatacaaattggaaaatctggcccattttagggttaccattttttccttatttgtgccaatgtccaagttgcagatttcccctttttcctgtattgtaacatattagataagttggtgtcgccagttggtactttctgtttgggtagtcctagggtaacaccctgccctaaactccatgatttcataggcttttcttcccttggggctcatgctcccctaattcctagcaagatgatccttcctaatcaaattcttctcattgcagaactttatccctggaagccttcatgtgggctgctagtgagttacattaattactgcaaatcagtggaattctcaagagacaagataagcttcatgtacatttgtcacctctctttcttccctatcctgccctgctgtcccaatcctagcttttctatataccatcctaaagggtttttaagccctaacacttgtctagcaaatggagagcctaatttaccaaaatgaaacttgtaaatttttgtgtcattgtatgtaagtttactttttatggaggaaggattctagataatgacaaatgaagattatgacatgtatttcactcctgtgattaggttctacgcacatgggtcataactcgcatgtcgagccccctctagtgaagggtaggagagctcagcctcggatggccaacattcagttgttcaggttcattcgtcaaagttaagttttagaactatttgtactcagtaacaaaaatcattttctttttttttttttttttctgttgtggaaaagcgtgaatttgttattaagcatttgattttctgtgtccttaagtacttcctgaagatgaagcaaaattttaatctggcaattatgaaaaagaaatattttagctctgaaggatttagtagattctgttagattagggaggccttacagactgactttacttaaagaggacgcgtcactcgctgtcagtgtggtgtgggctttatttgcttaaataccttcatttgtatagtacgtctcacttgaaattgctttgtatacattttgtaaaaatatttataaaatgttttgtaaaaaaaaaaaaactataacaaattgcagtttattttgttatgttggataaatactgttaaaagaaaccagtcagtaactatattgttaatccatggttaggaaatgtttagttggagattacaaattgaaacaaccattgcaatacagccaaagatttgggaaaatgtg

SEQ ID NO: 231 - protein, 1079 aa, Homo sapiens
MDDDDDSCLLDLIGDPQALNYFLHGPSNKSSNDDLTNAGYSAANSNSIFANSSNADPKSSLKGVSNQLGEGPSDGLPLSSSLQFLEDELESSPLPDLTEDQPFDILQKSLQEANITEQTLAEEAYLDASIGSSQQFAQAQLHPSSSASFTQASNVSNYSGQTLQPIGVTHVPVGASFASNTVGVQHGFMQHVGISVPSQHLSNSSQISGSGQIQLIGSFGNHPSMMTINNLDGSQIILKGSGQQAPSNVSGGLLVHRQTPNGNSLFGNSSSSPVAQPVTVPFNSTNFQTSLPVHNIIIQRGLAPNSNKVPINIQPKPIQMGQQNTYNVNNLGIQQHHVQQGISFASASSPQGSVVGPHMSVNIVNQQNTRKPVTSQAVSSTGGSIVIHSPMGQPHAPQSQFLIPTSLSVSSNSVHHVQTINGQLLQTQPSQLISGQVASEHVMLNRNSSNMLRTNQPYTGPMLNNQNTAVHLVSGQTFAASGSPVIANHASPQLVGGQMPLQQASPTVLHLSPGQSSVSQGRPGFATMPSVTSMSGPSRFPAVSSASTAHPSLGSAVQSGSSGSNFTGDQLTQPNRTPVPVSVSHRLPVSSSKSTSTFSNTPGTGTQQQFFCQAQKKCLNQTSPISAPKTTDGLRQAQIPGLLSTTLPGQDSGSKVISASLGTAQPQQEKVVGSSPGHPAVQVESHSGGQKRPAAKQLTKGAFILQQLQRDQAHTVTPDKSHFRSLSDAVQRLLSYHVCQGSMPTEEDLRKVDNEFETVATQLLKRTQAMLNKYRCLLLEDAMRINPSAEMVMIDRMFNQEERASLSRDKRLALVDPEGFQADFCCSFKLDKAAHETQFGRSDQHGSKASSSLQPPAKAQGRDRAKTGVTEPMNHDQFHLVPNHIVVSAEGNISKKTECLGRALKFDKVGLVQYQSTSEEKASRREPLKASQCSPGPEGHRKTSSRSDHGTESKLSSILADSHLEMTCNNSFQDKSLRNSPKNEVLHTDIMKGSGEPQPDLQLTKSLETTFKNILELKKAGRQPQSDPTVSGSVELDFPNFSPMASQENCLEKFIPDHSEGVVETDSILEAAVNSILEC

SEQ ID NO: 232 - DNA, 6579 bp, Mus musculus
ggggtctcatgtagcccaggctggcctcaaccttgtcatgtaggcaagggtagccttcacctcctgatcctcctgtctctgccttccaactcctgggatcaaggtgtttgccagtgtgtctggcttgcttggctatttgtttatttacttatgagctgcggtcttgctattgtccaggctgaccttgaactcttggactcaagttcccttccttactgagtcctacctgagtggccaggactactggcaaatgacactgtgcccaccagccacaacatttttcccatggtaggcttgataggtgactagggaaagctcccgtgctgacagttgtgtggaggctcagcgtgctccactgcatccatattgctggccgccctgctccgactcactgcctccctccctctctccttgcagttgtcatggatgatgacgatgactcctgtctcctcgatcttattggagacccacaagcattgaactattttctgcacggacctagcagtaaatcgggcagcgatgatgtgacgaacgcagggtattctgcagccaattctaattcaattttcgccaactccacgaacgctgaccctaaatcggccctcaaaggtgtgagtgaccagcttggggaggggcccagtgatgggctgccgcttgcaagcagccttcagtttcttgaagatgaacttgagtcttcacctctccccgatctcagcgaggaccaaccctttgacattcttcagaaatccttgcaggaggctaatatcactgaacagacattggcagaagaggcgtacctggatgccagtataggctcaagccaacagtttgcacaagcccagcttcatccttcttcatcagcatcctttactcaggcttctaatgtttctaattactcaggtcagacactgcagcctatcggggtgactcacgtgcctgttggagcatcgtttgcaagcaatacagtgggtgtgcagcatggctttatgcaacacgtggggatcagtgttcccagccagcatttgcctaacagcagccagattagtggctccggtcagatacagttaatcgggtccttcggtaatcagccttccatgatgactataaataacctcgatggctctcaaatcatactgaaaggcagtgggcagcaagccccatctaatgtgagtggggggcttctggttcacagacagactcctaacggcaactctctgtttgggaactccacttccagtcctgtagcacagcctgtcaccgttccatttaacagcacaaatttccaggcatctttacccgtgcataacatcattattcaaaggggtcttgcaccaaattcaaataaagtcccaattaatatccagccaaagccggtccagatgggtcagcagagcgcgtacaatgtgaacaaccttgggatccagcagcaccatgcccagcaggggatctccttcgcccccacaagctcgccccagggctccgtggttgggccgcacatgtctgtgaacattgtcaaccaacagaacacgagaaagcctgtcacctcgcaggcagtgagcggcacagggggcagcatcgtcatccattcccccatgggccagcctcacactccccaaagtcagttccttatacccacaagcctttctgtcagctccaactcggtgcaccatgtccaggctataaacgggcagctgcttcagactcagccctcccagctcatctctggccaagtggcctctgagcatgtcatgctgaacaggaattcctctaacatgctcaggaccaaccaaccatattccggacagatgcttaataaccagaataccgccgtccagctggtgtctgggcagacttttgccacctctggaagtccagtgatagtcaaccacgcctctcctcagatcgtcgggggacagatgcccttgcagcaggcctcacccaccgtgttacacctgtcacctgggcagagcagtgtttcccagggaaggccaggcttcgccaccatgcccgcggtgagcggcatggcaggacccgctcggttccccgccgtcagctcagctagcactgctcatcctactcttgggcctacggtgcagtcgggggcaccgggatcaaactttacgggagaccagctgacacaagccaacagaacgccagcgcccgtcagtgtgtcccaccgtcttccagtctctgcttccaaatcccccagcaccttgagcaacaccccggggacacagcagcagttcttctgtcaggctcagaagaagtgtttgaaccagacctcccccattcccacatccaagaccacagacggcttgaggccatcacagatccctgggctcttgagcaccgcactgccaggacaggattctggaagcaaaattatgccagcgaccttgggggccacacaggcacaaccagaaagctcagttggatcatccccgagccagacagctgtgcaggtggatagtcatccaggacagaaaaggcctgctgccaaacagctgactaaaggagctttcatcctccagcagttacagagggaccaagcccatgctgtgacacccgacaaaagccagttccggtcactaaatgacacggtgcagagactgctctcctaccacgtgtgccagggctccatgcccacggaggaagacctgaggcaagtggacaatgaatttgaagaggtcgccactcagctcctcaaaaggacccaagctatgctgaacaaatacagattcctgctcctagaagacgccatgaggatcaacccctctgcagagatggtgatgattgacaggatgttcaaccaggaggaaagagcttccctgtcgagggacaagcgtctggcgctcgtagatcctgagggttttcaggccgatttctgttgttccttcaaacttgacgaagctgtacctgagaccccgcttgacaggagtgaccagcatcgcagcaaaaccagctcgctccatcaggtgcccagggcccaaagcagagaccgagccaagccaggcatggcagaagcaacgaatcatgaccagtttcatctagtgcctaaccacatcgtggtctctgcagagggaaacatttctaaaaagtcagaaggccacagtagaacactgaaatttgacagaggggtcttaggccaataccggggtccgcctgaggacaagggcggccggagggaccctgccaaggtcagcaggtgctctccgggccccgagggccaccgcaaaagcttgcccaggccagatcacggctctgagagcaagctccccggcgtcctggccagctcgcacatggagatgccctgtctcgactccttccaggacaaagcgctgaggaattccccaaagaatgaggttttacacacagacatcatgaaagggtcgggtgagccccagccagatctccagctcaccaagagcctagagaaaacctttaagaacatcctggaactcaagaactcggggcggccgccaagcgaccctacggccagcggtgcggcggacctggacttccccagcttttctccaatggcttcgcaggaaaactgcctagaaaaattcatcccggaccacagtgaaggcgttgtagaaacggactccattttagaagcagctgtaaatagtattctagagtgttaatagcagccgtcctcctccagaccctgccccggaccagttacactctctcccagcaaagcaaatggaaacggctcccgtctgtctccagcctgcttggtcctccatcacaggttatcctttctaatctcaccctgttcttttgaagagcaatacatgtcgtcatggctgcggggagacccctcagtacacccacctctctctagaaagcagtccgataggccctccacatttcaagtgttacgaaagtgcttacggccattgttgttcgttaatttgttttgtggtttgtttcttagcactgtcgctcaagaccacagtacacttggccctgggtaaaattttgacaatcataagtcatttcaaaagaacagacttattaaagaaaaatcaaacaggactgatttaaagactttctcactgcagctccaaagtagtggtttggttttgttctgttccagggggagagggtatctgcgtagggaagactctccctgaccagcccgctgagtggtgggtagccggtgctctgcctggaagcccaccgccctggctaagacgccaggagcacagccacagagcatcctcctgacatccagtgctgtgcgatgctgcaaaagcaaagccttgtgtttgtcttcaacacattcgtgctgaattctgtctgagaatggtctgttcttagccccaggtgtacgccctgaaattctcacaggctcactagggaacagtggaagtcagttgtaaggcagcgagttggggaggcaccggggtctccgtgtattccatcaacttaaaagaggtttgcattttataattgggtgaagtcaacataacctatgttctttattatcgctgaattctgttccattcaacctcgttgtcccctttccctcagcccttagccaagcatcaaaaggctttcacttaaaaactgtgttgtactctttcagttgaggcttttgaacgggactctggccttgttcgtgagaatagtagtcaacagtatcagtcattcattcccaaacacagtaaaccaaaggtcacaaccagcaggccactgaaggaaggaaccgaggcaggagacagggggccatgtcctggccccgcccccgctgtgtgtggtccagttcaccatagcgatcgagccttcctctttattatttttgttcctttccgggagtggccctcatccttccctctgtgcgggcctgcaccagggcgtgttctgttgctacttgcttcttcctgtgtggtaatggcccacagtgctgtgtctgcaaccctcctcccacgtctccatcaacctctgggatccagaggtagctttgatgcctgtgagggcttcctccctctgttcatccccaggctgtgtaaatgcatccgttgatctcctctgcttcgttatacccccaaaatggagttgtccctatggtcatcatgtagagtgtttcttttccagattggcctgcaatggaaaggaaggcttttgattttgatttttatctttttttcacataacacagcaacaatctaggcatggtggcatacacctgtaatcccaacagtcaggtgactaaagcaggagagtcactggttcaaggccagcttgggctatataacacacccctgcctcaaacacagaaggagagaaatttgagcaatagcagactgtgtgggccttttttacccctctgtccactacacaaaaaaactctgtgagacagccagtctttgagagcgatggaccttctcccgcccacagcccagccaaccaaactagaagagtctgggctgtcttcgagttgtccttttcttccttctctgtgccaatgtccaagttgctgacttccttcctgtattataacacattagaaagatgagttgtttaccagttagacctctgtctgggctgccctgatctctctgtcacaggctcttctcatagccacatggttaccattcaagatggcccctggatgcctgcagcacatggctactaatgaattactttaattattgcaaatcagtggaattctcaagagacaagaaagtctcgtgtatatttgttatctcttccctccctccccagccccggccctggccctagttttctctcctgtgtgtcaggttacagggcttctcaccatgacattagtcccacacaaggagagcctactgtaccaaaatgaaacttgtaaatttttgtgtccttgtatgtaagtttactttttatggaggaaagactctagataatgacaaatgaagattacaaagtgtattttactcctgtgattaggttacaccacatgggtcataactcactcccgagcccccactgctgaagggaagcgctctgcctcagtggccaacgttggtggttcagggtcattagtcagttgagttctagaacgcgtgctcagtaacaaaaaaaaaaaatcaccttttcttccctttgtttttaatccgtttgttgttgtggaaaagtatgaatttgttattacgcattgattttctgtgtccttaagtactgcctaaagatgaagcaaattttgaactggcaattacgataaggaaaccctttagttctggagactttagtagactctgttagattagggaggcctcacaggctggccggctccaaggacggtcactcactgtcagtgtggcgtggctttatttgcttaaataccttcatttgtatagtatgtctcacttgaaattgctttgtatacattttgtaaaaatatttataaaatgttttgtaaaaaaaaaaaaaagtataacaaattgcagtttattttgttatgttggataaatactgttaaaccagtcagtacctatattgttaatccatggttagggtatgttcagttggagattacaaaatgaaacaaccattgcaatacagccaaagatttgggaaaacgtg

SEQ ID NO: 233 - protein, 1074 aa, Mus musculus
MDDDDDSCLLDLIGDPQALNYFLHGPSSKSGSDDVTNAGYSAANSNSIFANSTNADPKSALKGVSDQLGEGPSDGLPLASSLQFLEDELESSPLPDLSEDQPFDILQKSLQEANITEQTLAEEAYLDASIGSSQQFAQAQLHPSSSASFTQASNVSNYSGQTLQPIGVTHVPVGASFASNTVGVQHGFMQHVGISVPSQHLPNSSQISGSGQIQLIGSFGNQPSMMTINNLDGSQIILKGSGQQAPSNVSGGLLVHRQTPNGNSLFGNSTSSPVAQPVTVPFNSTNFQASLPVHNIIIQRGLAPNSNKVPINIQPKPVQMGQQSAYNVNNLGIQQHHAQQGISFAPTSSPQGSVVGPHMSVNIVNQQNTRKPVTSQAVSGTGGSIVIHSPMGQPHTPQSQFLIPTSLSVSSNSVHHVQAINGQLLQTQPSQLISGQVASEHVMLNRNSSNMLRTNQPYSGQMLNNQNTAVQLVSGQTFATSGSPVIVNHASPQIVGGQMPLQQASPTVLHLSPGQSSVSQGRPGFATMPAVSGMAGPARFPAVSSASTAHPTLGPTVQSGAPGSNFTGDQLTQANRTPAPVSVSHRLPVSASKSPSTLSNTPGTQQQFFCQAQKKCLNQTSPIPTSKTTDGLRPSQIPGLLSTALPGQDSGSKIMPATLGATQAQPESSVGSSPSQTAVQVDSHPGQKRPAAKQLTKGAFILQQLQRDQAHAVTPDKSQFRSLNDTVQRLLSYHVCQGSMPTEEDLRQVDNEFEEVATQLLKRTQAMLNKYRFLLLEDAMRINPSAEMVMIDRMFNQEERASLSRDKRLALVDPEGFQADFCCSFKLDEAVPETPLDRSDQHRSKTSSLHQVPRAQSRDRAKPGMAEATNHDQFHLVPNHIVVSAEGNISKKSEGHSRTLKFDRGVLGQYRGPPEDKGGRRDPAKVSRCSPGPEGHRKSLPRPDHGSESKLPGVLASSHMEMPCLDSFQDKALRNSPKNEVLHTDIMKGSGEPQPDLQLTKSLEKTFKNILELKNSGRPPSDPTASGAADLDFPSFSPMASQENCLEKFIPDHSEGVVETDSILEAAVNSILEC

SEQ ID NO: 234 - DNA, 2699 bp, Homo sapiens
ctgccgcggccccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactgggtgtttaaaaaa

SEQ ID NO: 235 - protein, 597 aa, Homo sapiens
MGKKHKKHKAEWRSSYEDYADKPLEKPLKLVLKVGGSEVTELSGSGHDSSYYDDRSDHERERHKEKKKKKKKKSEKEKHLDDEERRKRKEEKKRKREREHCDTEGEADDFDPGKKVEVEPPPDRPVRACRTQPAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 236 - DNA, 2526 bp, Homo sapiens
acgggggaggagttccgggcacgcggacgggggtcctgggcaccgggcgagattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaacaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactgggtgtttaaaaaa

SEQ ID NO: 237 - protein, 544 aa, Homo sapiens
MMTGQTMSERGTKKRKRRRRRSPRRRSIWTMRKEGSERKRRSGSERGSTVTRRERLTTLILGRRWRWSRPQIGQSERAGHSQPKMRAHLFSNSWNTSSASFRDPHGFFAFPVTDAIAPGYSMIIKHPMDFGTMKDKIVANEYKSVTEFKADFKLMCDNAMTYNRPDTVYYKLAKKILHAGFKMMSKQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 238 - DNA, 2878 bp, Homo sapiens
ctgccgcggccccgcctcgccccgtttccggcgcggcccagcgagctcggcaacctcggcgcagcgagcgcgggcggccagccagggccagggggcggtggcggccaaggtccgaccgggtgccagctgttcccagcccccgcctcgggcccgccgccggcgccgccatgggcaagaagcacaagaagcacaaggccgagtggcgctcgtcctacgaggattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggaagagaagaagcggaagcgagagagggagcactgtgacacggagggagaggctgacgactttgatcctgggaagaaggtggaggtggagccgcccccagatcggccagtccgagcgtgccggacacagccagttctcggtggaacttaaaatgctgtgagacaccagacagacagatactgtgaacttggagctctctaatgaagggataccaaagtcttgtattcaatttttttttccttaaattgtcagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcaggctttaagatgatgagcaaagagcggctgttagctttgaagcgcagcatgtcgtttatgcaggacatggatttttctcagcaggcagctcttttgggcaatgaagatacagctgttgaggaacctgtccctgaagttgtaccagtacaagtagaaactgccaagaaatccaaaaagccgagtagagaagttatcagctgcatgtttgagcctgaagggaatgcctgcagcttgacggacagtaccgcagaggagcacgtgctggcgctggtggagcacgcagctgacgaagctcgggacaggatcaaccggttcctcccaggcggcaagatgggctatctgaagaggaacggggacgggagcctgctctacagcgtggtcaacacggccgagccggacgctgatgaggaggagacccacccggtggacttgagctcgctctccagtaagctactcccaggcttcaccacgctgggcttcaaagacgagagaagaaacaaagtcacctttctctccagtgccactactgcgctttcgatgcagaataattcagtatttggcgacttgaagtcggacgagatggagctgctctactcagcctacggagatgagacaggcgtgcagtgtgcgctgagcctgcaggagtttgtgaaggatgctgggagctacagcaagaaagtggtggacgacctcctggaccagatcacaggcggagaccactctaggacgctcttccagctgaagcagagaagaaatgttcccatgaagcctccagatgaagccaaggttggggacaccctaggagacagcagcagctctgttctggagttcatgtcgatgaagtcctatcccgacgtttctgtggatatctccatgctcagctctctggggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggaagcccttctcgcctgagtgtcggggagcagccagacgtcacccacgacccctatgagtttcttcagtctccagagcctgcggcctctgccaagacctaactctagaccaccttcagctcttttattttatttttttagttttattttgcacgtgtagagtttttgtcatcagacaaggactttgatcctgtcccctttggcatgcgggaagcagccgcggggaggtaatgaattgtctgtggtatcatgtcagcagagtctccaagccccacgaaccctgaggagtggagtcatacgcgaaggccatatggccatcgtgtcagcagagagagtctctgtacacagccccgtgaaccctgaggagtggagtcatacacgaagggcgtgtggccatcgtgtcagcagagagagtctctgtacacagccccgtgaaccctgaggagtggagtcatacgcgaagggtgtgtggccaggctgcagagctgcgtgccgtttgtgtccgagcatcacgtgtggctccagcccttgtttctgccagtgtagacacctctgtctgccccactgtcctggggtcgctcttgggaggcacaggcatgggtgtgtctggcctcattctgtatcagtccagtgtgttcctgtcatagtttgtgtctcccaggcaggccatggtaggggcctcgcaggggccattggggagcacagggccaggctggggtgaggagagctcccctgttttctgtttaattgatgagcctgggaaaggagtgtgttctgcctgcccgttacagtggagcgttccgtgtccataaaacgttttctaactgggtgtttaaaaaa

SEQ ID NO: 239 - protein, 501 aa, Homo sapiens
MKGYQSLVFNFFFLKLSAENESTPIQQLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKERLLALKRSMSFMQDMDFSQQAALLGNEDTAVEEPVPEVVPVQVETAKKSKKPSREVISCMFEPEGNACSLTDSTAEEHVLALVEHAADEARDRINRFLPGGKMGYLKRNGDGSLLYSVVNTAEPDADEEETHPVDLSSLSSKLLPGFTTLGFKDERRNKVTFLSSATTALSMQNNSVFGDLKSDEMELLYSAYGDETGVQCALSLQEFVKDAGSYSKKVVDDLLDQITGGDHSRTLFQLKQRRNVPMKPPDEAKVGDTLGDSSSSVLEFMSMKSYPDVSVDISMLSSLGKVKKELDPDDSHLNLDETTKLLQDLHEAQAERGGSRPSSNLSSLSNASERDQHHLGSPSRLSVGEQPDVTHDPYEFLQSPEPAASAKT

SEQ ID NO: 240 - protein, 597 aa, Mus musculus
MGKKHKKHKAEWRSSYEDYTDTPLEKPLKLVLKVGGSEVTELSGSGHDSSYYDDRSDHERERHREKKKKKKKKSEKEKHLDEEERRKRKEEKKRKREKEHCDSEGEADAFDPGKKVEVEPPPDRPVRACRTQPAENESTPIQRLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKQAALLGSEDPAAEEPVPEVVPVQVETTKKSKKPSREVISCMFEPEGNACSLTDSTAEEHVLALVEHAADEARDRINRFLPGGKMGYLKKLGDGSLLYSVVNAPEPDADEEETHPVDLSSLSSKLLPGFTTLGFKDERRNKVTFLSSASTALSMQNNSVFGDLKSDEMELLYSAYGDETGVQCALSLQEFVKDAGSYSKKMVDDLLDQITGGDHSRMIFQLKQRRSIPMRPADEMKVGDPLGESGGPVLDFMSMKQYPDVSLDVSMLSSLGKVKKELDHEDSHLNLDETARLLQDLHEAQAERGGSRPSSNLSSLSTASEREHPPPGSPSRLSVGEQPDVAHDPYEFLQSPEPAAPAKN

SEQ ID NO: 241 - DNA, 2448 bp, Mus musculus
gcggtggcgaaggcgctacttccgactggcgcaggtcgagctaccggcagccgcttctcaccggatcccgtgctatctcagccatgggcaaaaagcacaagaagcacaaggcggaatggcgctcgtcctacgaagattatacagacacgccactggagaagcctctgaagctggtgctcaaggtgggaggaagtgaagtgacagagctctcaggatctggccacgactccagctactacgacgatcgctcagaccacgaacgggagagacacagagaaaagaagaaaaagaagaagaaaaagtcagagaaggagaagcacctcgatgaggaggagaggaggaagcggaaggaagagaagaaacggaaacgggagaaggaacactgcgactcagagggggaggctgatgctttcgaccctggaaagaaggtggaggtggagccacccccagaccgaccagtgagagcctgccgaacacagccagctgagaacgagagcacacctatccagaggcttctggaacacttcctccgccagctacagagaaaagatcctcatggattttttgcttttcctgttacggatgcaattgctcctgggtattcaatgataataaaacatcctatggactttggcacgatgaaagacaagattgtagctaatgaatataaatcagtcacagaatttaaggcagatttcaaattaatgtgtgataatgcgatgacgtacaatagaccagacaccgtgtactacaaattagccaagaagatcctgcacgcgggctttaagatgatgagcaaacaggcagctctcttgggcagtgaagacccagcagctgaggaacctgttcccgaggttgtcccagtgcaagtagaaactaccaagaaatccaaaaagccgagtagagaagttatcagctgcatgtttgagcctgaagggaatgcctgcagcctgacagacagcacggcagaggagcatgtgctagccctggtagagcacgcagctgatgaggctcgggacaggattaaccggtttctcccgggtggcaagatggggtacctgaagaagcttggagatggaagtctgctctacagcgtggtgaacgcacctgagcctgatgctgatgaggaggagacacaccctgtggacctgagttcactgtctagcaagttgctcccaggttttacaacattgggtttcaaagatgaaagaagaaataaagtcacattcctctccagtgccagcactgcactttcaatgcagaacaactctgtgtttggggacctgaagtcagatgagatggagcttctgtattccgcctatggagatgagactggtgtgcagtgtgcactgagcctgcaggaattcgtgaaggatgctggaagctatagcaagaagatggtagatgacctcctggaccaaatcacaggtggtgatcactcaaggatgatcttccagctgaagcagaggaggagcatccccatgagacctgcagatgagatgaaggttggggatccactgggagagagtggtggccctgttctggacttcatgtcaatgaaacagtatcctgatgtctccctggatgtgtccatgctcagctctctcgggaaagtaaagaaggagctggaccatgaagatagccacttgaacttggatgagacagccaggctcctgcaggacttacacgaagcacaagcagagcgaggaggctctcggccatcctccaaccttagctctctgtccactgcctctgagagggagcatcctcctccaggaagtccttctcgccttagtgttggggagcagccggatgtcgcccacgacccttatgaattccttcagtctccagaacctgcagctcctgccaagaactaacttgtggtgttcccagatggtttattttatttttctacattttatttgatacagtttttgtcacaagacagaaacttttgtctcatcctctctggcaagtagcagcctgaggaagatgctggcttgtctgtaccgtcacgtctgcagcagaggcccagtagcaccgaatggtgtccaataagctctgagcagtggcaatagaatgtcaacggattgcaatcagatggctcaactctgtgtctcctgagcaccagcagccaagcctgttcatgatgatgtgcacacagtcattctacaggagctttgcacagccttcctgcagttctcaaaggggagcctgcagactaggccttcagagggttccttctgtttcctatttgggcactgagccagaggatggagttgtctccctgacaaataatgaaccaccccaccttttagaatgaagtataaatgaagtcataaaatgtttcaatgttttgctgagtacctgtttgtatttataaaaaacatgaacacaggtcctaataaagagatgcctaaggcggtaaaaaaaaaaaaaaaaaaaaaa

SEQ ID NO: 242 - protein, 596 aa, Mus musculus
MGKKHKKHKAEWRSSYEDYTDTPLEKPLKLVLKVGGSEVTELSGSGHDSSYYDDRSDHERERHREKKKKKKKKSEKEKHLDEEERRKRKEEKKRKREKEHCDSEGEADAFDPGKKVEVEPPPDRPVRACRTQPAENESTPIQRLLEHFLRQLQRKDPHGFFAFPVTDAIAPGYSMIIKHPMDFGTMKDKIVANEYKSVTEFKADFKLMCDNAMTYNRPDTVYYKLAKKILHAGFKMMSKAALLGSEDPAAEEPVPEVVPVQVETTKKSKKPSREVISCMFEPEGNACSLTDSTAEEHVLALVEHAADEARDRINRFLPGGKMGYLKKLGDGSLLYSVVNAPEPDADEEETHPVDLSSLSSKLLPGFTTLGFKDERRNKVTFLSSASTALSMQNNSVFGDLKSDEMELLYSAYGDETGVQCALSLQEFVKDAGSYSKKMVDDLLDQITGGDHSRMIFQLKQRRSIPMRPADEMKVGDPLGESGGPVLDFMSMKQYPDVSLDVSMLSSLGKVKKELDHEDSHLNLDETARLLQDLHEAQAERGGSRPSSNLSSLSTASEREHPPPGSPSRLSVGEQPDVAHDPYEFLQSPEPAAPAKN

SEQ ID NO: 243 - DNA, 2445 bp, Mus musculus
gcggtggcgaaggcgctacttccgactggcgcaggtcgagctaccggcagccgcttctcaccggatcccgtgctatctcagccatgggcaaaaagcacaagaagcacaaggcggaatggcgctcgtcctacgaagattatacagacacgccactggagaagcctctgaagctggtgctcaaggtgggaggaagtgaagtgacagagctctcaggatctggccacgactccagctactacgacgatcgctcagaccacgaacgggagagacacagagaaaagaagaaaaagaagaagaaaaagtcagagaaggagaagcacctcgatgaggaggagaggaggaagcggaaggaagagaagaaacggaaacgggagaaggaacactgcgactcagagggggaggctgatgctttcgaccctggaaagaaggtggaggtggagccacccccagaccgaccagtgagagcctgccgaacacagccagctgagaacgagagcacacctatccagaggcttctggaacacttcctccgccagctacagagaaaagatcctcatggattttttgcttttcctgttacggatgcaattgctcctgggtattcaatgataataaaacatcctatggactttggcacgatgaaagacaagattgtagctaatgaatataaatcagtcacagaatttaaggcagatttcaaattaatgtgtgataatgcgatgacgtacaatagaccagacaccgtgtactacaaattagccaagaagatcctgcacgcgggctttaagatgatgagcaaagcagctctcttgggcagtgaagacccagcagctgaggaacctgttcccgaggttgtcccagtgcaagtagaaactaccaagaaatccaaaaagccgagtagagaagttatcagctgcatgtttgagcctgaagggaatgcctgcagcctgacagacagcacggcagaggagcatgtgctagccctggtagagcacgcagctgatgaggctcgggacaggattaaccggtttctcccgggtggcaagatggggtacctgaagaagcttggagatggaagtctgctctacagcgtggtgaacgcacctgagcctgatgctgatgaggaggagacacaccctgtggacctgagttcactgtctagcaagttgctcccaggttttacaacattgggtttcaaagatgaaagaagaaataaagtcacattcctctccagtgccagcactgcactttcaatgcagaacaactctgtgtttggggacctgaagtcagatgagatggagcttctgtattccgcctatggagatgagactggtgtgcagtgtgcactgagcctgcaggaattcgtgaaggatgctggaagctatagcaagaagatggtagatgacctcctggaccaaatcacaggtggtgatcactcaaggatgatcttccagctgaagcagaggaggagcatccccatgagacctgcagatgagatgaaggttggggatccactgggagagagtggtggccctgttctggacttcatgtcaatgaaacagtatcctgatgtctccctggatgtgtccatgctcagctctctcgggaaagtaaagaaggagctggaccatgaagatagccacttgaacttggatgagacagccaggctcctgcaggacttacacgaagcacaagcagagcgaggaggctctcggccatcctccaaccttagctctctgtccactgcctctgagagggagcatcctcctccaggaagtccttctcgccttagtgttggggagcagccggatgtcgcccacgacccttatgaattccttcagtctccagaacctgcagctcctgccaagaactaacttgtggtgttcccagatggtttattttatttttctacattttatttgatacagtttttgtcacaagacagaaacttttgtctcatcctctctggcaagtagcagcctgaggaagatgctggcttgtctgtaccgtcacgtctgcagcagaggcccagtagcaccgaatggtgtccaataagctctgagcagtggcaatagaatgtcaacggattgcaatcagatggctcaactctgtgtctcctgagcaccagcagccaagcctgttcatgatgatgtgcacacagtcattctacaggagctttgcacagccttcctgcagttctcaaaggggagcctgcagactaggccttcagagggttccttctgtttcctatttgggcactgagccagaggatggagttgtctccctgacaaataatgaaccaccccaccttttagaatgaagtataaatgaagtcataaaatgtttcaatgttttgctgagtacctgtttgtatttataaaaaacatgaacacaggtcctaataaagagatgcctaaggcggtaaaaaaaaaaaaaaaaaaaaaa

SEQ ID NO: 244 - protein, 675 aa, Homo sapiens
MKMQKAGPPVPASHIAPAPVQPPMIRRDITFPPGSVEATQPVLKQRRRLTMKDIGTPEAWRVMMSLKSGLLAESTWALDTINILLYDDNSIMTFNLSQLPGLLELLVEYFRRCLIEIFGILKEYEVGDPGQRTLLDPGRFSKVSSPAPMEGGEEEEELLGPKLEEEEEEEVVENDEEIAFSGKDKPASENSEEKLISKFDKLPVKIVQKNDPFVVDCSDKLGRVQEFDSGLLHWRIGGGDTTEHIQTHFESKTELLPSRPHAPCPPAPRKHVTTAEGTPGTTDQEGPPPDGPPEKRITATMDDMLSTRSSTLTEDGAKSSEAIKESSKFPFGISPAQSHRNIKILEDEPHSKDETPLCTLLDWQDSLAKRCVCVSNTIRSLSFVPGNDFEMSKHPGLLLILGKLILLHHKHPERKQAPLTYEKEEEQDQGVSCNKVEWWWDCLEMLRENTLVTLANISGQLDLSPYPESICLPVLDGLLHWAVCPSAEAQDPFSTLGPNAVLSPQRLVLETLSKLSIQDNNVDLILATPPFSRLEKLYSTMVRFLSDRKNPVCREMAVVLLANLAQGDSLAARAIAVQKGSIGNLLGFLEDSLAATQFQQSQASLLHMQNPPFEPTSVDMMRRAARALLALAKVDENHSEFTLYESRLLDISVSPLMNSLVSQVICDVLFLIGQS

SEQ ID NO: 245 - protein, 870 aa, Homo sapiens
MANSTGKAPPDERRKGLAFLDELRQFHHSRGSPFKKIPAVGGKELDLHGLYTRVTTLGGFAKVSEKNQWGEIVEEFNFPRSCSNAAFALKQYYLRYLEKYEKVHHFGEDDDEVPPGNPKPQLPIGAIPSSYNYQQHSVSDYLRQSYGLSMDFNSPNDYNKLVLSLLSGLPNEVDFAINVCTLLSNESKHVMQLEKDPKIITLLLANAGVFDDTLGSFSTVFGEEWKEKTDRDFVKFWKDIVDDNEVRDLISDRNKSHEGTSGEWIWESLFHPPRKLGINDIEGQRVLQIAVILRNLSFEEGNVKLLAANRTCLRFLLLSAHSHFISLRQLGLDTLGNIAAELLLDPVDFKTTHLMFHTVTKCLMSRDRFLKMRGMEILGNLCKAEDNGVLICEYVDQDSYREIICHLTLPDVLLVISTLEVLYMLTEMGDVACTKIAKVEKSIDMLVCLVSMDIQMFGPDALAAVKLIEHPSSSHQMLSEIRPQAIEQVQTQTHVASAPASRAVVAQHVAPPPGIVEIDSEKFACQWLNAHFEVNPDCSVSRAEMYSEYLSTCSKLARGGILTSTGFYKCLRTVFPNHTVKRVEDSSSNGQAHIHVVGVKRRAIPLPIQMYYQQQPVSTSVVRVDSNTPMPPSPAVQVQGQPNSSQPSPFSGSSQPGDPMRKPGQNFMCLWQSCKKWFQTPSQVFYHAATEHGGKDVYPGQCLWEGCEPFQRQRFSFITHLQDKHCSKDALLAGLKQDEPGQAGSQKSSTKQPTVGGTSSTPRAQKAIVNHPSAALMALRRGSRNLVFRDFTDEKEGPITKHIRLTAALILKNIGKYSECGRRLLKRHENNLSVLAISNMEASSTLAKCLYELNFTVQSKEQEKDSEMLQ

SEQ ID NO: 246 - protein, 17 aa, Homo sapiens
RRDTTLETALNSKAYKR

SEQ ID NO: 247 - protein, 12 aa, Homo sapiens
REARMTEKLEKQ

SEQ ID NO: 248 - protein, 18 aa, Homo sapiens
KKTACYDIDVEVDDPLKA

SEQ ID NO: 249 - protein, 17 aa, Homo sapiens
RQKHQEYLNSILQHAKD

SEQ ID NO: 250 - protein, 17 aa, Homo sapiens
RQKHQEYLNSILQHAKD

SEQ ID NO: 251 - protein, 17 aa, Homo sapiens
RQKHQEYLNSILQHAKD

SEQ ID NO: 252 - protein, 18 aa, Homo sapiens
RRQKHQEYLNSILQHAKD

SEQ ID NO: 253 - protein, 20 aa, Homo sapiens
RQKHQEYLNSILQHAKDFKE

SEQ ID NO: 254 - protein, 17 aa, Homo sapiens
RQKHQEYLNSILQHAKD

SEQ ID NO: 255 - protein, 20 aa, Homo sapiens
RQKHQEYLNSILQHAKDFKE

SEQ ID NO: 256 - protein, 17 aa, Homo sapiens
RQKHQEYLNSILQHAKD

SEQ ID NO: 257 - protein, 17 aa, Homo sapiens
RQKHQEYLNSILQHAKD

SEQ ID NO: 258 - protein, 20 aa, Homo sapiens
RQKHQEYLNSILQHAKDFKE

SEQ ID NO: 259 - protein, 13 aa, Homo sapiens
RKELPEYYELIRK

SEQ ID NO: 260 - protein, 13 aa, Homo sapiens
RKELPEYYELIRK

SEQ ID NO: 261 - protein, 11 aa, Homo sapiens
RDRKASANARK

SEQ ID NO: 262 - protein, 13 aa, Homo sapiens
RHQGTFTDEKSKA

SEQ ID NO: 263 - protein, 31 aa, Homo sapiens
KWILDTDIFNEWMNEEDYEVDENRKPVSFRQ

SEQ ID NO: 264 - protein, 10 aa, Homo sapiens
RKPVSFRQRI

SEQ ID NO: 265 - protein, 9 aa, Homo sapiens
RIRNHKYRS

SEQ ID NO: 266 - protein, 11 aa, Homo sapiens
RDRKASANARK

SEQ ID NO: 267 - protein, 9 aa, Homo sapiens
KKVQEAARA

SEQ ID NO: 268 - protein, 11 aa, Homo sapiens
RDRKASANARK

SEQ ID NO: 269 - protein, 22 aa, Homo sapiens
RSPQVPAAQQMLNFPEKNKEKP

SEQ ID NO: 270 - protein, 22 aa, Homo sapiens
RSPQVPAAQQMLNFPEKNKEKP

SEQ ID NO: 271 - protein, 22 aa, Homo sapiens
RLMEEDELPSWIIKDDAEVERL

SEQ ID NO: 272 - protein, 10 aa, Homo sapiens
RTKATVELKA

SEQ ID NO: 273 - protein, 10 aa, Homo sapiens
RTKATVELKA

SEQ ID NO: 274 - protein, 17 aa, Homo sapiens
RDTTLETALNSKAYKRS

SEQ ID NO: 275 - protein, 17 aa, Homo sapiens
KMKEEVPTALVEAHVRK

SEQ ID NO: 276 - protein, 17 aa, Homo sapiens
RQKHQEYLNSILQHAKD

SEQ ID NO: 277 - protein, 16 aa, Homo sapiens
KNVPSKSKAAASATRE

SEQ ID NO: 278 - protein, 16 aa, Homo sapiens
KNVPSKSKAAASATRE

SEQ ID NO: 279 - protein, 16 aa, Homo sapiens
KNVPSKSKAAASATRE

SEQ ID NO: 280 - protein, 16 aa, Homo sapiens
KNVPSKSKAAASATRE

SEQ ID NO: 281 - protein, 26 aa, Homo sapiens
RLQDSHDKEYINGDKYFQQIFDCPRL

SEQ ID NO: 282 - protein, 26 aa, Homo sapiens
RLQDSHDKEYINGDKYFQQIFDCPRL

SEQ ID NO: 283 - protein, 26 aa, Homo sapiens
RLQDSHDKEYINGDKYFQQIFDCPRL

SEQ ID NO: 284 - protein, 33 aa, Homo sapiens
REWTEQETLLLLEALEMYKDDWNKVSEHVGSRT

SEQ ID NO: 285 - protein, 33 aa, Homo sapiens; identical to SEQ ID NO: 284

SEQ ID NO: 286 - protein, 33 aa, Homo sapiens; identical to SEQ ID NO: 284

SEQ ID NO: 287 - protein, 33 aa, Homo sapiens; identical to SEQ ID NO: 284

SEQ ID NO: 288 - protein, 33 aa, Homo sapiens; identical to SEQ ID NO: 284

SEQ ID NO: 289 - protein, 33 aa, Homo sapiens; identical to SEQ ID NO: 284

SEQ ID NO: 290 - protein, 16 aa, Homo sapiens
RKLRIYISNTFSPSKA

SEQ ID NO: 291 - protein, 11 aa, Homo sapiens
RHIFAKVQQRR

SEQ ID NO: 292 - protein, 11 aa, Homo sapiens
KMADKVLPQRI

SEQ ID NO: 293 - protein, 12 aa, Homo sapiens
RKMADKVLPQRI

SEQ ID NO: 294 - protein, 12 aa, Homo sapiens
RKMADKVLPQRI

SEQ ID NO: 295 - protein, 12 aa, Homo sapiens
RKMADKVLPQRI

SEQ ID NO: 296 - protein, 12 aa, Homo sapiens
RKMADKVLPQRI

SEQ ID NO: 297 - protein, 11 aa, Homo sapiens
KMADKVLPQRI

SEQ ID NO: 298 - protein, 17 aa, Homo sapiens
KMKEEVPTALVEAHVRK

SEQ ID NO: 299 - protein, 14 aa, Homo sapiens
RKLEAELLQIEERH

SEQ ID NO: 300 - protein, 14 aa, Homo sapiens
RKLEAELLQIEERH

SEQ ID NO: 301 - protein, 15 aa, Homo sapiens
KSLVALLVETQMKKL

SEQ ID NO: 302 - protein, 15 aa, Homo sapiens
KSLVALLVETQMKKL

SEQ ID NO: 303 - protein, 14 aa, Homo sapiens
RKLEAELLQIEERH

SEQ ID NO: 304 - protein, 15 aa, Homo sapiens
KSLVALLVETQMKKL

SEQ ID NO: 305 - protein, 15 aa, Homo sapiens
KSLVALLVETQMKKL

SEQ ID NO: 306 - protein, 14 aa, Homo sapiens
RKLEAELLQIEERH

SEQ ID NO: 307 - protein, 14 aa, Homo sapiens
RKLEAELLQIEERH

SEQ ID NO: 308 - protein, 14 aa, Homo sapiens
RKLEAELLQIEERH

SEQ ID NO: 309 - protein, 14 aa, Homo sapiens
RKLEAELLQIEERH

SEQ ID NO: 310 - protein, 14 aa, Homo sapiens
RKLEAELLQIEERH

SEQ ID NO: 311 - protein, 18 aa, Homo sapiens
RKLEAELLQIEERHQEKK

SEQ ID NO: 312 - protein, 14 aa, Homo sapiens
RKLEAELLQIEERH

SEQ ID NO: 313 - protein, 14 aa, Homo sapiens
RKLEAELLQIEERH

SEQ ID NO: 314 - protein, 14 aa, Homo sapiens
RKLEAELLQIEERH

SEQ ID NO: 315 - protein, 14 aa, Homo sapiens
RKLEAELLQIEERH

SEQ ID NO: 316 - protein, 14 aa, Homo sapiens
RKLEAELLQIEERH

SEQ ID NO: 317 - protein, 17 aa, Homo sapiens
RKIKSLVALLVETQMKK

SEQ ID NO: 318 - protein, 17 aa, Homo sapiens
RKIKSLVALLVETQMKK

SEQ ID NO: 319 - protein, 17 aa, Homo sapiens
RKIKSLVALLVETQMKK

SEQ ID NO: 320 - protein, 17 aa, Homo sapiens
RKIKSLVALLVETQMKK

SEQ ID NO: 321 - protein, 17 aa, Homo sapiens
RKIKSLVALLVETQMKK

SEQ ID NO: 322 - protein, 17 aa, Homo sapiens
RKIKSLVALLVETQMKK

SEQ ID NO: 323 - protein, 12 aa, Homo sapiens
KAKHLAAVEERK

SEQ ID NO: 324 - protein, 12 aa, Homo sapiens
KAKHLAAVEERK

SEQ ID NO: 325 - protein, 8 aa, Homo sapiens
RMQVLKRQ

SEQ ID NO: 326 - protein, 25 aa, Homo sapiens
RDIGEGNLSTAAAAALAAAAVKAKH

SEQ ID NO: 327 - protein, 25 aa, Homo sapiens
RDIGEGNLSTAAAAALAAAAVKAKH

SEQ ID NO: 328 - protein, 25 aa, Homo sapiens
RDIGEGNLSTAAAAALAAAAVKAKH

SEQ ID NO: 329 - protein, 25 aa, Homo sapiens
RDIGEGNLSTAAAAALAAAAVKAKH

SEQ ID NO: 330 - protein, 25 aa, Homo sapiens
RDIGEGNLSTAAAAALAAAAVKAKH

SEQ ID NO: 331 - protein, 25 aa, Homo sapiens
RDIGEGNLSTAAAAALAAAAVKAKH

SEQ ID NO: 332 - protein, 25 aa, Homo sapiens
RDIGEGNLSTAAAAALAAAAVKAKH

SEQ ID NO: 333 - protein, 25 aa, Homo sapiens
RDIGEGNLSTAAAAALAAAAVKAKH

SEQ ID NO: 334 - protein, 25 aa, Homo sapiens
RDIGEGNLSTAAAAALAAAAVKAKH

SEQ ID NO: 335 - protein, 25 aa, Homo sapiens
RDIGEGNLSTAAAAALAAAAVKAKH

SEQ ID NO: 336 - protein, 9 aa, Homo sapiens
KKLEIKLRH

SEQ ID NO: 337 - protein, 9 aa, Homo sapiens
KKLEIKLRH

SEQ ID NO: 338 - protein, 8 aa, Homo sapiens
RHQEKKRK

SEQ ID NO: 339 - protein, 8 aa, Homo sapiens
RHQEKKRK

SEQ ID NO: 340 - protein, 8 aa, Homo sapiens
RHQEKKRK

SEQ ID NO: 341 - protein, 14 aa, Homo sapiens
RKLEAELLQIEERH

SEQ ID NO: 342 - protein, 22 aa, Homo sapiens
KASNPDLKLWEIGKIIGGMWRD

SEQ ID NO: 343 - protein, 21 aa, Homo sapiens
RKRPAPQQIQQVQQQAVQNRN

SEQ ID NO: 344 - protein, 15 aa, Homo sapiens
KSLVALLVETQMKKL

SEQ ID NO: 345 - protein, 15 aa, Homo sapiens
KSLVALLVETQMKKL

SEQ ID NO: 346 - protein, 21 aa, Homo sapiens
RKRPAPQQIQQVQQQAVQNRN

SEQ ID NO: 347 - protein, 16 aa, Homo sapiens
RQAFHMEQLKYAEMRA

SEQ ID NO: 348 - protein, 16 aa, Homo sapiens
RQAFHMEQLKYAEMRA

SEQ ID NO: 349 - protein, 16 aa, Homo sapiens
RQAFHMEQLKYAEMRA

SEQ ID NO: 350 - protein, 16 aa, Homo sapiens
RQAFHMEQLKYAEMRA

SEQ ID NO: 351 - protein, 16 aa, Homo sapiens
RQAFHMEQLKYAEMRA

SEQ ID NO: 352 - protein, 16 aa, Homo sapiens
RQAFHMEQLKYAEMRA

SEQ ID NO: 353 - protein, 19 aa, Homo sapiens
REFVICDKYLQQIFESQRM

SEQ ID NO: 354 - protein, 11 aa, Homo sapiens
KMADKILPQRI

SEQ ID NO: 355 - protein, 16 aa, Homo sapiens
RLLEDSALSKYDATKQ

SEQ ID NO: 356 - protein, 16 aa, Homo sapiens
RLLEDSALSKYDATKQ

SEQ ID NO: 357 - protein, 17 aa, Homo sapiens
RKFLESTDSFNNELKRL

SEQ ID NO: 358 - protein, 17 aa, Homo sapiens
RKFLESTDSFNNELKRL

SEQ ID NO: 359 - protein, 17 aa, Homo sapiens
RKFLESTDSFNNELKRL

SEQ ID NO: 360 - protein, 17 aa, Homo sapiens
RKFLESTDSFNNELKRL

SEQ ID NO: 361 - protein, 17 aa, Homo sapiens
RKFLESTDSFNNELKRL

SEQ ID NO: 362 - protein, 17 aa, Homo sapiens
RKFLESTDSFNNELKRL

SEQ ID NO: 363 - protein, 17 aa, Homo sapiens
RKFLESTDSFNNELKRL

SEQ ID NO: 364 - protein, 17 aa, Homo sapiens
RKFLESTDSFNNELKRL

SEQ ID NO: 365 - protein, 17 aa, Homo sapiens
RKFLESTDSFNNELKRL

SEQ ID NO: 366 - protein, 28 aa, Homo sapiens
RMEKGEPYMSIQPAEDPDDYDDGFSMKH

SEQ ID NO: 367 - protein, 28 aa, Homo sapiens
RMEKGEPYMSIQPAEDPDDYDDGFSMKH

SEQ ID NO: 368 - protein, 28 aa, Homo sapiens
RMEKGEPYMSIQPAEDPDDYDDGFSMKH

SEQ ID NO: 369 - protein, 28 aa, Homo sapiens
RMEKGEPYMSIQPAEDPDDYDDGFSMKH

SEQ ID NO: 370 - protein, 28 aa, Homo sapiens
RMEKGEPYMSIQPAEDPDDYDDGFSMKH

SEQ ID NO: 371 - protein, 28 aa, Homo sapiens
RMEKGEPYMSIQPAEDPDDYDDGFSMKH

SEQ ID NO: 372 - protein, 21 aa, Homo sapiens
RKRPAPQQIQQVQQQAVQNRN

SEQ ID NO: 373 - protein, 21 aa, Homo sapiens
RKRPAPQQIQQVQQQAVQNRN

SEQ ID NO: 374 - protein, 21 aa, Homo sapiens
RKRPAPQQIQQVQQQAVQNRN

SEQ ID NO: 375 - protein, 21 aa, Homo sapiens
RKRPAPQQIQQVQQQAVQNRN

SEQ ID NO: 376 - protein, 21 aa, Homo sapiens
RKRPAPQQIQQVQQQAVQNRN

SEQ ID NO: 377 - protein, 21 aa, Homo sapiens
RKRPAPQQIQQVQQQAVQNRN

SEQ ID NO: 378 - protein, 21 aa, Homo sapiens
RKRPAPQQIQQVQQQAVQNRN

SEQ ID NO: 379 - protein, 21 aa, Homo sapiens
RKRPAPQQIQQVQQQAVQNRN

SEQ ID NO: 380 - protein, 21 aa, Homo sapiens
RKRPAPQQIQQVQQQAVQNRN

SEQ ID NO: 381 - protein, 21 aa, Homo sapiens
RKRPAPQQIQQVQQQAVQNRN

SEQ ID NO: 382 - protein, 16 aa, Homo sapiens
KFLESTDSFNNELKRL

SEQ ID NO: 383 - protein, 16 aa, Homo sapiens
KFLESTDSFNNELKRL

SEQ ID NO: 384 - protein, 24 aa, Homo sapiens
KSSEAIKESSKFPFGISPAQSHRN

SEQ ID NO: 385 - protein, 24 aa, Homo sapiens
KSSEAIKESSKFPFGISPAQSHRN

SEQ ID NO: 386 - protein, 17 aa, Homo sapiens
RKFLESTDSFNNELKRL

SEQ ID NO: 387 - protein, 17 aa, Homo sapiens
RKFLESTDSFNNELKRL

SEQ ID NO: 388 - protein, 21 aa, Homo sapiens
RDITFPPGSVEATQPVLKQRR

SEQ ID NO: 389 - protein, 29 aa, Homo sapiens
RKHVTTAEGTPGTTDQEGPPPDGPPEKRI

SEQ ID NO: 390 - protein, 29 aa, Homo sapiens
RKHVTTAEGTPGTTDQEGPPPDGPPEKRI

SEQ ID NO: 391 - protein, 28 aa, Homo sapiens
RMEKGEPYMSIQPAEDPDDYDDGFSMKH

SEQ ID NO: 392 - protein, 28 aa, Homo sapiens
RMEKGEPYMSIQPAEDPDDYDDGFSMKH

SEQ ID NO: 393 - protein, 19 aa, Homo sapiens
KAYHNSPAYLAYINAKSRA

SEQ ID NO: 394 - protein, 19 aa, Homo sapiens
KAYHNSPAYLAYINAKSRA

SEQ ID NO: 395 - protein, 19 aa, Homo sapiens
KAYHNSPAYLAYINAKSRA

SEQ ID NO: 396 - protein, 19 aa, Homo sapiens
KAYHNSPAYLAYINAKSRA

SEQ ID NO: 397 - protein, 19 aa, Homo sapiens
KAYHNSPAYLAYINAKSRA

SEQ ID NO: 398 - protein, 19 aa, Homo sapiens
KAYHNSPAYLAYINAKSRA

SEQ ID NO: 399 - protein, 19 aa, Homo sapiens
KAYHNSPAYLAYINAKSRA

SEQ ID NO: 400 - protein, 19 aa, Homo sapiens
KAYHNSPAYLAYINAKSRA

SEQ ID NO: 401 - protein, 19 aa, Homo sapiens
KAYHNSPAYLAYINAKSRA

SEQ ID NO: 402 - protein, 19 aa, Homo sapiens
KAYHNSPAYLAYINAKSRA

SEQ ID NO: 403 - protein, 19 aa, Homo sapiens
KAYHNSPAYLAYINAKSRA

SEQ ID NO: 404 - protein, 19 aa, Homo sapiens
KAYHNSPAYLAYINAKSRA

SEQ ID NO: 405 - protein, 19 aa, Homo sapiens
KAYHNSPAYLAYINAKSRA

SEQ ID NO: 406 - protein, 19 aa, Homo sapiens
KAYHNSPAYLAYINAKSRA

SEQ ID NO: 407 - protein, 19 aa, Homo sapiens
KAYHNSPAYLAYINAKSRA

SEQ ID NO: 408 - protein, 19 aa, Homo sapiens
KAYHNSPAYLAYINAKSRA

SEQ ID NO: 409 - protein, 19 aa, Homo sapiens
KAYHNSPAYLAYINAKSRA

SEQ ID NO: 410 - protein, 19 aa, Homo sapiens
KAYHNSPAYLAYINAKSRA

SEQ ID NO: 411 - protein, 19 aa, Homo sapiens
KAYHNSPAYLAYINAKSRA

SEQ ID NO: 412 - protein, 19 aa, Homo sapiens
KAYHNSPAYLAYINAKSRA

SEQ ID NO: 413 - protein, 19 aa, Homo sapiens
KAYHNSPAYLAYINAKSRA

SEQ ID NO: 414 - protein, 19 aa, Homo sapiens
KAYHNSPAYLAYINAKSRA

SEQ ID NO: 415 - protein, 19 aa, Homo sapiens
KAYHNSPAYLAYINAKSRA

SEQ ID NO: 416 - protein, 18 aa, Homo sapiens
KESSKFPFGISPAQSHRN

SEQ ID NO: 417 - protein, 24 aa, Homo sapiens
KSSEAIKESSKFPFGISPAQSHRN

SEQ ID NO: 418 - protein, 24 aa, Homo sapiens
KSSEAIKESSKFPFGISPAQSHRN

SEQ ID NO: 419 - protein, 28 aa, Homo sapiens
RMEKGEPYMSIQPAEDPDDYDDGFSMKH

SEQ ID NO: 420 - protein, 19 aa, Homo sapiens
KAYHNSPAYLAYINAKSRA

SEQ ID NO: 421 - protein, 19 aa, Homo sapiens
KAYHNSPAYLAYINAKSRA

SEQ ID NO: 422 - protein, 19 aa, Homo sapiens
KAYHNSPAYLAYINAKSRA

SEQ ID NO: 423 - protein, 9 aa, Homo sapiens
RKVWDQVKA

SEQ ID NO: 424 - protein, 31 aa, Homo sapiens
RNIKILEDEPHSKDETPLCTLLDWQDSLAKR

SEQ ID NO: 425 - protein, 31 aa, Homo sapiens; identical to SEQ ID NO: 424

SEQ ID NO: 426 - protein, 31 aa, Homo sapiens; identical to SEQ ID NO: 424

SEQ ID NO: 427 - protein, 31 aa, Homo sapiens; identical to SEQ ID NO: 424

SEQ ID NO: 428 - protein, 31 aa, Homo sapiens; identical to SEQ ID NO: 424

SEQ ID NO: 429 - protein, 21 aa, Homo sapiens
RKRPAPQQIQQVQQQAVQNRN

SEQ ID NO: 430 - protein, 21 aa, Homo sapiens
RKRPAPQQIQQVQQQAVQNRN

SEQ ID NO: 431 - protein, 21 aa, Homo sapiens
RKRPAPQQIQQVQQQAVQNRN

SEQ ID NO: 432 - protein, 21 aa, Homo sapiens
RKRPAPQQIQQVQQQAVQNRN

SEQ ID NO: 433 - protein, 21 aa, Homo sapiens
RKRPAPQQIQQVQQQAVQNRN

SEQ ID NO: 434 - protein, 21 aa, Homo sapiens
RKRPAPQQIQQVQQQAVQNRN

SEQ ID NO: 435 - protein, 21 aa, Homo sapiens
RKRPAPQQIQQVQQQAVQNRN

SEQ ID NO: 436 - protein, 21 aa, Homo sapiens
RKRPAPQQIQQVQQQAVQNRN

SEQ ID NO: 437 - protein, 21 aa, Homo sapiens
RKRPAPQQIQQVQQQAVQNRN

SEQ ID NO: 438 - protein, 12 aa, Homo sapiens
RLEKLYSTMVRF

SEQ ID NO: 439 - protein, 12 aa, Homo sapiens
RLEKLYSTMVRF

SEQ ID NO: 440 - protein, 12 aa, Homo sapiens
RLEKLYSTMVRF

SEQ ID NO: 441 - protein, 12 aa, Homo sapiens
RLEKLYSTMVRF

SEQ ID NO: 442 - protein, 12 aa, Homo sapiens
RLEKLYSTMVRF

SEQ ID NO: 443 - protein, 12 aa, Homo sapiens
RLEKLYSTMVRF

SEQ ID NO: 444 - protein, 12 aa, Homo sapiens
RLEKLYSTMVRF

SEQ ID NO: 445 - protein, 12 aa, Homo sapiens
RLEKLYSTMVRF

SEQ ID NO: 446 - protein, 12 aa, Homo sapiens
RLEKLYSTMVRF

SEQ ID NO: 447 - protein, 12 aa, Homo sapiens
RLEKLYSTMVRF

SEQ ID NO: 448 - protein, 12 aa, Homo sapiens
RLEKLYSTMVRF

SEQ ID NO: 449 - protein, 12 aa, Homo sapiens
RLEKLYSTMVRF

SEQ ID NO: 450 - protein, 12 aa, Homo sapiens
RLEKLYSTMVRF

SEQ ID NO: 451 - protein, 12 aa, Homo sapiens
RLEKLYSTMVRF

SEQ ID NO: 452 - protein, 12 aa, Homo sapiens
RLEKLYSTMVRF

SEQ ID NO: 453 - protein, 12 aa, Homo sapiens
RLEKLYSTMVRF

SEQ ID NO: 454 - protein, 27 aa, Homo sapiens
RKAPGSDPFMSSGQGPNGGMGDPYSRA

SEQ ID NO: 455 - protein, 27 aa, Homo sapiens
RKAPGSDPFMSSGQGPNGGMGDPYSRA

SEQ ID NO: 456 - protein, 21 aa, Homo sapiens
RKRPAPQQIQQVQQQAVQNRN

SEQ ID NO: 457 - protein, 21 aa, Homo sapiens
RKRPAPQQIQQVQQQAVQNRN

SEQ ID NO: 458 - protein, 21 aa, Homo sapiens
RKRPAPQQIQQVQQQAVQNRN

SEQ ID NO: 459 - protein, 21 aa, Homo sapiens
RKRPAPQQIQQVQQQAVQNRN

SEQ ID NO: 460 - protein, 21 aa, Homo sapiens
RKRPAPQQIQQVQQQAVQNRN

SEQ ID NO: 461 - protein, 21 aa, Homo sapiens
RKRPAPQQIQQVQQQAVQNRN

SEQ ID NO: 462 - protein, 21 aa, Homo sapiens
RKRPAPQQIQQVQQQAVQNRN

SEQ ID NO: 463 - protein, 21 aa, Homo sapiens
RKRPAPQQIQQVQQQAVQNRN

SEQ ID NO: 464 - protein, 21 aa, Homo sapiens
RKRPAPQQIQQVQQQAVQNRN

SEQ ID NO: 465 - protein, 21 aa, Homo sapiens
RKRPAPQQIQQVQQQAVQNRN

SEQ ID NO: 466 - protein, 18 aa, Homo sapiens
KESSKFPFGISPAQSHRN

SEQ ID NO: 467 - protein, 18 aa, Homo sapiens
KESSKFPFGISPAQSHRN

SEQ ID NO: 468 - protein, 21 aa, Homo sapiens
RKRPAPQQIQQVQQQAVQNRN

SEQ ID NO: 469 - protein, 21 aa, Homo sapiens
RKRPAPQQIQQVQQQAVQNRN

SEQ ID NO: 470 - protein, 21 aa, Homo sapiens
RKRPAPQQIQQVQQQAVQNRN

SEQ ID NO: 471 - protein, 21 aa, Homo sapiens
RKRPAPQQIQQVQQQAVQNRN

SEQ ID NO: 472 - protein, 21 aa, Homo sapiens
RKRPAPQQIQQVQQQAVQNRN

SEQ ID NO: 473 - protein, 21 aa, Homo sapiens
RKRPAPQQIQQVQQQAVQNRN

SEQ ID NO: 474 - protein, 21 aa, Homo sapiens
RKRPAPQQIQQVQQQAVQNRN

SEQ ID NO: 475 - protein, 21 aa, Homo sapiens
RKRPAPQQIQQVQQQAVQNRN

SEQ ID NO: 476 - protein, 21 aa, Homo sapiens
RKRPAPQQIQQVQQQAVQNRN

SEQ ID NO: 477 - protein, 21 aa, Homo sapiens
RKRPAPQQIQQVQQQAVQNRN

SEQ ID NO: 478 - protein, 21 aa, Homo sapiens
RKRPAPQQIQQVQQQAVQNRN

SEQ ID NO: 479 - protein, 11 aa, Homo sapiens
KMADKILPQRI

SEQ ID NO: 480 - protein, 12 aa, Homo sapiens
KKMADKILPQRI

SEQ ID NO: 481 - protein, 9 aa, Homo sapiens
RNHNAKKKK

SEQ ID NO: 482 - protein, 9 aa, Homo sapiens
RNHNAKKKK

SEQ ID NO: 483 - protein, 9 aa, Homo sapiens
RNHNAKKKK

SEQ ID NO: 484 - protein, 9 aa, Homo sapiens
RNHNAKKKK

SEQ ID NO: 485 - protein, 9 aa, Homo sapiens
RNHNAKKKK

SEQ ID NO: 486 - protein, 9 aa, Homo sapiens
RNHNAKKKK

SEQ ID NO: 487 - protein, 8 aa, Homo sapiens
RKNPVCRE

SEQ ID NO: 488 - protein, 13 aa, Homo sapiens
RFLSDRKNPVCRE

SEQ ID NO: 489 - protein, 9 aa, Homo sapiens
RNHNAKKKK

SEQ ID NO: 490 - protein, 8 aa, Homo sapiens
RKNPVCRE

SEQ ID NO: 491 - protein, 9 aa, Homo sapiens
RNHNAKKKK

SEQ ID NO: 492 - protein, 8 aa, Homo sapiens
RKNPVCRE

SEQ ID NO: 493 - protein, 14 aa, Homo sapiens
RLDIQEALKRPIKQ

SEQ ID NO: 494 - protein, 14 aa, Homo sapiens
RLDIQEALKRPIKQ

SEQ ID NO: 495 - protein, 12 aa, Homo sapiens
KRLDIQEALKRP

SEQ ID NO: 496 - protein, 14 aa, Homo sapiens
RLDIQEALKRPIKQ

SEQ ID NO: 497 - protein, 14 aa, Homo sapiens
RLDIQEALKRPIKQ

SEQ ID NO: 498 - protein, 14 aa, Homo sapiens
RLDIQEALKRPIKQ

SEQ ID NO: 499 - protein, 14 aa, Homo sapiens
RLDIQEALKRPIKQ

SEQ ID NO: 500 - protein, 23 aa, Homo sapiens
RSNSVGIQDAFNDGSDSTFQKRN

SEQ ID NO: 501 - protein, 12 aa, Homo sapiens
KAKHLAAVEERK

SEQ ID NO: 502 - protein, 34 aa, Homo sapiens
KQAPLTYEKEEEQDQGVSCNKVEWWWDCLEMLRE

SEQ ID NO: 503 - protein, 12 aa, Homo sapiens
KLPIKCFLDFKA

SEQ ID NO: 504 - protein, 12 aa, Homo sapiens
KAKHLAAVEERK

SEQ ID NO: 505 - protein, 12 aa, Homo sapiens
KAKHLAAVEERK

SEQ ID NO: 506 - protein, 8 aa, Homo sapiens
KLEIKLRH

SEQ ID NO: 507 - protein, 9 aa, Homo sapiens
KKLEIKLRH

SEQ ID NO: 508 - protein, 29 aa, Homo sapiens
RKHVTTAEGTPGTTDQEGPPPDGPPEKRI

SEQ ID NO: 509 - protein, 29 aa, Homo sapiens
RKHVTTAEGTPGTTDQEGPPPDGPPEKRI

SEQ ID NO: 510 - protein, 29 aa, Homo sapiens
RKHVTTAEGTPGTTDQEGPPPDGPPEKRI

SEQ ID NO: 511 - protein, 29 aa, Homo sapiens
RKHVTTAEGTPGTTDQEGPPPDGPPEKRI

SEQ ID NO: 512 - protein, 29 aa, Homo sapiens
RKHVTTAEGTPGTTDQEGPPPDGPPEKRI

SEQ ID NO: 513 - protein, 29 aa, Homo sapiens
RKHVTTAEGTPGTTDQEGPPPDGPPEKRI

SEQ ID NO: 514 - protein, 29 aa, Homo sapiens
RKHVTTAEGTPGTTDQEGPPPDGPPEKRI

SEQ ID NO: 515 - protein, 29 aa, Homo sapiens
RKHVTTAEGTPGTTDQEGPPPDGPPEKRI

SEQ ID NO: 516 - protein, 29 aa, Homo sapiens
RKHVTTAEGTPGTTDQEGPPPDGPPEKRI

SEQ ID NO: 517 - protein, 29 aa, Homo sapiens
RKHVTTAEGTPGTTDQEGPPPDGPPEKRI

SEQ ID NO: 518 - protein, 29 aa, Homo sapiens
RKHVTTAEGTPGTTDQEGPPPDGPPEKRI

SEQ ID NO: 519 - protein, 29 aa, Homo sapiens
RKHVTTAEGTPGTTDQEGPPPDGPPEKRI

SEQ ID NO: 520 - protein, 29 aa, Homo sapiens
RKHVTTAEGTPGTTDQEGPPPDGPPEKRI

SEQ ID NO: 521 - protein, 28 aa, Homo sapiens
RKHVTTAEGTPGTTDQEGPPPDGPPEKR

SEQ ID NO: 522 - protein, 29 aa, Homo sapiens
RKHVTTAEGTPGTTDQEGPPPDGPPEKRI

SEQ ID NO: 523 - protein, 29 aa, Homo sapiens
RKHVTTAEGTPGTTDQEGPPPDGPPEKRI

SEQ ID NO: 524 - protein, 29 aa, Homo sapiens
RKHVTTAEGTPGTTDQEGPPPDGPPEKRI

SEQ ID NO: 525 - protein, 29 aa, Homo sapiens
RKHVTTAEGTPGTTDQEGPPPDGPPEKRI

SEQ ID NO: 526 - protein, 29 aa, Homo sapiens
RKHVTTAEGTPGTTDQEGPPPDGPPEKRI

SEQ ID NO: 527 - protein, 29 aa, Homo sapiens
RKHVTTAEGTPGTTDQEGPPPDGPPEKRI

SEQ ID NO: 528 - protein, 29 aa, Homo sapiens
RKHVTTAEGTPGTTDQEGPPPDGPPEKRI

SEQ ID NO: 529 - protein, 29 aa, Homo sapiens
RKHVTTAEGTPGTTDQEGPPPDGPPEKRI

SEQ ID NO: 530 - protein, 29 aa, Homo sapiens
RKHVTTAEGTPGTTDQEGPPPDGPPEKRI

SEQ ID NO: 531 - protein, 28 aa, Homo sapiens
RKHVTTAEGTPGTTDQEGPPPDGPPEKR

SEQ ID NO: 532 - protein, 29 aa, Homo sapiens
RKHVTTAEGTPGTTDQEGPPPDGPPEKRI

SEQ ID NO: 533 - protein, 29 aa, Homo sapiens
RKHVTTAEGTPGTTDQEGPPPDGPPEKRI

SEQ ID NO: 534 - protein, 29 aa, Homo sapiens
RKHVTTAEGTPGTTDQEGPPPDGPPEKRI

SEQ ID NO: 535 - protein, 29 aa, Homo sapiens
RKHVTTAEGTPGTTDQEGPPPDGPPEKRI

SEQ ID NO: 536 - protein, 28 aa, Homo sapiens
RKHVTTAEGTPGTTDQEGPPPDGPPEKR

SEQ ID NO: 537 - protein, 28 aa, Homo sapiens
RKHVTTAEGTPGTTDQEGPPPDGPPEKR

SEQ ID NO: 538 - protein, 28 aa, Homo sapiens
RKHVTTAEGTPGTTDQEGPPPDGPPEKR

SEQ ID NO: 539 - protein, 29 aa, Homo sapiens
RKHVTTAEGTPGTTDQEGPPPDGPPEKRI

SEQ ID NO: 540 - protein, 29 aa, Homo sapiens
RKHVTTAEGTPGTTDQEGPPPDGPPEKRI

SEQ ID NO: 541 - protein, 29 aa, Homo sapiens
RKHVTTAEGTPGTTDQEGPPPDGPPEKRI

SEQ ID NO: 542 - protein, 29 aa, Homo sapiens
RKHVTTAEGTPGTTDQEGPPPDGPPEKRI

SEQ ID NO: 543 - protein, 29 aa, Homo sapiens
RKHVTTAEGTPGTTDQEGPPPDGPPEKRI

SEQ ID NO: 544 - protein, 29 aa, Homo sapiens
RKHVTTAEGTPGTTDQEGPPPDGPPEKRI

SEQ ID NO: 545 - protein, 29 aa, Homo sapiens
RKHVTTAEGTPGTTDQEGPPPDGPPEKRI

SEQ ID NO: 546 - protein, 29 aa, Homo sapiens
RKHVTTAEGTPGTTDQEGPPPDGPPEKRI

SEQ ID NO: 547 - protein, 29 aa, Homo sapiens
RKHVTTAEGTPGTTDQEGPPPDGPPEKRI

SEQ ID NO: 548 - protein, 29 aa, Homo sapiens
RKHVTTAEGTPGTTDQEGPPPDGPPEKRI

SEQ ID NO: 549 - protein, 29 aa, Homo sapiens
RKHVTTAEGTPGTTDQEGPPPDGPPEKRI

SEQ ID NO: 550 - protein, 29 aa, Homo sapiens
RKHVTTAEGTPGTTDQEGPPPDGPPEKRI

SEQ ID NO: 551 - protein, 29 aa, Homo sapiens
RKHVTTAEGTPGTTDQEGPPPDGPPEKRI

SEQ ID NO: 552 - protein, 29 aa, Homo sapiens
RKHVTTAEGTPGTTDQEGPPPDGPPEKRI

SEQ ID NO: 553 - protein, 29 aa, Homo sapiens
RKHVTTAEGTPGTTDQEGPPPDGPPEKRI

SEQ ID NO: 554 - protein, 26 aa, Homo sapiens
RIGGGDTTEHIQTHFESKTELLPSRP

SEQ ID NO: 555 - protein, 36 aa, Homo sapiens
RIGGGDTTEHIQTHFESKTELLPSRPHAPCPPAPRK

SEQ ID NO: 556 - protein, 36 aa, Homo sapiens; identical to SEQ ID NO: 555

SEQ ID NO: 557 - protein, 36 aa, Homo sapiens; identical to SEQ ID NO: 555

SEQ ID NO: 558 - protein, 36 aa, Homo sapiens; identical to SEQ ID NO: 555

SEQ ID NO: 559 - protein, 36 aa, Homo sapiens; identical to SEQ ID NO: 555

SEQ ID NO: 560 - protein, 36 aa, Homo sapiens; identical to SEQ ID NO: 555

SEQ ID NO: 561 - protein, 36 aa, Homo sapiens; identical to SEQ ID NO: 555

SEQ ID NO: 562 - protein, 36 aa, Homo sapiens; identical to SEQ ID NO: 555

SEQ ID NO: 563 - protein, 36 aa, Homo sapiens; identical to SEQ ID NO: 555

SEQ ID NO: 564 - protein, 36 aa, Homo sapiens; identical to SEQ ID NO: 555

SEQ ID NO: 565 - protein, 13 aa, Homo sapiens
KDKPASENSEEKL

SEQ ID NO: 566 - protein, 8 aa, Homo sapiens
RKNPVCRE

SEQ ID NO: 567 - protein, 14 aa, Homo sapiens
RVDIQEALKRPMKQ

SEQ ID NO: 568 - protein, 14 aa, Homo sapiens
RVDIQEALKRPMKQ

SEQ ID NO: 569 - protein, 11 aa, Homo sapiens
RVDIQEALKRP

SEQ ID NO: 570 - protein, 14 aa, Homo sapiens
RVDIQEALKRPMKQ

SEQ ID NO: 571 - protein, 12 aa, Homo sapiens
KRVDIQEALKRP

SEQ ID NO: 572 - protein, 14 aa, Homo sapiens
RVDIQEALKRPMKQ

SEQ ID NO: 573 - protein, 14 aa, Homo sapiens
RVDIQEALKRPMKQ

SEQ ID NO: 574 - protein, 14 aa, Homo sapiens
RVDIQEALKRPMKQ

SEQ ID NO: 575 - protein, 14 aa, Homo sapiens
RVDIQEALKRPMKQ

SEQ ID NO: 576 - protein, 14 aa, Homo sapiens
RVDIQEALKRPMKQ

SEQ ID NO: 577 - protein, 29 aa, Homo sapiens
KILEDEPHSKDETPLCTLLDWQDSLAKRC

SEQ ID NO: 578 - protein, 23 aa, Homo sapiens
RALLALAKVDENHSEFTLYESRL

SEQ ID NO: 579 - protein, 24 aa, Homo sapiens
KSSEAIKESSKFPFGISPAQSHRN

SEQ ID NO: 580 - protein, 7 aa, Homo sapiens
RNHKYRS

SEQ ID NO: 581 - protein, 10 aa, Homo sapiens
KYKLNVDQKV

SEQ ID NO: 582 - protein, 18 aa, Homo sapiens
RGQPLPDHLQMAVQGKRP

SEQ ID NO: 583 - protein, 18 aa, Homo sapiens
RGQPLPDHLQMAVQGKRP

SEQ ID NO: 584 - protein, 12 aa, Homo sapiens
RYNQMKGMGMRS

SEQ ID NO: 585 - protein, 18 aa, Homo sapiens
RGQPLPDHLQMAVQGKRP

SEQ ID NO: 586 - protein, 12 aa, Homo sapiens
RYNQMKGMGMRS

SEQ ID NO: 587 - protein, 12 aa, Homo sapiens
RYNQMKGMGMRS

SEQ ID NO: 588 - protein, 12 aa, Homo sapiens
RYNQMKGMGMRS

SEQ ID NO: 589 - protein, 12 aa, Homo sapiens
RYNQMKGMGMRS

SEQ ID NO: 590 - protein, 29 aa, Homo sapiens
RKHVTTAEGTPGTTDQEGPPPDGPPEKRI

SEQ ID NO: 591 - protein, 29 aa, Homo sapiens
RKHVTTAEGTPGTTDQEGPPPDGPPEKRI

SEQ ID NO: 592 - protein, 29 aa, Homo sapiens
RKHVTTAEGTPGTTDQEGPPPDGPPEKRI

SEQ ID NO: 593 - protein, 9 aa, Homo sapiens
RKPLDLYRL

SEQ ID NO: 594 - protein, 29 aa, Homo sapiens
RKHVTTAEGTPGTTDQEGPPPDGPPEKRI

SEQ ID NO: 595 - protein, 20 aa, Homo sapiens
KIVQKNDPFVVDCSDKLGRV

SEQ ID NO: 596 - protein, 29 aa, Homo sapiens
RKHVTTAEGTPGTTDQEGPPPDGPPEKRI

SEQ ID NO: 597 - protein, 29 aa, Homo sapiens
RKHVTTAEGTPGTTDQEGPPPDGPPEKRI

SEQ ID NO: 598 - protein, 29 aa, Homo sapiens
RKHVTTAEGTPGTTDQEGPPPDGPPEKRI

SEQ ID NO: 599 - protein, 29 aa, Homo sapiens
RKHVTTAEGTPGTTDQEGPPPDGPPEKRI

SEQ ID NO: 600 - protein, 29 aa, Homo sapiens
RKHVTTAEGTPGTTDQEGPPPDGPPEKRI

SEQ ID NO: 601 - protein, 29 aa, Homo sapiens
RKHVTTAEGTPGTTDQEGPPPDGPPEKRI

SEQ ID NO: 602 - protein, 29 aa, Homo sapiens
RKHVTTAEGTPGTTDQEGPPPDGPPEKRI

SEQ ID NO: 603 - protein, 29 aa, Homo sapiens
RKHVTTAEGTPGTTDQEGPPPDGPPEKRI

SEQ ID NO: 604 - protein, 29 aa, Homo sapiens
RKHVTTAEGTPGTTDQEGPPPDGPPEKRI

SEQ ID NO: 605 - protein, 29 aa, Homo sapiens
RKHVTTAEGTPGTTDQEGPPPDGPPEKRI

SEQ ID NO: 606 - protein, 29 aa, Homo sapiens
RKHVTTAEGTPGTTDQEGPPPDGPPEKRI

SEQ ID NO: 607 - protein, 29 aa, Homo sapiens
RKHVTTAEGTPGTTDQEGPPPDGPPEKRI

SEQ ID NO: 608 - protein, 29 aa, Homo sapiens
RKHVTTAEGTPGTTDQEGPPPDGPPEKRI

SEQ ID NO: 609 - protein, 29 aa, Homo sapiens
RKHVTTAEGTPGTTDQEGPPPDGPPEKRI

SEQ ID NO: 610 - protein, 29 aa, Homo sapiens
RKHVTTAEGTPGTTDQEGPPPDGPPEKRI

SEQ ID NO: 611 - protein, 29 aa, Homo sapiens
RKHVTTAEGTPGTTDQEGPPPDGPPEKRI

SEQ ID NO: 612 - protein, 29 aa, Homo sapiens
RKHVTTAEGTPGTTDQEGPPPDGPPEKRI

SEQ ID NO: 613 - protein, 29 aa, Homo sapiens
RKHVTTAEGTPGTTDQEGPPPDGPPEKRI

SEQ ID NO: 614 - protein, 29 aa, Homo sapiens
RKHVTTAEGTPGTTDQEGPPPDGPPEKRI

SEQ ID NO: 615 - protein, 29 aa, Homo sapiens
RKHVTTAEGTPGTTDQEGPPPDGPPEKRI

SEQ ID NO: 616 - protein, 29 aa, Homo sapiens
RKHVTTAEGTPGTTDQEGPPPDGPPEKRI

SEQ ID NO: 617 - protein, 29 aa, Homo sapiens
RKHVTTAEGTPGTTDQEGPPPDGPPEKRI

SEQ ID NO: 618 - protein, 29 aa, Homo sapiens
RKHVTTAEGTPGTTDQEGPPPDGPPEKRI

SEQ ID NO: 619 - protein, 29 aa, Homo sapiens
RCLIEIFGILKEYEVGDPGQRTLLDPGRF

SEQ ID NO: 620 - protein, 9 aa, Homo sapiens
RKASANARK

SEQ ID NO: 621 - protein, 8 aa, Homo sapiens
RKNPVCRE

SEQ ID NO: 622 - protein, 36 aa, Homo sapiens; identical to SEQ ID NO: 555

SEQ ID NO: 623 - protein, 36 aa, Homo sapiens; identical to SEQ ID NO: 555

SEQ ID NO: 624 - protein, 36 aa, Homo sapiens; identical to SEQ ID NO: 555

SEQ ID NO: 625 - protein, 36 aa, Homo sapiens; identical to SEQ ID NO: 555

SEQ ID NO: 626 - protein, 36 aa, Homo sapiens; identical to SEQ ID NO: 555

SEQ ID NO: 627 - protein, 36 aa, Homo sapiens; identical to SEQ ID NO: 555

SEQ ID NO: 628 - protein, 36 aa, Homo sapiens; identical to SEQ ID NO: 555

SEQ ID NO: 629 - protein, 36 aa, Homo sapiens; identical to SEQ ID NO: 555

SEQ ID NO: 630 - protein, 36 aa, Homo sapiens; identical to SEQ ID NO: 555

SEQ ID NO: 631 - protein, 36 aa, Homo sapiens; identical to SEQ ID NO: 555

SEQ ID NO: 632 - protein, 36 aa, Homo sapiens; identical to SEQ ID NO: 555

SEQ ID NO: 633 - protein, 36 aa, Homo sapiens; identical to SEQ ID NO: 555

SEQ ID NO: 634 - protein, 36 aa, Homo sapiens; identical to SEQ ID NO: 555

SEQ ID NO: 635 - protein, 36 aa, Homo sapiens; identical to SEQ ID NO: 555

SEQ ID NO: 636 - protein, 36 aa, Homo sapiens; identical to SEQ ID NO: 555

SEQ ID NO: 637 - protein, 36 aa, Homo sapiens; identical to SEQ ID NO: 555

SEQ ID NO: 638 - protein, 36 aa, Homo sapiens; identical to SEQ ID NO: 555

SEQ ID NO: 639 - protein, 13 aa, Homo sapiens
RHQGTFTDEKSKA

SEQ ID NO: 640 - protein, 13 aa, Homo sapiens
RHQGTFTDEKSKA

SEQ ID NO: 641 - protein, 14 aa, Homo sapiens
RGKGEITPAAIQKM

SEQ ID NO: 642 - protein, 14 aa, Homo sapiens
RGKGEITPAAIQKM

SEQ ID NO: 643 - protein, 16 aa, Homo sapiens
RMSYEPNKDPYGSMRK

SEQ ID NO: 644 - protein, 35 aa, Homo sapiens
KSPFLHSGMKMQKAGPPVPASHIAPAPVQPPMIRR

SEQ ID NO: 645 - protein, 22 aa, Homo sapiens
KLLGEQYYKDAMEQCHNYNARL

SEQ ID NO: 646 - protein, 22 aa, Homo sapiens
KLLGEQYYKDAMEQCHNYNARL

SEQ ID NO: 647 - protein, 22 aa, Homo sapiens
KLLGEQYYKDAMEQCHNYNARL

SEQ ID NO: 648 - protein, 22 aa, Homo sapiens
KLLGEQYYKDAMEQCHNYNARL

SEQ ID NO: 649 - protein, 22 aa, Homo sapiens
KLLGEQYYKDAMEQCHNYNARL

SEQ ID NO: 650 - protein, 22 aa, Homo sapiens
KLLGEQYYKDAMEQCHNYNARL

SEQ ID NO: 651 - protein, 22 aa, Homo sapiens
KLLGEQYYKDAMEQCHNYNARL

SEQ ID NO: 652 - protein, 22 aa, Homo sapiens
KLLGEQYYKDAMEQCHNYNARL

SEQ ID NO: 653 - protein, 19 aa, Homo sapiens
KKEGLISQDGSSLEALLRT

SEQ ID NO: 654 - protein, 16 aa, Homo sapiens
RRLTMKDIGTPEAWRV

SEQ ID NO: 655 - protein, 15 aa, Homo sapiens
RLTMKDIGTPEAWRV

SEQ ID NO: 656 - protein, 16 aa, Homo sapiens
RRLTMKDIGTPEAWRV

SEQ ID NO: 657 - protein, 29 aa, Homo sapiens
KILEDEPHSKDETPLCTLLDWQDSLAKRC

SEQ ID NO: 658 - protein, 29 aa, Homo sapiens
KILEDEPHSKDETPLCTLLDWQDSLAKRC

SEQ ID NO: 659 - protein, 29 aa, Homo sapiens
KILEDEPHSKDETPLCTLLDWQDSLAKRC

SEQ ID NO: 660 - protein, 12 aa, Homo sapiens
RLEKLYSTMVRF

SEQ ID NO: 661 - protein, 12 aa, Homo sapiens
RLEKLYSTMVRF

SEQ ID NO: 662 - protein, 12 aa, Homo sapiens
RLEKLYSTMVRF

SEQ ID NO: 663 - protein, 12 aa, Homo sapiens
RLEKLYSTMVRF

SEQ ID NO: 664 - protein, 12 aa, Homo sapiens
RLEKLYSTMVRF

SEQ ID NO: 665 - protein, 12 aa, Homo sapiens
RLEKLYSTMVRF

SEQ ID NO: 666 - protein, 12 aa, Homo sapiens
RLEKLYSTMVRF

SEQ ID NO: 667 - protein, 18 aa, Homo sapiens
KESSKFPFGISPAQSHRN

SEQ ID NO: 668 - protein, 18 aa, Homo sapiens
KESSKFPFGISPAQSHRN

SEQ ID NO: 669 - protein, 18 aa, Homo sapiens
KESSKFPFGISPAQSHRN

SEQ ID NO: 670 - protein, 31 aa, Homo sapiens; identical to SEQ ID NO: 424

SEQ ID NO: 671 - protein, 31 aa, Homo sapiens; identical to SEQ ID NO: 424

SEQ ID NO: 672 - protein, 12 aa, Homo sapiens
RKMADKVLPQRI

SEQ ID NO: 673 - protein, 16 aa, Homo sapiens
RMEIQEAIKKPLTQKR

SEQ ID NO: 674 - protein, 16 aa, Homo sapiens
RMEIQEAIKKPLTQKR

SEQ ID NO: 675 - protein, 16 aa, Homo sapiens
RMEIQEAIKKPLTQKR

SEQ ID NO: 676 - protein, 16 aa, Homo sapiens
RMEIQEAIKKPLTQKR

SEQ ID NO: 677 - protein, 16 aa, Homo sapiens
RMEIQEAIKKPLTQKR

SEQ ID NO: 678 - protein, 16 aa, Homo sapiens
RMEIQEAIKKPLTQKR

SEQ ID NO: 679 - protein, 16 aa, Homo sapiens
RMEIQEAIKKPLTQKR

SEQ ID NO: 680 - protein, 16 aa, Homo sapiens
RMEIQEAIKKPLTQKR

SEQ ID NO: 681 - protein, 16 aa, Homo sapiens
RMEIQEAIKKPLTQKR

SEQ ID NO: 682 - protein, 16 aa, Homo sapiens
RMEIQEAIKKPLTQKR

SEQ ID NO: 683 - protein, 16 aa, Homo sapiens
RMEIQEAIKKPLTQKR

SEQ ID NO: 684 - protein, 16 aa, Homo sapiens
RMEIQEAIKKPLTQKR

SEQ ID NO: 685 - protein, 16 aa, Homo sapiens
RMEIQEAIKKPLTQKR

SEQ ID NO: 686 - protein, 16 aa, Homo sapiens
RMEIQEAIKKPLTQKR

SEQ ID NO: 687 - protein, 16 aa, Homo sapiens
RMEIQEAIKKPLTQKR

SEQ ID NO: 688 - protein, 16 aa, Homo sapiens
RMEIQEAIKKPLTQKR

SEQ ID NO: 689 - protein, 16 aa, Homo sapiens
RMEIQEAIKKPLTQKR

SEQ ID NO: 690 - protein, 16 aa, Homo sapiens
RMEIQEAIKKPLTQKR

SEQ ID NO: 691 - protein, 16 aa, Homo sapiens
RMEIQEAIKKPLTQKR

SEQ ID NO: 692 - protein, 16 aa, Homo sapiens
RMEIQEAIKKPLTQKR

SEQ ID NO: 693 - protein, 16 aa, Homo sapiens
RMEIQEAIKKPLTQKR

SEQ ID NO: 694 - protein, 16 aa, Homo sapiens
RMEIQEAIKKPLTQKR

SEQ ID NO: 695 - protein, 16 aa, Homo sapiens
RMEIQEAIKKPLTQKR

SEQ ID NO: 696 - protein, 16 aa, Homo sapiens
RMEIQEAIKKPLTQKR

SEQ ID NO: 697 - protein, 16 aa, Homo sapiens
RMEIQEAIKKPLTQKR

SEQ ID NO: 698 - protein, 16 aa, Homo sapiens
RMEIQEAIKKPLTQKR

SEQ ID NO: 699 - protein, 16 aa, Homo sapiens
RMEIQEAIKKPLTQKR

SEQ ID NO: 700 - protein, 16 aa, Homo sapiens
RMEIQEAIKKPLTQKR

SEQ ID NO: 701 - protein, 16 aa, Homo sapiens
RMEIQEAIKKPLTQKR

SEQ ID NO: 702 - protein, 16 aa, Homo sapiens
RMEIQEAIKKPLTQKR

SEQ ID NO: 703 - protein, 12 aa, Homo sapiens
KRMEIQEAIKKP

SEQ ID NO: 704 - protein, 16 aa, Homo sapiens
RMEIQEAIKKPLTQKR

SEQ ID NO: 705 - protein, 16 aa, Homo sapiens
RMEIQEAIKKPLTQKR

SEQ ID NO: 706 - protein, 16 aa, Homo sapiens
RMEIQEAIKKPLTQKR

SEQ ID NO: 707 - protein, 11 aa, Homo sapiens
KMADKVLPQRI

SEQ ID NO: 708 - protein, 12 aa, Homo sapiens
RKMADKVLPQRI

SEQ ID NO: 709 - protein, 12 aa, Homo sapiens
RKMADKVLPQRI

SEQ ID NO: 710 - protein, 15 aa, Homo sapiens
KNKSKTPEIYLAYRN

SEQ ID NO: 711 - protein, 10 aa, Homo sapiens
KKVMAAIEKV

SEQ ID NO: 712 - protein, 27 aa, Homo sapiens
RGQLSWHQKTYAFSENPLPTVEIAIRN

SEQ ID NO: 713 - protein, 27 aa, Homo sapiens
RGQLSWHQKTYAFSENPLPTVEIAIRN

SEQ ID NO: 714 - protein, 16 aa, Homo sapiens
RMQKEITALAPSTMKI

SEQ ID NO: 715 - protein, 16 aa, Homo sapiens
RMQKEITALAPSTMKI

SEQ ID NO: 716 - protein, 16 aa, Homo sapiens
RMQKEITALAPSTMKI

SEQ ID NO: 717 - protein, 16 aa, Homo sapiens
RMQKEITALAPSTMKI

SEQ ID NO: 718 - protein, 16 aa, Homo sapiens
RMQKEITALAPSTMKI

SEQ ID NO: 719 - protein, 16 aa, Homo sapiens
RMQKEITALAPSTMKI

SEQ ID NO: 720 - protein, 18 aa, Homo sapiens
RMQKEITALAPSTMKIKI

SEQ ID NO: 721 - protein, 23 aa, Homo sapiens
RVAPEEHPVLLTEAPLNPKANRE

SEQ ID NO: 722 - protein, 25 aa, Homo sapiens
RHQGVMVGMGQKDSYVGDEAQSKRG

SEQ ID NO: 723 - protein, 25 aa, Homo sapiens
RHQGVMVGMGQKDSYVGDEAQSKRG

SEQ ID NO: 724 - protein, 23 aa, Homo sapiens
RVAPEEHPVLLTEAPLNPKANRE

SEQ ID NO: 725 - protein, 22 aa, Homo sapiens
KEITALAPSTMKIKIIAPPERK

SEQ ID NO: 726 - protein, 22 aa, Homo sapiens
KEITALAPSTMKIKIIAPPERK

SEQ ID NO: 727 - protein, 22 aa, Homo sapiens
KEITALAPSTMKIKIIAPPERK

SEQ ID NO: 728 - protein, 35 aa, Homo sapiens
RGILTLKYPIEHGIVTNWDDMEKIWHHTFYNELRV

SEQ ID NO: 729 - protein, 35 aa, Homo sapiens; identical to SEQ ID NO: 728

SEQ ID NO: 730 - protein, 35 aa, Homo sapiens; identical to SEQ ID NO: 728

SEQ ID NO: 731 - protein, 35 aa, Homo sapiens; identical to SEQ ID NO: 728

SEQ ID NO: 732 - protein, 35 aa, Homo sapiens; identical to SEQ ID NO: 728

SEQ ID NO: 733 - protein, 25 aa, Homo sapiens
RHQGVMVGMGQKDCYVGDEAQSKRG

SEQ ID NO: 734 - protein, 35 aa, Homo sapiens; identical to SEQ ID NO: 728

SEQ ID NO: 735 - protein, 25 aa, Homo sapiens
RHQGVMVGMGQKDCYVGDEAQSKRG

SEQ ID NO: 736 - protein, 25 aa, Homo sapiens
RHQGVMVGMGQKDCYVGDEAQSKRG

SEQ ID NO: 737 - protein, 35 aa, Homo sapiens; identical to SEQ ID NO: 728

SEQ ID NO: 738 - protein, 35 aa, Homo sapiens; identical to SEQ ID NO: 728

SEQ ID NO: 739 - protein, 35 aa, Homo sapiens; identical to SEQ ID NO: 728

SEQ ID NO: 740 - protein, 25 aa, Homo sapiens
RHQGVMVGMGQKDCYVGDEAQSKRG

SEQ ID NO: 741 - protein, 35 aa, Homo sapiens; identical to SEQ ID NO: 728

SEQ ID NO: 742 - protein, 35 aa, Homo sapiens; identical to SEQ ID NO: 728

SEQ ID NO: 743 - protein, 25 aa, Homo sapiens
RHQGVMVGMGQKDCYVGDEAQSKRG

SEQ ID NO: 744 - protein, 25 aa, Homo sapiens
RHQGVMVGMGQKDCYVGDEAQSKRG

SEQ ID NO: 745 - protein, 25 aa, Homo sapiens
RHQGVMVGMGQKDCYVGDEAQSKRG

SEQ ID NO: 746 - protein, 25 aa, Homo sapiens
RHQGVMVGMGQKDCYVGDEAQSKRG

SEQ ID NO: 747 - protein, 25 aa, Homo sapiens
RHQGVMVGMGQKDCYVGDEAQSKRG

SEQ ID NO: 748 - protein, 25 aa, Homo sapiens
RHQGVMVGMGQKDCYVGDEAQSKRG

SEQ ID NO: 749 - protein, 25 aa, Homo sapiens
KRGILTLKYPIEHGIVTNWDDMEKI

SEQ ID NO: 750 - protein, 25 aa, Homo sapiens
RHQGVMVGMGQKDSYVGDEAQSKRG

SEQ ID NO: 751 - protein, 25 aa, Homo sapiens
RHQGVMVGMGQKDSYVGDEAQSKRG

SEQ ID NO: 752 - protein, 13 aa, Homo sapiens
RWKYMIVDEGHRM

SEQ ID NO: 753 - protein, 24 aa, Homo sapiens
RGILTLKYPIEHGIVTNWDDMEKI

SEQ ID NO: 754 - protein, 43 aa, Homo sapiens
KEKLCYVALDFEQEMATAASSSSLEKSYELPDGQVITIGNERF

SEQ ID NO: 755 - protein, 24 aa, Homo sapiens
RKDLYANTVLSGGTTMYPGIADRM

SEQ ID NO: 756 - protein, 24 aa, Homo sapiens
RKDLYANTVLSGGTTMYPGIADRM

SEQ ID NO: 757 - protein, 24 aa, Homo sapiens
RKDLYANTVLSGGTTMYPGIADRM

SEQ ID NO: 758 - protein, 24 aa, Homo sapiens
RKDLYANTVLSGGTTMYPGIADRM

SEQ ID NO: 759 - protein, 24 aa, Homo sapiens
RKDLYANTVLSGGTTMYPGIADRM

SEQ ID NO: 760 - protein, 24 aa, Homo sapiens
RKDLYANTVLSGGTTMYPGIADRM

SEQ ID NO: 761 - protein, 24 aa, Homo sapiens
RKDLYANTVLSGGTTMYPGIADRM

SEQ ID NO: 762 - protein, 24 aa, Homo sapiens
RKDLYANTVLSGGTTMYPGIADRM

SEQ ID NO: 763 - protein, 24 aa, Homo sapiens
RKDLYANTVLSGGTTMYPGIADRM

SEQ ID NO: 764 - protein, 24 aa, Homo sapiens
RKDLYANTVLSGGTTMYPGIADRM

SEQ ID NO: 765 - protein, 24 aa, Homo sapiens
RKDLYANTVLSGGTTMYPGIADRM

SEQ ID NO: 766 - protein, 10 aa, Homo sapiens
RKLDQTIARK

SEQ ID NO: 767 - protein, 11 aa, Homo sapiens
RHIFAKVQQRR

SEQ ID NO: 768 - protein, 31 aa, Homo sapiens
KASEVEEILDGNDEKYKAVSISTEPPTYLRE

SEQ ID NO: 769 - protein, 16 aa, Homo sapiens
RQNFHMEQLKYAELRA

SEQ ID NO: 770 - protein, 16 aa, Homo sapiens
RQNFHMEQLKYAELRA

SEQ ID NO: 771 - protein, 16 aa, Homo sapiens
RQNFHMEQLKYAELRA

SEQ ID NO: 772 - protein, 16 aa, Homo sapiens
RQNFHMEQLKYAELRA

SEQ ID NO: 773 - protein, 16 aa, Homo sapiens
RQNFHMEQLKYAELRA

SEQ ID NO: 774 - protein, 11 aa, Homo sapiens
RDRKASANARK

SEQ ID NO: 775 - protein, 13 aa, Homo sapiens
RHQGTFTDEKSKA

SEQ ID NO: 776 - protein, 9 aa, Homo sapiens
KKVQEAARA

SEQ ID NO: 777 - protein, 25 aa, Homo sapiens
RNTGDADQWCPLLETLTDAEMEKKI

SEQ ID NO: 778 - protein, 18 aa, Homo sapiens
RKRDSDAGSSTPTTSTRS

SEQ ID NO: 779 - protein, 21 aa, Homo sapiens
KQWLKAIEEGTLEEIEEEVRQ

SEQ ID NO: 780 - protein, 15 aa, Homo sapiens
RLKLIANNTTVERRF

SEQ ID NO: 781 - protein, 14 aa, Homo sapiens
RLKLIANNTTVERR

SEQ ID NO: 782 - protein, 15 aa, Homo sapiens
RLKLIANNTTVERRF

SEQ ID NO: 783 - protein, 31 aa, Homo sapiens
RENMEAISPLKNGMVEDWDSFQAILDHTYKM

SEQ ID NO: 784 - protein, 16 aa, Homo sapiens
RWEKRWVTVGDTSLRI

SEQ ID NO: 785 - protein, 13 aa, Homo sapiens
RKELPEYYELIRK

SEQ ID NO: 786 - protein, 13 aa, Homo sapiens
RKELPEYYELIRK

SEQ ID NO: 787 - protein, 18 aa, Homo sapiens
KVIQAGMFDQKSSSHERR

SEQ ID NO: 788 - protein, 18 aa, Homo sapiens
KVIQAGMFDQKSSSHERR

SEQ ID NO: 789 - protein, 18 aa, Homo sapiens
KVIQAGMFDQKSSSHERR

SEQ ID NO: 790 - protein, 18 aa, Homo sapiens
KVIQAGMFDQKSSSHERR

SEQ ID NO: 791 - protein, 19 aa, Homo sapiens
KGIVEDIHCGSMKGTGMRP

SEQ ID NO: 792 - protein, 22 aa, Homo sapiens
KHQEYLNSILQHAKDFKEYHRS

SEQ ID NO: 793 - protein, 20 aa, Homo sapiens
RQKHQEYLNSILQHAKDFKE

SEQ ID NO: 794 - protein, 20 aa, Homo sapiens
RQKHQEYLNSILQHAKDFKE

SEQ ID NO: 795 - protein, 18 aa, Homo sapiens
KHQEYLNSILQHAKDFKE

SEQ ID NO: 796 - protein, 20 aa, Homo sapiens
RQKHQEYLNSILQHAKDFKE

SEQ ID NO: 797 - protein, 18 aa, Homo sapiens
KHQEYLNSILQHAKDFKE

SEQ ID NO: 798 - protein, 22 aa, Homo sapiens
KHQEYLNSILQHAKDFKEYHRS

SEQ ID NO: 799 - protein, 20 aa, Homo sapiens
RQKHQEYLNSILQHAKDFKE

SEQ ID NO: 800 - protein, 20 aa, Homo sapiens
RQKHQEYLNSILQHAKDFKE

SEQ ID NO: 801 - protein, 22 aa, Homo sapiens
KHQEYLNSILQHAKDFKEYHRS

SEQ ID NO: 802 - protein, 20 aa, Homo sapiens
RQKHQEYLNSILQHAKDFKE

SEQ ID NO: 803 - protein, 20 aa, Homo sapiens
RQKHQEYLNSILQHAKDFKE

SEQ ID NO: 804 - protein, 20 aa, Homo sapiens
RQKHQEYLNSILQHAKDFKE

SEQ ID NO: 805 - protein, 22 aa, Homo sapiens
KHQEYLNSILQHAKDFKEYHRS

SEQ ID NO: 806 - protein, 20 aa, Homo sapiens
RQKHQEYLNSILQHAKDFKE

SEQ ID NO: 807 - protein, 20 aa, Homo sapiens
RQKHQEYLNSILQHAKDFKE

SEQ ID NO: 808 - protein, 18 aa, Homo sapiens
KHQEYLNSILQHAKDFKE

SEQ ID NO: 809 - protein, 20 aa, Homo sapiens
RQKHQEYLNSILQHAKDFKE

SEQ ID NO: 810 - protein, 20 aa, Homo sapiens
RQKHQEYLNSILQHAKDFKE

SEQ ID NO: 811 - protein, 20 aa, Homo sapiens
RQKHQEYLNSILQHAKDFKE

SEQ ID NO: 812 - protein, 20 aa, Homo sapiens
RQKHQEYLNSILQHAKDFKE

SEQ ID NO: 813 - protein, 20 aa, Homo sapiens
RQKHQEYLNSILQHAKDFKE

SEQ ID NO: 814 - protein, 20 aa, Homo sapiens
RQKHQEYLNSILQHAKDFKE

SEQ ID NO: 815 - protein, 20 aa, Homo sapiens
RQKHQEYLNSILQHAKDFKE

SEQ ID NO: 816 - protein, 22 aa, Homo sapiens
KHQEYLNSILQHAKDFKEYHRS

SEQ ID NO: 817 - protein, 22 aa, Homo sapiens
KHQEYLNSILQHAKDFKEYHRS

SEQ ID NO: 818 - protein, 20 aa, Homo sapiens
RQKHQEYLNSILQHAKDFKE

SEQ ID NO: 819 - protein, 20 aa, Homo sapiens
RQKHQEYLNSILQHAKDFKE

SEQ ID NO: 820 - protein, 20 aa, Homo sapiens
RQKHQEYLNSILQHAKDFKE

SEQ ID NO: 821 - protein, 22 aa, Homo sapiens
KHQEYLNSILQHAKDFKEYHRS

SEQ ID NO: 822 - protein, 22 aa, Homo sapiens
KHQEYLNSILQHAKDFKEYHRS

SEQ ID NO: 823 - protein, 20 aa, Homo sapiens
RQKHQEYLNSILQHAKDFKE

SEQ ID NO: 824 - protein, 22 aa, Homo sapiens
KHQEYLNSILQHAKDFKEYHRS

SEQ ID NO: 825 - protein, 22 aa, Homo sapiens
KHQEYLNSILQHAKDFKEYHRS

SEQ ID NO: 826 - protein, 22 aa, Homo sapiens
KHQEYLNSILQHAKDFKEYHRS

SEQ ID NO: 827 - protein, 20 aa, Homo sapiens
RQKHQEYLNSILQHAKDFKE

SEQ ID NO: 828 - protein, 22 aa, Homo sapiens
KHQEYLNSILQHAKDFKEYHRS

SEQ ID NO: 829 - protein, 20 aa, Homo sapiens
RQKHQEYLNSILQHAKDFKE

SEQ ID NO: 830 - protein, 22 aa, Homo sapiens
KHQEYLNSILQHAKDFKEYHRS

SEQ ID NO: 831 - protein, 20 aa, Homo sapiens
RQKHQEYLNSILQHAKDFKE

SEQ ID NO: 832 - protein, 20 aa, Homo sapiens
RQKHQEYLNSILQHAKDFKE

SEQ ID NO: 833 - protein, 18 aa, Homo sapiens
KHQEYLNSILQHAKDFKE

SEQ ID NO: 834 - protein, 22 aa, Homo sapiens
KHQEYLNSILQHAKDFKEYHRS

SEQ ID NO: 835 - protein, 22 aa, Homo sapiens
KHQEYLNSILQHAKDFKEYHRS

SEQ ID NO: 836 - protein, 22 aa, Homo sapiens
KHQEYLNSILQHAKDFKEYHRS

SEQ ID NO: 837 - protein, 20 aa, Homo sapiens
RQKHQEYLNSILQHAKDFKE

SEQ ID NO: 838 - protein, 18 aa, Homo sapiens
KHQEYLNSILQHAKDFKE

SEQ ID NO: 839 - protein, 22 aa, Homo sapiens
KHQEYLNSILQHAKDFKEYHRS

SEQ ID NO: 840 - protein, 20 aa, Homo sapiens
RQKHQEYLNSILQHAKDFKE

SEQ ID NO: 841 - protein, 22 aa, Homo sapiens
KHQEYLNSILQHAKDFKEYHRS

SEQ ID NO: 842 - protein, 22 aa, Homo sapiens
KHQEYLNSILQHAKDFKEYHRS

SEQ ID NO: 843 - protein, 20 aa, Homo sapiens
RQKHQEYLNSILQHAKDFKE

SEQ ID NO: 844 - protein, 20 aa, Homo sapiens
RQKHQEYLNSILQHAKDFKE

SEQ ID NO: 845 - protein, 20 aa, Homo sapiens
RQKHQEYLNSILQHAKDFKE

SEQ ID NO: 846 - protein, 20 aa, Homo sapiens
RQKHQEYLNSILQHAKDFKE

SEQ ID NO: 847 - protein, 22 aa, Homo sapiens
KHQEYLNSILQHAKDFKEYHRS

SEQ ID NO: 848 - protein, 20 aa, Homo sapiens
RQKHQEYLNSILQHAKDFKE

SEQ ID NO: 849 - protein, 20 aa, Homo sapiens
RQKHQEYLNSILQHAKDFKE

SEQ ID NO: 850 - protein, 18 aa, Homo sapiens
KHQEYLNSILQHAKDFKE

SEQ ID NO: 851 - protein, 20 aa, Homo sapiens
RQKHQEYLNSILQHAKDFKE

SEQ ID NO: 852 - protein, 22 aa, Homo sapiens
KHQEYLNSILQHAKDFKEYHRS

SEQ ID NO: 853 - protein, 20 aa, Homo sapiens
RQKHQEYLNSILQHAKDFKE

SEQ ID NO: 854 - protein, 22 aa, Homo sapiens
KHQEYLNSILQHAKDFKEYHRS

SEQ ID NO: 855 - protein, 14 aa, Homo sapiens
RLKLIANNTTVERR

SEQ ID NO: 856 - protein, 14 aa, Homo sapiens
RLKLIANNTTVERR

SEQ ID NO: 857 - protein, 15 aa, Homo sapiens
RLKLIANNTTVERRF

SEQ ID NO: 858 - protein, 15 aa, Homo sapiens
RLKLIANNTTVERRF

SEQ ID NO: 859 - protein, 14 aa, Homo sapiens
RLKLIANNTTVERR

SEQ ID NO: 860 - protein, 14 aa, Homo sapiens
RLKLIANNTTVERR

SEQ ID NO: 861 - protein, 14 aa, Homo sapiens
RLKLIANNTTVERR

SEQ ID NO: 862 - protein, 15 aa, Homo sapiens
RLKLIANNTTVERRF

SEQ ID NO: 863 - protein, 14 aa, Homo sapiens
RLKLIANNTTVERR

SEQ ID NO: 864 - protein, 14 aa, Homo sapiens
RLKLIANNTTVERR

SEQ ID NO: 865 - protein, 15 aa, Homo sapiens
RLKLIANNTTVERRF

SEQ ID NO: 866 - protein, 15 aa, Homo sapiens
RLKLIANNTTVERRF

SEQ ID NO: 867 - protein, 15 aa, Homo sapiens
RLKLIANNTTVERRF

SEQ ID NO: 868 - protein, 22 aa, Homo sapiens
KHQEYLNSILQHAKDFKEYHRS

SEQ ID NO: 869 - protein, 15 aa, Homo sapiens
RLKLIANNTTVERRF

SEQ ID NO: 870 - protein, 15 aa, Homo sapiens
RLKLIANNTTVERRF

SEQ ID NO: 871 - protein, 13 aa, Homo sapiens
RKELPEYYELIRK

SEQ ID NO: 872 - protein, 13 aa, Homo sapiens
RWKYMIVDEGHRM

SEQ ID NO: 873 - protein, 11 aa, Homo sapiens
RKEKLPQVTRS

SEQ ID NO: 874 - protein, 34 aa, Homo sapiens
RRFSSWIGGSILASLGTFQQMWISKQEYEEGGKQ

SEQ ID NO: 875 - protein, 23 aa, Homo sapiens
RALLALAKVDENHSEFTLYESRL

SEQ ID NO: 876 - protein, 23 aa, Homo sapiens
RALLALAKVDENHSEFTLYESRL

SEQ ID NO: 877 - protein, 23 aa, Homo sapiens
RALLALAKVDENHSEFTLYESRL

SEQ ID NO: 878 - protein, 23 aa, Homo sapiens
RALLALAKVDENHSEFTLYESRL

SEQ ID NO: 879 - protein, 23 aa, Homo sapiens
RALLALAKVDENHSEFTLYESRL

SEQ ID NO: 880 - protein, 23 aa, Homo sapiens
RALLALAKVDENHSEFTLYESRL

SEQ ID NO: 881 - protein, 23 aa, Homo sapiens
RALLALAKVDENHSEFTLYESRL

SEQ ID NO: 882 - protein, 23 aa, Homo sapiens
RALLALAKVDENHSEFTLYESRL

SEQ ID NO: 883 - protein, 23 aa, Homo sapiens
RALLALAKVDENHSEFTLYESRL

SEQ ID NO: 884 - protein, 23 aa, Homo sapiens
RALLALAKVDENHSEFTLYESRL

SEQ ID NO: 885 - protein, 23 aa, Homo sapiens
RALLALAKVDENHSEFTLYESRL

SEQ ID NO: 886 - protein, 23 aa, Homo sapiens
RALLALAKVDENHSEFTLYESRL

SEQ ID NO: 887 - protein, 23 aa, Homo sapiens
RALLALAKVDENHSEFTLYESRL

SEQ ID NO: 888 - protein, 23 aa, Homo sapiens
RALLALAKVDENHSEFTLYESRL

SEQ ID NO: 889 - protein, 23 aa, Homo sapiens
RALLALAKVDENHSEFTLYESRL

SEQ ID NO: 890 - protein, 23 aa, Homo sapiens
RALLALAKVDENHSEFTLYESRL

SEQ ID NO: 891 - protein, 23 aa, Homo sapiens
RALLALAKVDENHSEFTLYESRL

SEQ ID NO: 892 - protein, 23 aa, Homo sapiens
RALLALAKVDENHSEFTLYESRL

SEQ ID NO: 893 - protein, 23 aa, Homo sapiens
RALLALAKVDENHSEFTLYESRL

SEQ ID NO: 894 - protein, 23 aa, Homo sapiens
RALLALAKVDENHSEFTLYESRL

SEQ ID NO: 895 - protein, 23 aa, Homo sapiens
RALLALAKVDENHSEFTLYESRL

SEQ ID NO: 896 - protein, 23 aa, Homo sapiens
RALLALAKVDENHSEFTLYESRL

SEQ ID NO: 897 - protein, 23 aa, Homo sapiens
RALLALAKVDENHSEFTLYESRL

SEQ ID NO: 898 - protein, 23 aa, Homo sapiens
RALLALAKVDENHSEFTLYESRL

SEQ ID NO: 899 - protein, 23 aa, Homo sapiens
RALLALAKVDENHSEFTLYESRL

SEQ ID NO: 900 - protein, 23 aa, Homo sapiens
RALLALAKVDENHSEFTLYESRL

SEQ ID NO: 901 - protein, 23 aa, Homo sapiens
RALLALAKVDENHSEFTLYESRL

SEQ ID NO: 902 - protein, 13 aa, Homo sapiens
RELSQKTPPSMRL

SEQ ID NO: 903 - protein, 23 aa, Homo sapiens
RSNSVGIQDAFNDGSDSTFQKRN

SEQ ID NO: 904 - protein, 16 aa, Homo sapiens
RMSYEPNKDPYGSMRK

SEQ ID NO: 905 - protein, 16 aa, Homo sapiens
RMSYEPNKDPYGSMRK

SEQ ID NO: 906 - protein, 19 aa, Homo sapiens
KAYHNSPAYLAYINAKSRA

SEQ ID NO: 907 - protein, 19 aa, Homo sapiens
KAYHNSPAYLAYINAKSRA

SEQ ID NO: 908 - protein, 19 aa, Homo sapiens
KAYHNSPAYLAYINAKSRA

SEQ ID NO: 909 - protein, 19 aa, Homo sapiens
KAYHNSPAYLAYINAKSRA

SEQ ID NO: 910 - protein, 19 aa, Homo sapiens
KAYHNSPAYLAYINAKSRA

SEQ ID NO: 911 - protein, 19 aa, Homo sapiens
KAYHNSPAYLAYINAKSRA

SEQ ID NO: 912 - protein, 19 aa, Homo sapiens
KAYHNSPAYLAYINAKSRA

SEQ ID NO: 913 - protein, 19 aa, Homo sapiens
KAYHNSPAYLAYINAKSRA

SEQ ID NO: 914 - protein, 19 aa, Homo sapiens
KAYHNSPAYLAYINAKSRA

SEQ ID NO: 915 - protein, 19 aa, Homo sapiens
KAYHNSPAYLAYINAKSRA

SEQ ID NO: 916 - protein, 19 aa, Homo sapiens
KAYHNSPAYLAYINAKSRA

SEQ ID NO: 917 - protein, 19 aa, Homo sapiens
KAYHNSPAYLAYINAKSRA

SEQ ID NO: 918 - protein, 19 aa, Homo sapiens
KAYHNSPAYLAYINAKSRA

SEQ ID NO: 919 - protein, 22 aa, Homo sapiens
KASNPDLKLWEIGKIIGGMWRD

SEQ ID NO: 920 - protein, 22 aa, Homo sapiens
KASNPDLKLWEIGKIIGGMWRD

SEQ ID NO: 921 - protein, 22 aa, Homo sapiens
KASNPDLKLWEIGKIIGGMWRD

SEQ ID NO: 922 - protein, 14 aa, Homo sapiens
RLKLIANNTTVERR

SEQ ID NO: 923 - protein, 24 aa, Homo sapiens
RQVQSLMVHQRKLEAELLQIEERH

SEQ ID NO: 924 - protein, 16 aa, Homo sapiens
RLKIPEGLFDPSNVKG

SEQ ID NO: 925 - protein, 15 aa, Homo sapiens
RSPSPSPTPEAKKKN

SEQ ID NO: 926 - protein, 14 aa, Homo sapiens
RSPSPSPTPEAKKK

SEQ ID NO: 927 - protein, 19 aa, Homo sapiens
RVASAAAKSALEEFSKMKE

SEQ ID NO: 928 - protein, 45 aa, Homo sapiens
RSTGLILDSGATHTTAIPVHDGYVLQQGIVKSPLAGDFITMQCRE

SEQ ID NO: 929 - protein, 45 aa, Homo sapiens; identical to SEQ ID NO: 928

SEQ ID NO: 930 - protein, 45 aa, Homo sapiens; identical to SEQ ID NO: 928

SEQ ID NO: 931 - protein, 45 aa, Homo sapiens; identical to SEQ ID NO: 928

SEQ ID NO: 932 - protein, 45 aa, Homo sapiens; identical to SEQ ID NO: 928

SEQ ID NO: 933 - protein, 22 aa, Homo sapiens
KEPKEGQEEVLKEVVESEGERK

SEQ ID NO: 934 - protein, 22 aa, Homo sapiens
KEPKEGQEEVLKEVVESEGERK

SEQ ID NO: 935 - protein, 22 aa, Homo sapiens
KEPKEGQEEVLKEVVESEGERK

SEQ ID NO: 936 - protein, 22 aa, Homo sapiens
KEPKEGQEEVLKEVVESEGERK

SEQ ID NO: 937 - protein, 20 aa, Homo sapiens
KTPPSMRLKLIANNTTVERR

SEQ ID NO: 938 - protein, 15 aa, Homo sapiens
KQEYEEGGKQCVERK

SEQ ID NO: 939 - protein, 15 aa, Homo sapiens
KQEYEEGGKQCVERK

SEQ ID NO: 940 - protein, 15 aa, Homo sapiens
KQEYEEGGKQCVERK

SEQ ID NO: 941 - protein, 15 aa, Homo sapiens
KQEYEEGGKQCVERK

SEQ ID NO: 942 - protein, 15 aa, Homo sapiens
KQEYEEGGKQCVERK

SEQ ID NO: 943 - protein, 15 aa, Homo sapiens
KQEYEEGGKQCVERK

SEQ ID NO: 944 - protein, 16 aa, Homo sapiens
KQEYEEGGKQCVERKC

SEQ ID NO: 945 - protein, 15 aa, Homo sapiens
KQEYEEGGKQCVERK

SEQ ID NO: 946 - protein, 16 aa, Homo sapiens
KQEYEEGGKQCVERKC

SEQ ID NO: 947 - protein, 45 aa, Homo sapiens; identical to SEQ ID NO: 928

SEQ ID NO: 948 - protein, 22 aa, Homo sapiens
REKLTELMFEHYNIPAFFLCKT

SEQ ID NO: 949 - protein, 22 aa, Homo sapiens
REKLTELMFEHYNIPAFFLCKT

SEQ ID NO: 950 - protein, 22 aa, Homo sapiens
REKLTELMFEHYNIPAFFLCKT

SEQ ID NO: 951 - protein, 22 aa, Homo sapiens
REKLTELMFEHYNIPAFFLCKT

SEQ ID NO: 952 - protein, 22 aa, Homo sapiens
REKLTELMFEHYNIPAFFLCKT

SEQ ID NO: 953 - protein, 22 aa, Homo sapiens
REKLTELMFEHYNIPAFFLCKT

SEQ ID NO: 954 - protein, 22 aa, Homo sapiens
REKLTELMFEHYNIPAFFLCKT

SEQ ID NO: 955 - protein, 22 aa, Homo sapiens
REKLTELMFEHYNIPAFFLCKT

SEQ ID NO: 956 - protein, 39 aa, Homo sapiens
RRHEPYGQQYPGQGPPSGQPPYGGHQPGLYPQQPNYKRH

SEQ ID NO: 957 - protein, 38 aa, Homo sapiens
RHEPYGQQYPGQGPPSGQPPYGGHQPGLYPQQPNYKRH

SEQ ID NO: 958 - protein, 14 aa, Homo sapiens
RHMDGMYGPPAKRH

SEQ ID NO: 959 - protein, 18 aa, Homo sapiens
KKTGQPEELVSCSDCGRS

SEQ ID NO: 960 - protein, 14 aa, Homo sapiens
RLKLIANNTTVERR

SEQ ID NO: 961 - protein, 15 aa, Homo sapiens
RLKLIANNTTVERRF

SEQ ID NO: 962 - protein, 14 aa, Homo sapiens
RLKLIANNTTVERR

SEQ ID NO: 963 - protein, 36 aa, Homo sapiens
KNRPGLSYHYAHSHLAEEEGEDKEDSQPPTPVSQRS

SEQ ID NO: 964 - protein, 22 aa, Homo sapiens
REKLTELMFEHYNIPAFFLCKT

SEQ ID NO: 965 - protein, 22 aa, Homo sapiens
REKLTELMFEHYNIPAFFLCKT

SEQ ID NO: 966 - protein, 13 aa, Homo sapiens
RELSQKTPPSMRL

SEQ ID NO: 967 - protein, 13 aa, Homo sapiens
RELSQKTPPSMRL

SEQ ID NO: 968 - protein, 26 aa, Homo sapiens
KPVKFQLEDDGEFYMIGSEVGNYLRM

SEQ ID NO: 969 - protein, 26 aa, Homo sapiens
KPVKFQLEDDGEFYMIGSEVGNYLRM

SEQ ID NO: 970 - protein, 15 aa, Homo sapiens
RLKLIANNTTVERRF

SEQ ID NO: 971 - protein, 14 aa, Homo sapiens
RLKLIANNTTVERR

SEQ ID NO: 972 - protein, 15 aa, Homo sapiens
RLKLIANNTTVERRF

SEQ ID NO: 973 - protein, 13 aa, Homo sapiens
KIVASSHGKKTKP

SEQ ID NO: 974 - protein, 13 aa, Homo sapiens
KIVASSHGKKTKP

SEQ ID NO: 975 - protein, 45 aa, Homo sapiens; identical to SEQ ID NO: 928

SEQ ID NO: 976 - protein, 45 aa, Homo sapiens; identical to SEQ ID NO: 928

SEQ ID NO: 977 - protein, 45 aa, Homo sapiens; identical to SEQ ID NO: 928

SEQ ID NO: 978 - protein, 45 aa, Homo sapiens; identical to SEQ ID NO: 928

SEQ ID NO: 979 - protein, 45 aa, Homo sapiens; identical to SEQ ID NO: 928

SEQ ID NO: 980 - protein, 45 aa, Homo sapiens; identical to SEQ ID NO: 928

SEQ ID NO: 981 - protein, 45 aa, Homo sapiens; identical to SEQ ID NO: 928

SEQ ID NO: 982 - protein, 31 aa, Homo sapiens; identical to SEQ ID NO: 783

SEQ ID NO: 983 - protein, 22 aa, Homo sapiens
REKLTELMFEHYNIPAFFLCKT

SEQ ID NO: 984 - protein, 22 aa, Homo sapiens
REKLTELMFEHYNIPAFFLCKT

SEQ ID NO: 985 - protein, 22 aa, Homo sapiens
REKLTELMFEHYNIPAFFLCKT

SEQ ID NO: 986 - protein, 13 aa, Homo sapiens
RHQGTFTDEKSKA

SEQ ID NO: 987 - protein, 27 aa, Homo sapiens
KSKASHHIYPYSSSQDDEEWLRPVMRK

SEQ ID NO: 988 - protein, 14 aa, Homo sapiens
RLKLIANNTTVERR

SEQ ID NO: 989 - protein, 17 aa, Homo sapiens
RDTALETALNAKAYKRS

SEQ ID NO: 990 - protein, 19 aa, Homo sapiens
KVIHVESGKILTGTDAPKA

SEQ ID NO: 991 - protein, 19 aa, Homo sapiens
KVIHVESGKILTGTDAPKA

SEQ ID NO: 992 - protein, 13 aa, Homo sapiens
RHQGTFTDEKSKA

SEQ ID NO: 993 - protein, 10 aa, Homo sapiens
RITPIQKPRG

SEQ ID NO: 994 - protein, 13 aa, Homo sapiens
RTKATIELKALRL

SEQ ID NO: 995 - protein, 13 aa, Homo sapiens
RTKATIELKALRL

SEQ ID NO: 996 - protein, 10 aa, Homo sapiens
RTKATIELKA

SEQ ID NO: 997 - protein, 10 aa, Homo sapiens
RTKATIELKA

SEQ ID NO: 998 - protein, 13 aa, Homo sapiens
RTKATIELKALRL

SEQ ID NO: 999 - protein, 13 aa, Homo sapiens
RTKATIELKALRL

SEQ ID NO: 1000 - protein, 10 aa, Homo sapiens
RTKATIELKA

SEQ ID NO: 1001 - protein, 10 aa, Homo sapiens
RTKATIELKA

SEQ ID NO: 1002 - protein, 13 aa, Homo sapiens
RHQGTFTDEKSKA

SEQ ID NO: 1003 - protein, 12 aa, Homo sapiens
KVSYKGSPAARR

SEQ ID NO: 1004 - protein, 13 aa, Homo sapiens
RHQGTFTDEKSKA

SEQ ID NO: 1005 - protein, 13 aa, Homo sapiens
RHQGTFTDEKSKA

SEQ ID NO: 1006 - protein, 16 aa, Homo sapiens
RHRKEVDYSDSLTEKQ

SEQ ID NO: 1007 - protein, 18 aa, Homo sapiens
RKRDSDAGSSTPTTSTRS

SEQ ID NO: 1008 - protein, 13 aa, Homo sapiens
RTKATIELKALRL

SEQ ID NO: 1009 - protein, 14 aa, Homo sapiens
KEKPVDLQNFGLRT

SEQ ID NO: 1010 - protein, 16 aa, Homo sapiens
KNKEKPVDLQNFGLRT

SEQ ID NO: 1011 - protein, 16 aa, Homo sapiens
KNKEKPVDLQNFGLRT

SEQ ID NO: 1012 - protein, 20 aa, Homo sapiens
RSPQVPAAQQMLNFPEKNKE

SEQ ID NO: 1013 - protein, 20 aa, Homo sapiens
RSPQVPAAQQMLNFPEKNKE

SEQ ID NO: 1014 - protein, 20 aa, Homo sapiens
RSPQVPAAQQMLNFPEKNKE

SEQ ID NO: 1015 - protein, 20 aa, Homo sapiens
RSPQVPAAQQMLNFPEKNKE

SEQ ID NO: 1016 - protein, 20 aa, Homo sapiens
RSPQVPAAQQMLNFPEKNKE

SEQ ID NO: 1017 - protein, 21 aa, Homo sapiens
RKRPAPQQIQQVQQQAVQNRN

SEQ ID NO: 1018 - protein, 21 aa, Homo sapiens
RKRPAPQQIQQVQQQAVQNRN

SEQ ID NO: 1019 - protein, 21 aa, Homo sapiens
RKRPAPQQIQQVQQQAVQNRN

SEQ ID NO: 1020 - protein, 21 aa, Homo sapiens
RKRPAPQQIQQVQQQAVQNRN

SEQ ID NO: 1021 - protein, 25 aa, Homo sapiens
KEVEAQLPEKVEYVIKCDMSALQRV

SEQ ID NO: 1022 - protein, 21 aa, Homo sapiens
RKRPAPQQIQQVQQQAVQNRN

SEQ ID NO: 1023 - protein, 21 aa, Homo sapiens
RKRPAPQQIQQVQQQAVQNRN

SEQ ID NO: 1024 - protein, 17 aa, Homo sapiens
RDTALETALNAKAYKRS

SEQ ID NO: 1025 - protein, 17 aa, Homo sapiens
RDTALETALNAKAYKRS

SEQ ID NO: 1026 - protein, 17 aa, Homo sapiens
RDTALETALNAKAYKRS

SEQ ID NO: 1027 - protein, 17 aa, Homo sapiens
RRDTALETALNAKAYKR

SEQ ID NO: 1028 - protein, 16 aa, Homo sapiens
RDTALETALNAKAYKR

SEQ ID NO: 1029 - protein, 17 aa, Homo sapiens
RRDTALETALNAKAYKR

SEQ ID NO: 1030 - protein, 17 aa, Homo sapiens
RRDTALETALNAKAYKR

SEQ ID NO: 1031 - protein, 21 aa, Homo sapiens
RKRPAPQQIQQVQQQAVQNRN

SEQ ID NO: 1032 - protein, 21 aa, Homo sapiens
RKRPAPQQIQQVQQQAVQNRN

SEQ ID NO: 1033 - protein, 21 aa, Homo sapiens
RKRPAPQQIQQVQQQAVQNRN

SEQ ID NO: 1034 - protein, 21 aa, Homo sapiens
RKRPAPQQIQQVQQQAVQNRN

SEQ ID NO: 1035 - protein, 33 aa, Homo sapiens; identical to SEQ ID NO: 284

SEQ ID NO: 1036 - protein, 33 aa, Homo sapiens; identical to SEQ ID NO: 284

SEQ ID NO: 1037 - protein, 14 aa, Homo sapiens
KEKPTDMQNFGLRT

SEQ ID NO: 1038 - protein, 14 aa, Homo sapiens
KEKPTDMQNFGLRT

SEQ ID NO: 1039 - protein, 18 aa, Homo sapiens
RGQPLPDHLQMAVQGKRP

SEQ ID NO: 1040 - protein, 10 aa, Homo sapiens
RTKATIELKA

SEQ ID NO: 1041 - protein, 10 aa, Homo sapiens
RTKATIELKA

SEQ ID NO: 1042 - protein, 10 aa, Homo sapiens
RTKATIELKA

SEQ ID NO: 1043 - protein, 43 aa, Homo sapiens
RPSPAPPAVPPAASPVMPPQTQSPGQPAQPAPMVPLHQKQSRI

SEQ ID NO: 1044 - protein, 43 aa, Homo sapiens; identical to SEQ ID NO: 1043

SEQ ID NO: 1045 - protein, 43 aa, Homo sapiens; identical to SEQ ID NO: 1043

SEQ ID NO: 1046 - protein, 17 aa, Homo sapiens
RDTALETALNAKAYKRS

SEQ ID NO: 1047 - protein, 17 aa, Homo sapiens
RRDTALETALNAKAYKR

SEQ ID NO: 1048 - protein, 20 aa, Homo sapiens
KISAKTLTDEVNSPDSDRRD

SEQ ID NO: 1049 - protein, 28 aa, Homo sapiens
RMEKGEPYMSIQPAEDPDDYDDGFSMKH

SEQ ID NO: 1050 - protein, 28 aa, Homo sapiens
RMEKGEPYMSIQPAEDPDDYDDGFSMKH

SEQ ID NO: 1051 - protein, 28 aa, Homo sapiens
RMEKGEPYMSIQPAEDPDDYDDGFSMKH

SEQ ID NO: 1052 - protein, 28 aa, Homo sapiens
RMEKGEPYMSIQPAEDPDDYDDGFSMKH

SEQ ID NO: 1053 - protein, 28 aa, Homo sapiens
RMEKGEPYMSIQPAEDPDDYDDGFSMKH

SEQ ID NO: 1054 - protein, 19 aa, Homo sapiens
KAYHNSPAYLAYINAKSRA

SEQ ID NO: 1055 - protein, 14 aa, Homo sapiens
RKLEAELLQIEERH

SEQ ID NO: 1056 - protein, 10 aa, Homo sapiens
RSVTGKIQKL

SEQ ID NO: 1057 - protein, 8 aa, Homo sapiens
REQKAKRN

SEQ ID NO: 1058 - protein, 12 aa, Homo sapiens
RLDGTTKAEDRG

SEQ ID NO: 1059 - protein, 8 aa, Homo sapiens
REQKAKRN

SEQ ID NO: 1060 - protein, 8 aa, Homo sapiens
REQKAKRN

SEQ ID NO: 1061 - protein, 12 aa, Homo sapiens
KVSYKGSPAARR

SEQ ID NO: 1062 - protein, 12 aa, Homo sapiens
KVSYKGSPAARR

SEQ ID NO: 1063 - protein, 8 aa, Homo sapiens
RGFKYLRL

SEQ ID NO: 1064 - protein, 17 aa, Homo sapiens
RDTALETALNAKAYKRS

SEQ ID NO: 1065 - protein, 17 aa, Homo sapiens
RRDTALETALNAKAYKR

SEQ ID NO: 1066 - protein, 17 aa, Homo sapiens
RRDTALETALNAKAYKR

SEQ ID NO: 1067 - protein, 17 aa, Homo sapiens
RRDTALETALNAKAYKR

SEQ ID NO: 1068 - protein, 17 aa, Homo sapiens
RRDTALETALNAKAYKR

SEQ ID NO: 1069 - protein, 18 aa, Homo sapiens
RKRDSDAGSSTPTTSTRS

SEQ ID NO: 1070 - protein, 16 aa, Homo sapiens
RQRGKGEITPAAIQKM

SEQ ID NO: 1071 - protein, 16 aa, Homo sapiens
RQRGKGEITPAAIQKM

SEQ ID NO: 1072 - protein, 21 aa, Homo sapiens
RLDLAGRDLTDYLMKILTERG

SEQ ID NO: 1073 - protein, 21 aa, Homo sapiens
RLDLAGRDLTDYLMKILTERG

SEQ ID NO: 1074 - protein, 15 aa, Homo sapiens
RDLTDYLMKILTERG

SEQ ID NO: 1075 - protein, 21 aa, Homo sapiens
RLDLAGRDLTDYLMKILTERG

SEQ ID NO: 1076 - protein, 15 aa, Homo sapiens
RDLTDYLMKILTERG

SEQ ID NO: 1077 - protein, 21 aa, Homo sapiens
RLDLAGRDLTDYLMKILTERG

SEQ ID NO: 1078 - protein, 15 aa, Homo sapiens
RDLTDYLMKILTERG

SEQ ID NO: 1079 - protein, 15 aa, Homo sapiens
RDLTDYLMKILTERG

SEQ ID NO: 1080 - protein, 15 aa, Homo sapiens
RDLTDYLMKILTERG

SEQ ID NO: 1081 - protein, 21 aa, Homo sapiens
RLDLAGRDLTDYLMKILTERG

SEQ ID NO: 1082 - protein, 15 aa, Homo sapiens
RDLTDYLMKILTERG

SEQ ID NO: 1083 - protein, 15 aa, Homo sapiens
RDLTDYLMKILTERG

SEQ ID NO: 1084 - protein, 15 aa, Homo sapiens
RDLTDYLMKILTERG

SEQ ID NO: 1085 - protein, 21 aa, Homo sapiens
RLDLAGRDLTDYLMKILTERG

SEQ ID NO: 1086 - protein, 21 aa, Homo sapiens
RLDLAGRDLTDYLMKILTERG

SEQ ID NO: 1087 - protein, 15 aa, Homo sapiens
RDLTDYLMKILTERG

SEQ ID NO: 1088 - protein, 15 aa, Homo sapiens
RDLTDYLMKILTERG

SEQ ID NO: 1089 - protein, 15 aa, Homo sapiens
RDLTDYLMKILTERG

SEQ ID NO: 1090 - protein, 21 aa, Homo sapiens
RLDLAGRDLTDYLMKILTERG

SEQ ID NO: 1091 - protein, 15 aa, Homo sapiens
RDLTDYLMKILTERG

SEQ ID NO: 1092 - protein, 15 aa, Homo sapiens
RDLTDYLMKILTERG

SEQ ID NO: 1093 - protein, 15 aa, Homo sapiens
RDLTDYLMKILTERG

SEQ ID NO: 1094 - protein, 15 aa, Homo sapiens
RDLTDYLMKILTERG

SEQ ID NO: 1095 - protein, 15 aa, Homo sapiens
RDLTDYLMKILTERG

SEQ ID NO: 1096 - protein, 15 aa, Homo sapiens
RDLTDYLMKILTERG

SEQ ID NO: 1097 - protein, 30 aa, Homo sapiens
KVDFPTAIGMVVERDDGSTLMEIDGDKGKQ

SEQ ID NO: 1098 - protein, 25 aa, Homo sapiens
RHQGVMVGMGQKDCYVGDEAQSKRG

SEQ ID NO: 1099 - protein, 10 aa, Homo sapiens
REQKKENERI

SEQ ID NO: 1100 - protein, 10 aa, Homo sapiens
KKENERIEKE

SEQ ID NO: 1101 - protein, 10 aa, Homo sapiens
KKENERIEKE

SEQ ID NO: 1102 - protein, 10 aa, Homo sapiens
KKENERIEKE

SEQ ID NO: 1103 - protein, 17 aa, Homo sapiens
KAVATYHANTEREQKKE

SEQ ID NO: 1104 - protein, 10 aa, Homo sapiens
REQKKENERI

SEQ ID NO: 1105 - protein, 19 aa, Homo sapiens
KKKIPDPDSDDVSEVDARH

SEQ ID NO: 1106 - protein, 19 aa, Homo sapiens
KIQKLTKAVATYHANTERE

SEQ ID NO: 1107 - protein, 19 aa, Homo sapiens
KIQKLTKAVATYHANTERE

SEQ ID NO: 1108 - protein, 22 aa, Homo sapiens
KEIITLAPSTMKIKIIAPPERK

SEQ ID NO: 1109 - protein, 22 aa, Homo sapiens
KEIITLAPSTMKIKIIAPPERK

SEQ ID NO: 1110 - protein, 24 aa, Homo sapiens
RKDLYANTVLSGGSTMYPGIADRM

SEQ ID NO: 1111 - protein, 13 aa, Homo sapiens
RWKYMIVDEGHRM

SEQ ID NO: 1112 - protein, 17 aa, Homo sapiens
KAVATWHANTEREQKKE

SEQ ID NO: 1113 - protein, 11 aa, Homo sapiens
KIKIIAPPERK

SEQ ID NO: 1114 - protein, 11 aa, Homo sapiens
KIKIIAPPERK

SEQ ID NO: 1115 - protein, 11 aa, Homo sapiens
KIKIIAPPERK

SEQ ID NO: 1116 - protein, 11 aa, Homo sapiens
KIKIIAPPERK

SEQ ID NO: 1117 - protein, 11 aa, Homo sapiens
KIKIIAPPERK

SEQ ID NO: 1118 - protein, 11 aa, Homo sapiens
KETERIEKERM

SEQ ID NO: 1119 - protein, 11 aa, Homo sapiens
KIKIIAPPERK

SEQ ID NO: 1120 - protein, 25 aa, Homo sapiens
RDIGEGNLSTAAAAALAAAAVKAKH

SEQ ID NO: 1121 - protein, 15 aa, Homo sapiens
KNKSKTPEIYLAYRN

SEQ ID NO: 1122 - protein, 15 aa, Homo sapiens
KNKSKTPEIYLAYRN

SEQ ID NO: 1123 - protein, 15 aa, Homo sapiens
KNKSKTPEIYLAYRN

SEQ ID NO: 1124 - protein, 10 aa, Homo sapiens
KKVMATIEKV

SEQ ID NO: 1125 - protein, 10 aa, Homo sapiens
KKVMATIEKV

SEQ ID NO: 1126 - protein, 8 aa, Homo sapiens
REQKAKRN

SEQ ID NO: 1127 - protein, 10 aa, Homo sapiens
RSRAKDDIKR

SEQ ID NO: 1128 - protein, 17 aa, Homo sapiens
RIFKWVPVVDPQEEERR

SEQ ID NO: 1129 - protein, 17 aa, Homo sapiens
RIFKWVPVVDPQEEERR

SEQ ID NO: 1130 - protein, 17 aa, Homo sapiens
RIFKWVPVVDPQEEERR

SEQ ID NO: 1131 - protein, 22 aa, Homo sapiens
KHQEYLNSILQHAKDFKEYHRS

SEQ ID NO: 1132 - protein, 13 aa, Homo sapiens
RWKYMIVDEGHRM

SEQ ID NO: 1133 - protein, 13 aa, Homo sapiens
RWKYMIVDEGHRM

SEQ ID NO: 1134 - protein, 13 aa, Homo sapiens
RWKYMIVDEGHRM

SEQ ID NO: 1135 - protein, 13 aa, Homo sapiens
RWKYMIVDEGHRM

SEQ ID NO: 1136 - protein, 13 aa, Homo sapiens
RWKYMIVDEGHRM

SEQ ID NO: 1137 - protein, 12 aa, Homo sapiens
KVSYKGSPAARR

SEQ ID NO: 1138 - protein, 9 aa, Homo sapiens
RAKDDIKKV

SEQ ID NO: 1139 - protein, 12 aa, Homo sapiens
REARITEKLEKQ

SEQ ID NO: 1140 - protein, 12 aa, Homo sapiens
KVSYKGSPAARR

SEQ ID NO: 1141 - protein, 9 aa, Homo sapiens
RAKDDIKKV

SEQ ID NO: 1142 - protein, 10 aa, Homo sapiens
RSRAKDDIKR

SEQ ID NO: 1143 - protein, 10 aa, Homo sapiens
RSVTGKIQKL

SEQ ID NO: 1144 - protein, 10 aa, Homo sapiens
RSVTGKIQKL

SEQ ID NO: 1145 - protein, 10 aa, Homo sapiens
RSVTGKIQKL

SEQ ID NO: 1146 - protein, 18 aa, Homo sapiens
RKRDSDAGSSTPTTSTRS

SEQ ID NO: 1147 - protein, 19 aa, Homo sapiens
KAYHNSPAYLAYINAKSRA

SEQ ID NO: 1148 - protein, 19 aa, Homo sapiens
KKEGLISQDGSSLEALLRT

SEQ ID NO: 1149 - protein, 18 aa, Homo sapiens
RLSFPSIKPDTDQTLKKE

SEQ ID NO: 1150 - protein, 17 aa, Homo sapiens
RLSFPSIKPDTDQTLKK

SEQ ID NO: 1151 - protein, 17 aa, Homo sapiens
RLSFPSIKPDTDQTLKK

SEQ ID NO: 1152 - protein, 17 aa, Homo sapiens
RLSFPSIKPDTDQTLKK

SEQ ID NO: 1153 - protein, 18 aa, Homo sapiens
RLSFPSIKPDTDQTLKKE

SEQ ID NO: 1154 - protein, 17 aa, Homo sapiens
RLSFPSIKPDTDQTLKK

SEQ ID NO: 1155 - protein, 18 aa, Homo sapiens
RLSFPSIKPDTDQTLKKE

SEQ ID NO: 1156 - protein, 18 aa, Homo sapiens
RLSFPSIKPDTDQTLKKE

SEQ ID NO: 1157 - protein, 18 aa, Homo sapiens
KKTGQPEELVSCSDCGRS

SEQ ID NO: 1158 - protein, 18 aa, Homo sapiens
KKTGQPEELVSCSDCGRS

SEQ ID NO: 1159 - protein, 18 aa, Homo sapiens
RKRDSDAGSSTPTTSTRS

SEQ ID NO: 1160 - protein, 13 aa, Homo sapiens
RKELPEYYELIRK

SEQ ID NO: 1161 - protein, 13 aa, Homo sapiens
RTKATVELKALRL

SEQ ID NO: 1162 - protein, 19 aa, Homo sapiens
KIQKLSKAVATWHANTERE

SEQ ID NO: 1163 - protein, 22 aa, Homo sapiens
KLDASILEDRDKPYACDICGKR

SEQ ID NO: 1164 - protein, 22 aa, Homo sapiens
KLDASILEDRDKPYACDICGKR

SEQ ID NO: 1165 - protein, 23 aa, Homo sapiens
RSGHPSCLQFTPVMMAAVKTYRW

SEQ ID NO: 1166 - protein, 23 aa, Homo sapiens
RSGHPSCLQFTPVMMAAVKTYRW

SEQ ID NO: 1167 - protein, 23 aa, Homo sapiens
RSGHPSCLQFTPVMMAAVKTYRW

SEQ ID NO: 1168 - protein, 23 aa, Homo sapiens
RSGHPSCLQFTPVMMAAVKTYRW

SEQ ID NO: 1169 - protein, 13 aa, Homo sapiens
RKELPEYYELIRK

SEQ ID NO: 1170 - protein, 19 aa, Homo sapiens
KKEGLISQDGSSLEALLRT

SEQ ID NO: 1171 - protein, 23 aa, Homo sapiens
KKGPDGLALPNNYCDFCLGDSKI

SEQ ID NO: 1172 - protein, 26 aa, Homo sapiens
RILEPDDFLDDLDDEDYEEDTPKRRG

SEQ ID NO: 1173 - protein, 24 aa, Homo sapiens
RCTLLLMLDYQPPQFKLDPRLARL

SEQ ID NO: 1174 - protein, 14 aa, Homo sapiens
RDKPYACDICGKRY

SEQ ID NO: 1175 - protein, 11 aa, Homo sapiens
RKKDGGPNVKY

SEQ ID NO: 1176 - protein, 24 aa, Homo sapiens
RLPFLDSQTGVAQSNCYIWMEKRH

SEQ ID NO: 1177 - protein, 24 aa, Homo sapiens
RLPFLDSQTGVAQSNCYIWMEKRH

SEQ ID NO: 1178 - protein, 12 aa, Homo sapiens
KSKGKGVGSARK

SEQ ID NO: 1179 - protein, 11 aa, Homo sapiens
RKKDGGPNVKY

SEQ ID NO: 1180 - protein, 34 aa, Homo sapiens
RPGLSYHYAHSHLAEEEGEDKEDSQPPTPVSQRS

SEQ ID NO: 1181 - protein, 34 aa, Homo sapiens; identical to SEQ ID NO: 1180

SEQ ID NO: 1182 - protein, 34 aa, Homo sapiens; identical to SEQ ID NO: 1180

SEQ ID NO: 1183 - protein, 34 aa, Homo sapiens; identical to SEQ ID NO: 1180

SEQ ID NO: 1184 - protein, 34 aa, Homo sapiens; identical to SEQ ID NO: 1180

SEQ ID NO: 1185 - protein, 34 aa, Homo sapiens; identical to SEQ ID NO: 1180

SEQ ID NO: 1186 - protein, 34 aa, Homo sapiens; identical to SEQ ID NO: 1180

SEQ ID NO: 1187 - protein, 34 aa, Homo sapiens; identical to SEQ ID NO: 1180

SEQ ID NO: 1188 - protein, 34 aa, Homo sapiens; identical to SEQ ID NO: 1180

SEQ ID NO: 1189 - protein, 34 aa, Homo sapiens; identical to SEQ ID NO: 1180

SEQ ID NO: 1190 - protein, 21 aa, Homo sapiens
RKRPAPQQIQQVQQQAVQNRN

SEQ ID NO: 1191 - protein, 21 aa, Homo sapiens
RKRPAPQQIQQVQQQAVQNRN

SEQ ID NO: 1192 - protein, 11 aa, Homo sapiens
RKLDQTIMRKR

SEQ ID NO: 1193 - protein, 12 aa, Homo sapiens
KSKGKGVGSARK

SEQ ID NO: 1194 - protein, 17 aa, Homo sapiens
RLSFPSIKPDTDQTLKK

SEQ ID NO: 1195 - protein, 19 aa, Homo sapiens
KKEGLISQDGSSLEALLRT

SEQ ID NO: 1196 - protein, 16 aa, Homo sapiens
RKVWDQVKASNPDLKL

SEQ ID NO: 1197 - protein, 23 aa, Homo sapiens
RSGHPSCLQFTPVMMAAVKTYRW

SEQ ID NO: 1198 - protein, 13 aa, Homo sapiens
RHQGTFTDEKSKA

SEQ ID NO: 1199 - protein, 13 aa, Homo sapiens
RHQGTFTDEKSKA

SEQ ID NO: 1200 - protein, 9 aa, Homo sapiens
KKVQEAARA

SEQ ID NO: 1201 - protein, 23 aa, Homo sapiens
RQQLLTERQNFHMEQLKYAELRA

SEQ ID NO: 1202 - protein, 23 aa, Homo sapiens
RSGHPSCLQFTPVMMAAVKTYRW

SEQ ID NO: 1203 - protein, 9 aa, Homo sapiens
RTDPLEKRG

SEQ ID NO: 1204 - protein, 9 aa, Homo sapiens
RTDPLEKRG

SEQ ID NO: 1205 - protein, 11 aa, Homo sapiens
RDRKASANARK

SEQ ID NO: 1206 - protein, 9 aa, Homo sapiens
RTDPLEKRG

SEQ ID NO: 1207 - protein, 9 aa, Homo sapiens
RTDPLEKRG

SEQ ID NO: 1208 - protein, 14 aa, Homo sapiens
KRHQGTFTDEKSKA

SEQ ID NO: 1209 - protein, 14 aa, Homo sapiens
KRHQGTFTDEKSKA

SEQ ID NO: 1210 - protein, 27 aa, Homo sapiens
KSKASHHIYPYSSSQDDEEWLRPVMRK

SEQ ID NO: 1211 - protein, 27 aa, Homo sapiens
KSKASHHIYPYSSSQDDEEWLRPVMRK

SEQ ID NO: 1212 - protein, 27 aa, Homo sapiens
KSKASHHIYPYSSSQDDEEWLRPVMRK

SEQ ID NO: 1213 - protein, 9 aa, Homo sapiens
KKIRDQDRN

SEQ ID NO: 1214 - protein, 18 aa, Homo sapiens
KKTGQPEELVSCSDCGRS

SEQ ID NO: 1215 - protein, 27 aa, Homo sapiens
RGQLSWHQKTYAFSENPLPTVEIAIRN

SEQ ID NO: 1216 - protein, 27 aa, Homo sapiens
RGQLSWHQKTYAFSENPLPTVEIAIRN

SEQ ID NO: 1217 - protein, 22 aa, Homo sapiens
RSRDETPLCTIAHWQDSLAKRC

SEQ ID NO: 1218 - protein, 22 aa, Homo sapiens
RSRDETPLCTIAHWQDSLAKRC

SEQ ID NO: 1219 - protein, 22 aa, Homo sapiens
RSRDETPLCTIAHWQDSLAKRC

SEQ ID NO: 1220 - protein, 22 aa, Homo sapiens
RSRDETPLCTIAHWQDSLAKRC

SEQ ID NO: 1221 - protein, 22 aa, Homo sapiens
RSRDETPLCTIAHWQDSLAKRC

SEQ ID NO: 1222 - protein, 22 aa, Homo sapiens
RSRDETPLCTIAHWQDSLAKRC

SEQ ID NO: 1223 - protein, 22 aa, Homo sapiens
RSRDETPLCTIAHWQDSLAKRC

SEQ ID NO: 1224 - protein, 22 aa, Homo sapiens
RSRDETPLCTIAHWQDSLAKRC

SEQ ID NO: 1225 - protein, 22 aa, Homo sapiens
RSRDETPLCTIAHWQDSLAKRC

SEQ ID NO: 1226 - protein, 22 aa, Homo sapiens
RSRDETPLCTIAHWQDSLAKRC

SEQ ID NO: 1227 - protein, 12 aa, Homo sapiens
RMTEKLEKQQKI

SEQ ID NO: 1228 - protein, 12 aa, Homo sapiens
RMTEKLEKQQKI

SEQ ID NO: 1229 - protein, 12 aa, Homo sapiens
RAAKALLAMARV

SEQ ID NO: 1230 - protein, 12 aa, Homo sapiens
RMTEKLEKQQKI

SEQ ID NO: 1231 - protein, 12 aa, Homo sapiens
RMTEKLEKQQKI

SEQ ID NO: 1232 - protein, 12 aa, Homo sapiens
RMTEKLEKQQKI

SEQ ID NO: 1233 - protein, 12 aa, Homo sapiens
RMTEKLEKQQKI

SEQ ID NO: 1234 - protein, 10 aa, Homo sapiens
KQQKIEQERK

SEQ ID NO: 1235 - protein, 10 aa, Homo sapiens
KQQKIEQERK

SEQ ID NO: 1236 - protein, 10 aa, Homo sapiens
KQQKIEQERK

SEQ ID NO: 1237 - protein, 17 aa, Homo sapiens
RRDTTLETALNSKAYKR

SEQ ID NO: 1238 - protein, 17 aa, Homo sapiens
RDTTLETALNSKAYKRS

SEQ ID NO: 1239 - protein, 17 aa, Homo sapiens
RDTTLETALNSKAYKRS

SEQ ID NO: 1240 - protein, 22 aa, Homo sapiens
RSRDETPLCTIAHWQDSLAKRC

SEQ ID NO: 1241 - protein, 22 aa, Homo sapiens
RSRDETPLCTIAHWQDSLAKRC

SEQ ID NO: 1242 - protein, 18 aa, Homo sapiens
KGKGGTKTLMNTIMQLRK

SEQ ID NO: 1243 - protein, 12 aa, Homo sapiens
RITEKLEKQQKI

SEQ ID NO: 1244 - protein, 12 aa, Homo sapiens
RITEKLEKQQKI

SEQ ID NO: 1245 - protein, 12 aa, Homo sapiens
RITEKLEKQQKI

SEQ ID NO: 1246 - protein, 12 aa, Homo sapiens
RITEKLEKQQKI

SEQ ID NO: 1247 - protein, 12 aa, Homo sapiens
RITEKLEKQQKI

SEQ ID NO: 1248 - protein, 12 aa, Homo sapiens
RITEKLEKQQKI

SEQ ID NO: 1249 - protein, 12 aa, Homo sapiens
RITEKLEKQQKI

SEQ ID NO: 1250 - protein, 12 aa, Homo sapiens
RITEKLEKQQKI

SEQ ID NO: 1251 - protein, 22 aa, Homo sapiens
RSRDETPLCTIAHWQDSLAKRC

SEQ ID NO: 1252 - protein, 22 aa, Homo sapiens
RSRDETPLCTIAHWQDSLAKRC

SEQ ID NO: 1253 - protein, 22 aa, Homo sapiens
RSRDETPLCTIAHWQDSLAKRC

SEQ ID NO: 1254 - protein, 22 aa, Homo sapiens
RSRDETPLCTIAHWQDSLAKRC

SEQ ID NO: 1255 - protein, 22 aa, Homo sapiens
RSRDETPLCTIAHWQDSLAKRC

SEQ ID NO: 1256 - protein, 22 aa, Homo sapiens
RSRDETPLCTIAHWQDSLAKRC

SEQ ID NO: 1257 - protein, 22 aa, Homo sapiens
RSRDETPLCTIAHWQDSLAKRC

SEQ ID NO: 1258 - protein, 18 aa, Homo sapiens
RGQPLPDHLQMAVQGKRP

SEQ ID NO: 1259 - protein, 27 aa, Homo sapiens
RKNPVCREMSMALLSNLAQGDALAARA

SEQ ID NO: 1260 - protein, 17 aa, Homo sapiens
RDTALETALNAKAYKRS

SEQ ID NO: 1261 - protein, 17 aa, Homo sapiens
RDTALETALNAKAYKRS

SEQ ID NO: 1262 - protein, 17 aa, Homo sapiens
RDTALETALNAKAYKRS

SEQ ID NO: 1263 - protein, 17 aa, Homo sapiens
RRDTALETALNAKAYKR

SEQ ID NO: 1264 - protein, 17 aa, Homo sapiens
RRDTALETALNAKAYKR

SEQ ID NO: 1265 - protein, 17 aa, Homo sapiens
RRDTALETALNAKAYKR

SEQ ID NO: 1266 - protein, 17 aa, Homo sapiens
RRDTALETALNAKAYKR

SEQ ID NO: 1267 - protein, 17 aa, Homo sapiens
RRDTALETALNAKAYKR

SEQ ID NO: 1268 - protein, 17 aa, Homo sapiens
RRDTALETALNAKAYKR

SEQ ID NO: 1269 - protein, 19 aa, Homo sapiens
KAYHNSPAYLAYINAKSRA

SEQ ID NO: 1270 - protein, 19 aa, Homo sapiens
KAYHNSPAYLAYINAKSRA

SEQ ID NO: 1271 - protein, 19 aa, Homo sapiens
KAYHNSPAYLAYINAKSRA

SEQ ID NO: 1272 - protein, 19 aa, Homo sapiens
KAYHNSPAYLAYINAKSRA

SEQ ID NO: 1273 - protein, 19 aa, Homo sapiens
KAYHNSPAYLAYINAKSRA

SEQ ID NO: 1274 - protein, 19 aa, Homo sapiens
KAYHNSPAYLAYINAKSRA

SEQ ID NO: 1275 - protein, 28 aa, Homo sapiens
RMEKGEPYMSIQPAEDPDDYDDGFSMKH

SEQ ID NO: 1276 - protein, 28 aa, Homo sapiens
RMEKGEPYMSIQPAEDPDDYDDGFSMKH

SEQ ID NO: 1277 - protein, 28 aa, Homo sapiens
RMEKGEPYMSIQPAEDPDDYDDGFSMKH

SEQ ID NO: 1278 - protein, 28 aa, Homo sapiens
RMEKGEPYMSIQPAEDPDDYDDGFSMKH

SEQ ID NO: 1279 - protein, 14 aa, Homo sapiens
RKLEAELLQIEERH

SEQ ID NO: 1280 - protein, 19 aa, Homo sapiens
KAYHNSPAYLAYINAKSRA

SEQ ID NO: 1281 - protein, 19 aa, Homo sapiens
KAYHNSPAYLAYINAKSRA

SEQ ID NO: 1282 - protein, 19 aa, Homo sapiens
KAYHNSPAYLAYINAKSRA

SEQ ID NO: 1283 - protein, 19 aa, Homo sapiens
KAYHNSPAYLAYINAKSRA

SEQ ID NO: 1284 - protein, 39 aa, Homo sapiens; identical to SEQ ID NO: 956

SEQ ID NO: 1285 - protein, 39 aa, Homo sapiens; identical to SEQ ID NO: 956

SEQ ID NO: 1286 - protein, 39 aa, Homo sapiens; identical to SEQ ID NO: 956

SEQ ID NO: 1287 - protein, 13 aa, Homo sapiens
RYVGDRKNPVCRE

SEQ ID NO: 1288 - protein, 13 aa, Homo sapiens
RYVGDRKNPVCRE

SEQ ID NO: 1289 - protein, 22 aa, Homo sapiens
RSRDETPLCTIAHWQDSLAKRC

SEQ ID NO: 1290 - protein, 22 aa, Homo sapiens
RSRDETPLCTIAHWQDSLAKRC

SEQ ID NO: 1291 - protein, 22 aa, Homo sapiens
RSRDETPLCTIAHWQDSLAKRC

SEQ ID NO: 1292 - protein, 22 aa, Homo sapiens
RSRDETPLCTIAHWQDSLAKRC

SEQ ID NO: 1293 - protein, 22 aa, Homo sapiens
RSRDETPLCTIAHWQDSLAKRC

SEQ ID NO: 1294 - protein, 22 aa, Homo sapiens
RSRDETPLCTIAHWQDSLAKRC

SEQ ID NO: 1295 - protein, 22 aa, Homo sapiens
RSRDETPLCTIAHWQDSLAKRC

SEQ ID NO: 1296 - protein, 22 aa, Homo sapiens
RSRDETPLCTIAHWQDSLAKRC

SEQ ID NO: 1297 - protein, 22 aa, Homo sapiens
RSRDETPLCTIAHWQDSLAKRC

SEQ ID NO: 1298 - protein, 22 aa, Homo sapiens
RSRDETPLCTIAHWQDSLAKRC

SEQ ID NO: 1299 - protein, 22 aa, Homo sapiens
RSRDETPLCTIAHWQDSLAKRC

SEQ ID NO: 1300 - protein, 15 aa, Homo sapiens
KITKVYELGNEPERK

SEQ ID NO: 1301 - protein, 14 aa, Homo sapiens
KFPFGIQQAKSHRN

SEQ ID NO: 1302 - protein, 14 aa, Homo sapiens
KFPFGIQQAKSHRN

SEQ ID NO: 1303 - protein, 12 aa, Homo sapiens
RNIKLLEDEPRS

SEQ ID NO: 1304 - protein, 12 aa, Homo sapiens
RNIKLLEDEPRS

SEQ ID NO: 1305 - protein, 12 aa, Homo sapiens
RNIKLLEDEPRS

SEQ ID NO: 1306 - protein, 12 aa, Homo sapiens
RNIKLLEDEPRS

SEQ ID NO: 1307 - protein, 12 aa, Homo sapiens
RQEKFYATLVRY

SEQ ID NO: 1308 - protein, 12 aa, Homo sapiens
RQEKFYATLVRY

SEQ ID NO: 1309 - protein, 12 aa, Homo sapiens
RQEKFYATLVRY

SEQ ID NO: 1310 - protein, 12 aa, Homo sapiens
RQEKFYATLVRY

SEQ ID NO: 1311 - protein, 12 aa, Homo sapiens
RQEKFYATLVRY

SEQ ID NO: 1312 - protein, 12 aa, Homo sapiens
RQEKFYATLVRY

SEQ ID NO: 1313 - protein, 12 aa, Homo sapiens
RQEKFYATLVRY

SEQ ID NO: 1314 - protein, 12 aa, Homo sapiens
RQEKFYATLVRY

SEQ ID NO: 1315 - protein, 12 aa, Homo sapiens
RQEKFYATLVRY

SEQ ID NO: 1316 - protein, 12 aa, Homo sapiens
RQEKFYATLVRY

SEQ ID NO: 1317 - protein, 12 aa, Homo sapiens
RQEKFYATLVRY

SEQ ID NO: 1318 - protein, 12 aa, Homo sapiens
RQEKFYATLVRY

SEQ ID NO: 1319 - protein, 21 aa, Homo sapiens
RKRPAPQQIQQVQQQAVQNRN

SEQ ID NO: 1320 - protein, 21 aa, Homo sapiens
RKRPAPQQIQQVQQQAVQNRN

SEQ ID NO: 1321 - protein, 21 aa, Homo sapiens
RKRPAPQQIQQVQQQAVQNRN

SEQ ID NO: 1322 - protein, 21 aa, Homo sapiens
RKRPAPQQIQQVQQQAVQNRN

SEQ ID NO: 1323 - protein, 21 aa, Homo sapiens
RKRPAPQQIQQVQQQAVQNRN

SEQ ID NO: 1324 - protein, 21 aa, Homo sapiens
RKRPAPQQIQQVQQQAVQNRN

SEQ ID NO: 1325 - protein, 21 aa, Homo sapiens
RKRPAPQQIQQVQQQAVQNRN

SEQ ID NO: 1326 - protein, 21 aa, Homo sapiens
RKRPAPQQIQQVQQQAVQNRN

SEQ ID NO: 1327 - protein, 21 aa, Homo sapiens
RKRPAPQQIQQVQQQAVQNRN

SEQ ID NO: 1328 - protein, 21 aa, Homo sapiens
RKRPAPQQIQQVQQQAVQNRN

SEQ ID NO: 1329 - protein, 23 aa, Homo sapiens
RKCLIDIFGILMEYEVGDPSQKA

SEQ ID NO: 1330 - protein, 21 aa, Homo sapiens
RAPQTYEKEEDEDKGVACSKD

SEQ ID NO: 1331 - protein, 21 aa, Homo sapiens
RAPQTYEKEEDEDKGVACSKD

SEQ ID NO: 1332 - protein, 21 aa, Homo sapiens
RAPQTYEKEEDEDKGVACSKD

SEQ ID NO: 1333 - protein, 21 aa, Homo sapiens
RAPQTYEKEEDEDKGVACSKD

SEQ ID NO: 1334 - protein, 12 aa, Homo sapiens
KAKHLAAVEERK

SEQ ID NO: 1335 - protein, 12 aa, Homo sapiens
KAKHLAAVEERK

SEQ ID NO: 1336 - protein, 15 aa, Homo sapiens
KSLVALLVETQMKKL

SEQ ID NO: 1337 - protein, 15 aa, Homo sapiens
KSLVALLVETQMKKL

SEQ ID NO: 1338 - protein, 12 aa, Homo sapiens
KAKHLAAVEERK

SEQ ID NO: 1339 - protein, 11 aa, Homo sapiens
KKNNLFVVDRS

SEQ ID NO: 1340 - protein, 11 aa, Homo sapiens
KKNNLFVVDRS

SEQ ID NO: 1341 - protein, 11 aa, Homo sapiens
KKNNLFVVDRS

SEQ ID NO: 1342 - protein, 14 aa, Homo sapiens
RHMDGMYGPPAKRH

SEQ ID NO: 1343 - protein, 14 aa, Homo sapiens
RHMDGMYGPPAKRH

SEQ ID NO: 1344 - protein, 22 aa, Homo sapiens
RSRDETPLCTIAHWQDSLAKRC

SEQ ID NO: 1345 - protein, 22 aa, Homo sapiens
RSRDETPLCTIAHWQDSLAKRC

SEQ ID NO: 1346 - protein, 22 aa, Homo sapiens
RSRDETPLCTIAHWQDSLAKRC

SEQ ID NO: 1347 - protein, 22 aa, Homo sapiens
RSRDETPLCTIAHWQDSLAKRC

SEQ ID NO: 1348 - protein, 22 aa, Homo sapiens
RSRDETPLCTIAHWQDSLAKRC

SEQ ID NO: 1349 - protein, 22 aa, Homo sapiens
RSRDETPLCTIAHWQDSLAKRC

SEQ ID NO: 1350 - protein, 22 aa, Homo sapiens
RSRDETPLCTIAHWQDSLAKRC

SEQ ID NO: 1351 - protein, 22 aa, Homo sapiens
RSRDETPLCTIAHWQDSLAKRC

SEQ ID NO: 1352 - protein, 22 aa, Homo sapiens
RSRDETPLCTIAHWQDSLAKRC

SEQ ID NO: 1353 - protein, 22 aa, Homo sapiens
RSRDETPLCTIAHWQDSLAKRC

SEQ ID NO: 1354 - protein, 22 aa, Homo sapiens
RSRDETPLCTIAHWQDSLAKRC

SEQ ID NO: 1355 - protein, 22 aa, Homo sapiens
RSRDETPLCTIAHWQDSLAKRC

SEQ ID NO: 1356 - protein, 22 aa, Homo sapiens
RSRDETPLCTIAHWQDSLAKRC

SEQ ID NO: 1357 - protein, 22 aa, Homo sapiens
RSRDETPLCTIAHWQDSLAKRC

SEQ ID NO: 1358 - protein, 22 aa, Homo sapiens
RSRDETPLCTIAHWQDSLAKRC

SEQ ID NO: 1359 - protein, 22 aa, Homo sapiens
RSRDETPLCTIAHWQDSLAKRC

SEQ ID NO: 1360 - protein, 20 aa, Homo sapiens
RDETPLCTIAHWQDSLAKRC

SEQ ID NO: 1361 - protein, 22 aa, Homo sapiens
RSRDETPLCTIAHWQDSLAKRC

SEQ ID NO: 1362 - protein, 22 aa, Homo sapiens
RSRDETPLCTIAHWQDSLAKRC

SEQ ID NO: 1363 - protein, 22 aa, Homo sapiens
RSRDETPLCTIAHWQDSLAKRC

SEQ ID NO: 1364 - protein, 20 aa, Homo sapiens
RDETPLCTIAHWQDSLAKRC

SEQ ID NO: 1365 - protein, 20 aa, Homo sapiens
RDETPLCTIAHWQDSLAKRC

SEQ ID NO: 1366 - protein, 22 aa, Homo sapiens
RSRDETPLCTIAHWQDSLAKRC

SEQ ID NO: 1367 - protein, 20 aa, Homo sapiens
RDETPLCTIAHWQDSLAKRC

SEQ ID NO: 1368 - protein, 22 aa, Homo sapiens
RSRDETPLCTIAHWQDSLAKRC

SEQ ID NO: 1369 - protein, 22 aa, Homo sapiens
RSRDETPLCTIAHWQDSLAKRC

SEQ ID NO: 1370 - protein, 22 aa, Homo sapiens
RSRDETPLCTIAHWQDSLAKRC

SEQ ID NO: 1371 - protein, 22 aa, Homo sapiens
RSRDETPLCTIAHWQDSLAKRC

SEQ ID NO: 1372 - protein, 22 aa, Homo sapiens
RSRDETPLCTIAHWQDSLAKRC

SEQ ID NO: 1373 - protein, 22 aa, Homo sapiens
RSRDETPLCTIAHWQDSLAKRC

SEQ ID NO: 1374 - protein, 22 aa, Homo sapiens
RSRDETPLCTIAHWQDSLAKRC

SEQ ID NO: 1375 - protein, 22 aa, Homo sapiens
RSRDETPLCTIAHWQDSLAKRC

SEQ ID NO: 1376 - protein, 22 aa, Homo sapiens
RSRDETPLCTIAHWQDSLAKRC

SEQ ID NO: 1377 - protein, 22 aa, Homo sapiens
RSRDETPLCTIAHWQDSLAKRC

SEQ ID NO: 1378 - protein, 22 aa, Homo sapiens
RSRDETPLCTIAHWQDSLAKRC

SEQ ID NO: 1379 - protein, 22 aa, Homo sapiens
RSRDETPLCTIAHWQDSLAKRC

SEQ ID NO: 1380 - protein, 22 aa, Homo sapiens
RSRDETPLCTIAHWQDSLAKRC

SEQ ID NO: 1381 - protein, 22 aa, Homo sapiens
RSRDETPLCTIAHWQDSLAKRC

SEQ ID NO: 1382 - protein, 22 aa, Homo sapiens
RSRDETPLCTIAHWQDSLAKRC

SEQ ID NO: 1383 - protein, 22 aa, Homo sapiens
RSRDETPLCTIAHWQDSLAKRC

SEQ ID NO: 1384 - protein, 22 aa, Homo sapiens
RSRDETPLCTIAHWQDSLAKRC

SEQ ID NO: 1385 - protein, 22 aa, Homo sapiens
RSRDETPLCTIAHWQDSLAKRC

SEQ ID NO: 1386 - protein, 22 aa, Homo sapiens
RSRDETPLCTIAHWQDSLAKRC

SEQ ID NO: 1387 - protein, 22 aa, Homo sapiens
RSRDETPLCTIAHWQDSLAKRC

SEQ ID NO: 1388 - protein, 20 aa, Homo sapiens
RDETPLCTIAHWQDSLAKRC

SEQ ID NO: 1389 - protein, 22 aa, Homo sapiens
RSRDETPLCTIAHWQDSLAKRC

SEQ ID NO: 1390 - protein, 22 aa, Homo sapiens
RSRDETPLCTIAHWQDSLAKRC

SEQ ID NO: 1391 - protein, 22 aa, Homo sapiens
RSRDETPLCTIAHWQDSLAKRC

SEQ ID NO: 1392 - protein, 22 aa, Homo sapiens
RSRDETPLCTIAHWQDSLAKRC

SEQ ID NO: 1393 - protein, 22 aa, Homo sapiens
RSRDETPLCTIAHWQDSLAKRC

SEQ ID NO: 1394 - protein, 20 aa, Homo sapiens
RDETPLCTIAHWQDSLAKRC

SEQ ID NO: 1395 - protein, 22 aa, Homo sapiens
RSRDETPLCTIAHWQDSLAKRC

SEQ ID NO: 1396 - protein, 22 aa, Homo sapiens
RSRDETPLCTIAHWQDSLAKRC

SEQ ID NO: 1397 - protein, 22 aa, Homo sapiens
RSRDETPLCTIAHWQDSLAKRC

SEQ ID NO: 1398 - protein, 22 aa, Homo sapiens
RSRDETPLCTIAHWQDSLAKRC

SEQ ID NO: 1399 - protein, 22 aa, Homo sapiens
RSRDETPLCTIAHWQDSLAKRC

SEQ ID NO: 1400 - protein, 16 aa, Homo sapiens
RMEIQEAIKKPLTQKR

SEQ ID NO: 1401 - protein, 16 aa, Homo sapiens
RMEIQEAIKKPLTQKR

SEQ ID NO: 1402 - protein, 12 aa, Homo sapiens
RNIKLLEDEPRS

SEQ ID NO: 1403 - protein, 12 aa, Homo sapiens
RNIKLLEDEPRS

SEQ ID NO: 1404 - protein, 12 aa, Homo sapiens
RNIKLLEDEPRS

SEQ ID NO: 1405 - protein, 14 aa, Homo sapiens
KFPFGIQQAKSHRN

SEQ ID NO: 1406 - protein, 14 aa, Homo sapiens
KFPFGIQQAKSHRN

SEQ ID NO: 1407 - protein, 12 aa, Homo sapiens
RQEKFYATLVRY

SEQ ID NO: 1408 - protein, 12 aa, Homo sapiens
RQEKFYATLVRY

SEQ ID NO: 1409 - protein, 12 aa, Homo sapiens
RQEKFYATLVRY

SEQ ID NO: 1410 - protein, 12 aa, Homo sapiens
RQEKFYATLVRY

SEQ ID NO: 1411 - protein, 12 aa, Homo sapiens
RAAKALLAMARV

SEQ ID NO: 1412 - protein, 12 aa, Homo sapiens
RNIKLLEDEPRS

SEQ ID NO: 1413 - protein, 12 aa, Homo sapiens
RNIKLLEDEPRS

SEQ ID NO: 1414 - protein, 14 aa, Homo sapiens
RHMDGMYGPPAKRH

SEQ ID NO: 1415 - protein, 14 aa, Homo sapiens
RHMDGMYGPPAKRH

SEQ ID NO: 1416 - protein, 37 aa, Homo sapiens
RVQEFNSGLLHWQLGGGDTTEHIQTHFESKMEIPPRR

SEQ ID NO: 1417 - protein, 37 aa, Homo sapiens; identical to SEQ ID NO: 1416

SEQ ID NO: 1418 - protein, 18 aa, Homo sapiens
RVREEVPLELVEAHVKKV

SEQ ID NO: 1419 - protein, 9 aa, Homo sapiens
RTDIYSKKT

SEQ ID NO: 1420 - protein, 9 aa, Homo sapiens
RTDIYSKKT

SEQ ID NO: 1421 - protein, 34 aa, Homo sapiens
RQQGGGMMMGPGGGGAASLSKAAAGSAAGGFQRF

SEQ ID NO: 1422 - protein, 34 aa, Homo sapiens; identical to SEQ ID NO: 1421

SEQ ID NO: 1423 - protein, 34 aa, Homo sapiens; identical to SEQ ID NO: 1421

SEQ ID NO: 1424 - protein, 22 aa, Homo sapiens
RHFEELETIMDREKEALEQQRQ

SEQ ID NO: 1425 - protein, 22 aa, Homo sapiens
RHFEELETIMDREKEALEQQRQ

SEQ ID NO: 1426 - protein, 22 aa, Homo sapiens
RHFEELETIMDREKEALEQQRQ

SEQ ID NO: 1427 - protein, 11 aa, Homo sapiens
REKEALEQQRQ

SEQ ID NO: 1428 - protein, 24 aa, Homo sapiens
RAAIMQALWLYIKHNQLQDGHERE

SEQ ID NO: 1429 - protein, 24 aa, Homo sapiens
RAAIMQALWLYIKHNQLQDGHERE

SEQ ID NO: 1430 - protein, 24 aa, Homo sapiens
RAAIMQALWLYIKHNQLQDGHERE

SEQ ID NO: 1431 - protein, 24 aa, Homo sapiens
RAAIMQALWLYIKHNQLQDGHERE

SEQ ID NO: 1432 - protein, 24 aa, Homo sapiens
RAAIMQALWLYIKHNQLQDGHERE

SEQ ID NO: 1433 - protein, 24 aa, Homo sapiens
RAAIMQALWLYIKHNQLQDGHERE

SEQ ID NO: 1434 - protein, 24 aa, Homo sapiens
RAAIMQALWLYIKHNQLQDGHERE

SEQ ID NO: 1435 - protein, 24 aa, Homo sapiens
RAAIMQALWLYIKHNQLQDGHERE

SEQ ID NO: 1436 - protein, 11 aa, Homo sapiens
RHIFAKVQQRR

SEQ ID NO: 1437 - protein, 11 aa, Homo sapiens
RHIFAKVQQRR

SEQ ID NO: 1438 - protein, 16 aa, Homo sapiens
RQRGKGEITPAAIQKM

SEQ ID NO: 1439 - protein, 17 aa, Homo sapiens
RVASAAAKAALEEFSRV

SEQ ID NO: 1440 - protein, 16 aa, Homo sapiens
RTPTTQETDGFQVKRP

SEQ ID NO: 1441 - protein, 26 aa, Homo sapiens
RLQDSHDKEYINGDKYFQQIFDCPRL

SEQ ID NO: 1442 - protein, 26 aa, Homo sapiens
RLQDSHDKEYINGDKYFQQIFDCPRL

SEQ ID NO: 1443 - protein, 26 aa, Homo sapiens
RLQDSHDKEYINGDKYFQQIFDCPRL

SEQ ID NO: 1444 - protein, 26 aa, Homo sapiens
RLQDSHDKEYINGDKYFQQIFDCPRL

SEQ ID NO: 1445 - protein, 26 aa, Homo sapiens
RLQDSHDKEYINGDKYFQQIFDCPRL

SEQ ID NO: 1446 - protein, 26 aa, Homo sapiens
RLQDSHDKEYINGDKYFQQIFDCPRL

SEQ ID NO: 1447 - protein, 19 aa, Homo sapiens
KEYINGDKYFQQIFDCPRL

SEQ ID NO: 1448 - protein, 26 aa, Homo sapiens
RLQDSHDKEYINGDKYFQQIFDCPRL

SEQ ID NO: 1449 - protein, 11 aa, Homo sapiens
RYFYSKVQQRR

SEQ ID NO: 1450 - protein, 21 aa, Homo sapiens
RKRPAPQQIQQVQQQAVQNRN

SEQ ID NO: 1451 - protein, 21 aa, Homo sapiens
RKRPAPQQIQQVQQQAVQNRN

SEQ ID NO: 1452 - protein, 17 aa, Homo sapiens
RVASAAAKAALEEFSRV

SEQ ID NO: 1453 - protein, 17 aa, Homo sapiens
RVASAAAKAALEEFSRV

SEQ ID NO: 1454 - protein, 19 aa, Homo sapiens
REFVICDKYLQQIFESQRM

SEQ ID NO: 1455 - protein, 19 aa, Homo sapiens
REFVICDKYLQQIFESQRM

SEQ ID NO: 1456 - protein, 26 aa, Homo sapiens
KLQDPHEREFVICDKYLQQIFESQRM

SEQ ID NO: 1457 - protein, 19 aa, Homo sapiens
REFVICDKYLQQIFESQRM

SEQ ID NO: 1458 - protein, 26 aa, Homo sapiens
KLQDPHEREFVICDKYLQQIFESQRM

SEQ ID NO: 1459 - protein, 19 aa, Homo sapiens
REFVICDKYLQQIFESQRM

SEQ ID NO: 1460 - protein, 26 aa, Homo sapiens
KLQDPHEREFVICDKYLQQIFESQRM

SEQ ID NO: 1461 - protein, 26 aa, Homo sapiens
KLQDPHEREFVICDKYLQQIFESQRM

SEQ ID NO: 1462 - protein, 19 aa, Homo sapiens
REFVICDKYLQQIFESQRM

SEQ ID NO: 1463 - protein, 19 aa, Homo sapiens
REFVICDKYLQQIFESQRM

SEQ ID NO: 1464 - protein, 19 aa, Homo sapiens
REFVICDKYLQQIFESQRM

SEQ ID NO: 1465 - protein, 19 aa, Homo sapiens
REFVICDKYLQQIFESQRM

SEQ ID NO: 1466 - protein, 26 aa, Homo sapiens
KLQDPHEREFVICDKYLQQIFESQRM

SEQ ID NO: 1467 - protein, 19 aa, Homo sapiens
REFVICDKYLQQIFESQRM

SEQ ID NO: 1468 - protein, 19 aa, Homo sapiens
REFVICDKYLQQIFESQRM

SEQ ID NO: 1469 - protein, 19 aa, Homo sapiens
REFVICDKYLQQIFESQRM

SEQ ID NO: 1470 - protein, 19 aa, Homo sapiens
REFVICDKYLQQIFESQRM

SEQ ID NO: 1471 - protein, 19 aa, Homo sapiens
REFVICDKYLQQIFESQRM

SEQ ID NO: 1472 - protein, 19 aa, Homo sapiens
REFVICDKYLQQIFESQRM

SEQ ID NO: 1473 - protein, 19 aa, Homo sapiens
REFVICDKYLQQIFESQRM

SEQ ID NO: 1474 - protein, 19 aa, Homo sapiens
REFVICDKYLQQIFESQRM

SEQ ID NO: 1475 - protein, 19 aa, Homo sapiens
REFVICDKYLQQIFESQRM

SEQ ID NO: 1476 - protein, 19 aa, Homo sapiens
REFVICDKYLQQIFESQRM

SEQ ID NO: 1477 - protein, 19 aa, Homo sapiens
REFVICDKYLQQIFESQRM

SEQ ID NO: 1478 - protein, 19 aa, Homo sapiens
REFVICDKYLQQIFESQRM

SEQ ID NO: 1479 - protein, 19 aa, Homo sapiens
REFVICDKYLQQIFESQRM

SEQ ID NO: 1480 - protein, 16 aa, Homo sapiens
RQNFHMEQLKYAELRA

SEQ ID NO: 1481 - protein, 16 aa, Homo sapiens
RQNFHMEQLKYAELRA

SEQ ID NO: 1482 - protein, 16 aa, Homo sapiens
RQNFHMEQLKYAELRA

SEQ ID NO: 1483 - protein, 16 aa, Homo sapiens
RQNFHMEQLKYAELRA

SEQ ID NO: 1484 - protein, 16 aa, Homo sapiens
RQNFHMEQLKYAELRA

SEQ ID NO: 1485 - protein, 19 aa, Homo sapiens
KTHKLQDPHEREFVICDKY

SEQ ID NO: 1486 - protein, 16 aa, Homo sapiens
RQNFHMEQLKYAELRA

SEQ ID NO: 1487 - protein, 16 aa, Homo sapiens
RQNFHMEQLKYAELRA

SEQ ID NO: 1488 - protein, 16 aa, Homo sapiens
RQNFHMEQLKYAELRA

SEQ ID NO: 1489 - protein, 16 aa, Homo sapiens
RQNFHMEQLKYAELRA

SEQ ID NO: 1490 - protein, 16 aa, Homo sapiens
RQNFHMEQLKYAELRA

SEQ ID NO: 1491 - protein, 16 aa, Homo sapiens
RQNFHMEQLKYAELRA

SEQ ID NO: 1492 - protein, 19 aa, Homo sapiens
KTHKLQDPHEREFVICDKY

SEQ ID NO: 1493 - protein, 16 aa, Homo sapiens
RQNFHMEQLKYAELRA

SEQ ID NO: 1494 - protein, 19 aa, Homo sapiens
KTHKLQDPHEREFVICDKY

SEQ ID NO: 1495 - protein, 16 aa, Homo sapiens
RQNFHMEQLKYAELRA

SEQ ID NO: 1496 - protein, 16 aa, Homo sapiens
RQNFHMEQLKYAELRA

SEQ ID NO: 1497 - protein, 19 aa, Homo sapiens
KTHKLQDPHEREFVICDKY

SEQ ID NO: 1498 - protein, 19 aa, Homo sapiens
KTHKLQDPHEREFVICDKY

SEQ ID NO: 1499 - protein, 16 aa, Homo sapiens
RQNFHMEQLKYAELRA

SEQ ID NO: 1500 - protein, 16 aa, Homo sapiens
RQNFHMEQLKYAELRA

SEQ ID NO: 1501 - protein, 16 aa, Homo sapiens
RQNFHMEQLKYAELRA

SEQ ID NO: 1502 - protein, 16 aa, Homo sapiens
RQNFHMEQLKYAELRA

SEQ ID NO: 1503 - protein, 16 aa, Homo sapiens
RQNFHMEQLKYAELRA

SEQ ID NO: 1504 - protein, 16 aa, Homo sapiens
RQNFHMEQLKYAELRA

SEQ ID NO: 1505 - protein, 16 aa, Homo sapiens
RQNFHMEQLKYAELRA

SEQ ID NO: 1506 - protein, 16 aa, Homo sapiens
RQNFHMEQLKYAELRA

SEQ ID NO: 1507 - protein, 16 aa, Homo sapiens
RQNFHMEQLKYAELRA

SEQ ID NO: 1508 - protein, 16 aa, Homo sapiens
RQNFHMEQLKYAELRA

SEQ ID NO: 1509 - protein, 16 aa, Homo sapiens
RQNFHMEQLKYAELRA

SEQ ID NO: 1510 - protein, 21 aa, Homo sapiens
RKRPAPQQIQQVQQQAVQNRN

SEQ ID NO: 1511 - protein, 21 aa, Homo sapiens
RKRPAPQQIQQVQQQAVQNRN

SEQ ID NO: 1512 - protein, 14 aa, Homo sapiens
KTLAKSKGASAGRE

SEQ ID NO: 1513 - protein, 20 aa, Homo sapiens
RSPQVPAAQQMLNFPEKNKE

SEQ ID NO: 1514 - protein, 13 aa, Homo sapiens
RHQGTFTDEKSKA

SEQ ID NO: 1515 - protein, 17 aa, Homo sapiens
KMKEEVPTALVEAHVRK

SEQ ID NO: 1516 - protein, 13 aa, Homo sapiens
RKVEEAAKVTGKA

SEQ ID NO: 1517 - protein, 17 aa, Homo sapiens
RVASAAAKAALEEFSRV

SEQ ID NO: 1518 - protein, 17 aa, Homo sapiens
RVASAAAKAALEEFSRV

SEQ ID NO: 1519 - protein, 17 aa, Homo sapiens
RVASAAAKAALEEFSRV

SEQ ID NO: 1520 - protein, 17 aa, Homo sapiens
RVASAAAKAALEEFSRV

SEQ ID NO: 1521 - protein, 17 aa, Homo sapiens
RVASAAAKAALEEFSRV

SEQ ID NO: 1522 - protein, 17 aa, Homo sapiens
RVASAAAKAALEEFSRV

SEQ ID NO: 1523 - protein, 17 aa, Homo sapiens
RVASAAAKAALEEFSRV

SEQ ID NO: 1524 - protein, 25 aa, Homo sapiens
KSALEEFSKMKEEVPTALVEAHVRK

SEQ ID NO: 1525 - protein, 25 aa, Homo sapiens
KSALEEFSKMKEEVPTALVEAHVRK

SEQ ID NO: 1526 - protein, 33 aa, Homo sapiens
RDIGEGNLSTAAAAALAAAAVKAKHLAAVEERK

SEQ ID NO: 1527 - protein, 25 aa, Homo sapiens
KSALEEFSKMKEEVPTALVEAHVRK

SEQ ID NO: 1528 - protein, 25 aa, Homo sapiens
KSALEEFSKMKEEVPTALVEAHVRK

SEQ ID NO: 1529 - protein, 25 aa, Homo sapiens
KSALEEFSKMKEEVPTALVEAHVRK

SEQ ID NO: 1530 - protein, 25 aa, Homo sapiens
KSALEEFSKMKEEVPTALVEAHVRK

SEQ ID NO: 1531 - protein, 25 aa, Homo sapiens
KSALEEFSKMKEEVPTALVEAHVRK

SEQ ID NO: 1532 - protein, 25 aa, Homo sapiens
KSALEEFSKMKEEVPTALVEAHVRK

SEQ ID NO: 1533 - protein, 25 aa, Homo sapiens
KSALEEFSKMKEEVPTALVEAHVRK

SEQ ID NO: 1534 - protein, 25 aa, Homo sapiens
KSALEEFSKMKEEVPTALVEAHVRK

SEQ ID NO: 1535 - protein, 25 aa, Homo sapiens
KSALEEFSKMKEEVPTALVEAHVRK

SEQ ID NO: 1536 - protein, 25 aa, Homo sapiens
KSALEEFSKMKEEVPTALVEAHVRK

SEQ ID NO: 1537 - protein, 17 aa, Homo sapiens
RVASAAAKAALEEFSRV

SEQ ID NO: 1538 - protein, 9 aa, Homo sapiens
RTDMYTKKN

SEQ ID NO: 1539 - protein, 9 aa, Homo sapiens
KKVQEAARA

SEQ ID NO: 1540 - protein, 9 aa, Homo sapiens
KKVQEAARA

SEQ ID NO: 1541 - protein, 17 aa, Homo sapiens
RVASAAAKSALEEFSKM

SEQ ID NO: 1542 - protein, 24 aa, Homo sapiens
KAGGALCHILGAAYKYKNEQGWRR

SEQ ID NO: 1543 - protein, 20 aa, Homo sapiens
KISAKTLTDEVNSPDSDRRD

SEQ ID NO: 1544 - protein, 11 aa, Homo sapiens
RKKDGGPNVKY

SEQ ID NO: 1545 - protein, 22 aa, Homo sapiens
RHFEELETIMDREKEALEQQRQ

SEQ ID NO: 1546 - protein, 22 aa, Homo sapiens
RHFEELETIMDREKEALEQQRQ

SEQ ID NO: 1547 - protein, 22 aa, Homo sapiens
RHFEELETIMDREKEALEQQRQ

SEQ ID NO: 1548 - protein, 17 aa, Homo sapiens
RKFLESTDSFNNELKRL

SEQ ID NO: 1549 - protein, 22 aa, Homo sapiens
RHFEELETIMDREKEALEQQRQ

SEQ ID NO: 1550 - protein, 22 aa, Homo sapiens
RHFEELETIMDREKEALEQQRQ

SEQ ID NO: 1551 - protein, 22 aa, Homo sapiens
RHFEELETIMDREKEALEQQRQ

SEQ ID NO: 1552 - protein, 22 aa, Homo sapiens
RHFEELETIMDREKEALEQQRQ

SEQ ID NO: 1553 - protein, 22 aa, Homo sapiens
RHFEELETIMDREKEALEQQRQ

SEQ ID NO: 1554 - protein, 22 aa, Homo sapiens
RHFEELETIMDREKEALEQQRQ

SEQ ID NO: 1555 - protein, 22 aa, Homo sapiens
RHFEELETIMDREKEALEQQRQ

SEQ ID NO: 1556 - protein, 22 aa, Homo sapiens
RHFEELETIMDREKEALEQQRQ

SEQ ID NO: 1557 - protein, 22 aa, Homo sapiens
RHFEELETIMDREKEALEQQRQ

SEQ ID NO: 1558 - protein, 17 aa, Homo sapiens
RKFLESTDSFNNELKRL

SEQ ID NO: 1559 - protein, 22 aa, Homo sapiens
RHFEELETIMDREKEALEQQRQ

SEQ ID NO: 1560 - protein, 22 aa, Homo sapiens
RHFEELETIMDREKEALEQQRQ

SEQ ID NO: 1561 - protein, 22 aa, Homo sapiens
RHFEELETIMDREKEALEQQRQ

SEQ ID NO: 1562 - protein, 22 aa, Homo sapiens
RHFEELETIMDREKEALEQQRQ

SEQ ID NO: 1563 - protein, 22 aa, Homo sapiens
RHFEELETIMDREKEALEQQRQ

SEQ ID NO: 1564 - protein, 22 aa, Homo sapiens
RHFEELETIMDREKEALEQQRQ

SEQ ID NO: 1565 - protein, 22 aa, Homo sapiens
RHFEELETIMDREKEALEQQRQ

SEQ ID NO: 1566 - protein, 22 aa, Homo sapiens
RHFEELETIMDREKEALEQQRQ

SEQ ID NO: 1567 - protein, 27 aa, Homo sapiens
RLCGLKVEVDMEKIAAEIAQAEEQARK

SEQ ID NO: 1568 - protein, 22 aa, Homo sapiens
KVEVDMEKIAAEIAQAEEQARK

SEQ ID NO: 1569 - protein, 27 aa, Homo sapiens
RLCGLKVEVDMEKIAAEIAQAEEQARK

SEQ ID NO: 1570 - protein, 9 aa, Homo sapiens
KKVQEAARA

SEQ ID NO: 1571 - protein, 9 aa, Homo sapiens
KKVQEAARA

SEQ ID NO: 1572 - protein, 9 aa, Homo sapiens
KKVQEAARA

SEQ ID NO: 1573 - protein, 18 aa, Homo sapiens
RVREEVPLELVEAHVKKV

SEQ ID NO: 1574 - protein, 18 aa, Homo sapiens
RVREEVPLELVEAHVKKV

SEQ ID NO: 1575 - protein, 18 aa, Homo sapiens
KRKHSPSPPPPTPTESRK

SEQ ID NO: 1576 - protein, 29 aa, Homo sapiens
KKVEHEISEGNVATAAAAALASAATKAKH

SEQ ID NO: 1577 - protein, 28 aa, Homo sapiens
KVEHEISEGNVATAAAAALASAATKAKH

SEQ ID NO: 1578 - protein, 28 aa, Homo sapiens
KVEHEISEGNVATAAAAALASAATKAKH

SEQ ID NO: 1579 - protein, 28 aa, Homo sapiens
KVEHEISEGNVATAAAAALASAATKAKH

SEQ ID NO: 1580 - protein, 29 aa, Homo sapiens
KKVEHEISEGNVATAAAAALASAATKAKH

SEQ ID NO: 1581 - protein, 29 aa, Homo sapiens
KKVEHEISEGNVATAAAAALASAATKAKH

SEQ ID NO: 1582 - protein, 29 aa, Homo sapiens
KKVEHEISEGNVATAAAAALASAATKAKH

SEQ ID NO: 1583 - protein, 29 aa, Homo sapiens
KKVEHEISEGNVATAAAAALASAATKAKH

SEQ ID NO: 1584 - protein, 28 aa, Homo sapiens
KVEHEISEGNVATAAAAALASAATKAKH

SEQ ID NO: 1585 - protein, 28 aa, Homo sapiens
KVEHEISEGNVATAAAAALASAATKAKH

SEQ ID NO: 1586 - protein, 14 aa, Homo sapiens
KPYACDICGKRYKN

SEQ ID NO: 1587 - protein, 9 aa, Homo sapiens
RTDPLEKRG

SEQ ID NO: 1588 - protein, 10 aa, Homo sapiens
RSVTGKIQKL

SEQ ID NO: 1589 - protein, 10 aa, Homo sapiens
RSVTGKIQKL

SEQ ID NO: 1590 - protein, 10 aa, Homo sapiens
RSVTGKIQKL

SEQ ID NO: 1591 - protein, 10 aa, Homo sapiens
RSVTGKIQKL

SEQ ID NO: 1592 - protein, 19 aa, Homo sapiens
KIQKLTKAVATYHANTERE

SEQ ID NO: 1593 - protein, 19 aa, Homo sapiens
KIQKLTKAVATYHANTERE

SEQ ID NO: 1594 - protein, 9 aa, Homo sapiens
RAKDDIKRV

SEQ ID NO: 1595 - protein, 9 aa, Homo sapiens
RAKDDIKRV

SEQ ID NO: 1596 - protein, 12 aa, Homo sapiens
KVSYKGSPAARR

SEQ ID NO: 1597 - protein, 12 aa, Homo sapiens
KVSYKGSPAARR

SEQ ID NO: 1598 - protein, 12 aa, Homo sapiens
KVSYKGSPAARR

SEQ ID NO: 1599 - protein, 12 aa, Homo sapiens
KVSYKGSPAARR

SEQ ID NO: 1600 - protein, 12 aa, Homo sapiens
KVSYKGSPAARR

SEQ ID NO: 1601 - protein, 11 aa, Homo sapiens
RVMAAIEKVRK

SEQ ID NO: 1602 - protein, 12 aa, Homo sapiens
RITEKLEKQQKI

SEQ ID NO: 1603 - protein, 12 aa, Homo sapiens
KVSYKGSPAARR

SEQ ID NO: 1604 - protein, 12 aa, Homo sapiens
KVSYKGSPAARR

SEQ ID NO: 1605 - protein, 12 aa, Homo sapiens
KVSYKGSPAARR

SEQ ID NO: 1606 - protein, 9 aa, Homo sapiens
RAKDDIKRV

SEQ ID NO: 1607 - protein, 18 aa, Homo sapiens
RKRDSDAGSSTPTTSTRS

SEQ ID NO: 1608 - protein, 9 aa, Homo sapiens
RAKDDIKRV

SEQ ID NO: 1609 - protein, 9 aa, Homo sapiens
RAKDDIKRV

SEQ ID NO: 1610 - protein, 13 aa, Homo sapiens
RWKYMIVDEGHRM

SEQ ID NO: 1611 - protein, 13 aa, Homo sapiens
RWKYMIVDEGHRM

SEQ ID NO: 1612 - protein, 13 aa, Homo sapiens
RWKYMIVDEGHRM

SEQ ID NO: 1613 - protein, 13 aa, Homo sapiens
RWKYMIVDEGHRM

SEQ ID NO: 1614 - protein, 13 aa, Homo sapiens
RWKYMIVDEGHRM

SEQ ID NO: 1615 - protein, 9 aa, Homo sapiens
RAKDDIKRV

SEQ ID NO: 1616 - protein, 12 aa, Homo sapiens
KISYKGTPAMRR

SEQ ID NO: 1617 - protein, 8 aa, Homo sapiens
REQKAKRN

SEQ ID NO: 1618 - protein, 27 aa, Homo sapiens
RGQLSWHQKTYAFSENPLPTVEIAIRN

SEQ ID NO: 1619 - protein, 27 aa, Homo sapiens
RGQLSWHQKTYAFSENPLPTVEIAIRN

SEQ ID NO: 1620 - protein, 27 aa, Homo sapiens
RGQLSWHQKTYAFSENPLPTVEIAIRN

SEQ ID NO: 1621 - protein, 8 aa, Homo sapiens
REQKAKRN

SEQ ID NO: 1622 - protein, 17 aa, Homo sapiens
KYKAVSISTEPPTYLRE

SEQ ID NO: 1623 - protein, 31 aa, Homo sapiens; identical to SEQ ID NO: 768

SEQ ID NO: 1624 - protein, 17 aa, Homo sapiens
KYKAVSISTEPPTYLRE

SEQ ID NO: 1625 - protein, 31 aa, Homo sapiens; identical to SEQ ID NO: 768

SEQ ID NO: 1626 - protein, 18 aa, Homo sapiens
KASEVEEILDGNDEKYKA

SEQ ID NO: 1627 - protein, 18 aa, Homo sapiens
KASEVEEILDGNDEKYKA

SEQ ID NO: 1628 - protein, 11 aa, Homo sapiens
RVMAAIEKVRK

SEQ ID NO: 1629 - protein, 11 aa, Homo sapiens
RVMAAIEKVRK

SEQ ID NO: 1630 - protein, 13 aa, Homo sapiens
RIYKWVPVTEPKV

SEQ ID NO: 1631 - protein, 17 aa, Homo sapiens
KMKEEVPTALVEAHVRK

SEQ ID NO: 1632 - protein, 13 aa, Homo sapiens
RHQGTFTDEKSKA

SEQ ID NO: 1633 - protein, 13 aa, Homo sapiens
RHQGTFTDEKSKA

SEQ ID NO: 1634 - protein, 15 aa, Homo sapiens
RDTTLETALNSKAYK

SEQ ID NO: 1635 - protein, 10 aa, Homo sapiens
EARMTEKLEK

SEQ ID NO: 1636 - protein, 16 aa, Homo sapiens
KTACYDIDVEVDDPLK

SEQ ID NO: 1637 - protein, 15 aa, Homo sapiens
QKHQEYLNSILQHAK

SEQ ID NO: 1638 - protein, 15 aa, Homo sapiens
QKHQEYLNSILQHAK

SEQ ID NO: 1639 - protein, 15 aa, Homo sapiens
QKHQEYLNSILQHAK

SEQ ID NO: 1640 - protein, 16 aa, Homo sapiens
RQKHQEYLNSILQHAK

SEQ ID NO: 1641 - protein, 18 aa, Homo sapiens
QKHQEYLNSILQHAKDFK

SEQ ID NO: 1642 - protein, 15 aa, Homo sapiens
QKHQEYLNSILQHAK

SEQ ID NO: 1643 - protein, 18 aa, Homo sapiens
QKHQEYLNSILQHAKDFK

SEQ ID NO: 1644 - protein, 15 aa, Homo sapiens
QKHQEYLNSILQHAK

SEQ ID NO: 1645 - protein, 15 aa, Homo sapiens
QKHQEYLNSILQHAK

SEQ ID NO: 1646 - protein, 18 aa, Homo sapiens
QKHQEYLNSILQHAKDFK

SEQ ID NO: 1647 - protein, 11 aa, Homo sapiens
KELPEYYELIR

SEQ ID NO: 1648 - protein, 11 aa, Homo sapiens
KELPEYYELIR

SEQ ID NO: 1649 - protein, 9 aa, Homo sapiens
DRKASANAR

SEQ ID NO: 1650 - protein, 11 aa, Homo sapiens
HQGTFTDEKSK

SEQ ID NO: 1651 - protein, 29 aa, Homo sapiens
WILDTDIFNEWMNEEDYEVDENRKPVSFR

SEQ ID NO: 1652 - protein, 8 aa, Homo sapiens
KPVSFRQR

SEQ ID NO: 1653 - protein, 7 aa, Homo sapiens
IRNHKYR

SEQ ID NO: 1654 - protein, 9 aa, Homo sapiens
DRKASANAR

SEQ ID NO: 1655 - protein, 7 aa, Homo sapiens
KVQEAAR

SEQ ID NO: 1656 - protein, 9 aa, Homo sapiens
DRKASANAR

SEQ ID NO: 1657 - protein, 20 aa, Homo sapiens
SPQVPAAQQMLNFPEKNKEK

SEQ ID NO: 1658 - protein, 20 aa, Homo sapiens
SPQVPAAQQMLNFPEKNKEK

SEQ ID NO: 1659 - protein, 20 aa, Homo sapiens
LMEEDELPSWIIKDDAEVER

SEQ ID NO: 1660 - protein, 8 aa, Homo sapiens
TKATVELK

SEQ ID NO: 1661 - protein, 8 aa, Homo sapiens
TKATVELK

SEQ ID NO: 1662 - protein, 15 aa, Homo sapiens
DTTLETALNSKAYKR

SEQ ID NO: 1663 - protein, 15 aa, Homo sapiens
MKEEVPTALVEAHVR

SEQ ID NO: 1664 - protein, 15 aa, Homo sapiens
QKHQEYLNSILQHAK

SEQ ID NO: 1665 - protein, 14 aa, Homo sapiens
NVPSKSKAAASATR

SEQ ID NO: 1666 - protein, 14 aa, Homo sapiens
NVPSKSKAAASATR

SEQ ID NO: 1667 - protein, 14 aa, Homo sapiens
NVPSKSKAAASATR

SEQ ID NO: 1668 - protein, 14 aa, Homo sapiens
NVPSKSKAAASATR

SEQ ID NO: 1669 - protein, 24 aa, Homo sapiens
LQDSHDKEYINGDKYFQQIFDCPR

SEQ ID NO: 1670 - protein, 24 aa, Homo sapiens
LQDSHDKEYINGDKYFQQIFDCPR

SEQ ID NO: 1671 - protein, 24 aa, Homo sapiens
LQDSHDKEYINGDKYFQQIFDCPR

SEQ ID NO: 1672 - protein, 31 aa, Homo sapiens
EWTEQETLLLLEALEMYKDDWNKVSEHVGSR

SEQ ID NO: 1673 - protein, 31 aa, Homo sapiens; identical to SEQ ID NO: 1672

SEQ ID NO: 1674 - protein, 31 aa, Homo sapiens; identical to SEQ ID NO: 1672

SEQ ID NO: 1675 - protein, 31 aa, Homo sapiens; identical to SEQ ID NO: 1672

SEQ ID NO: 1676 - protein, 31 aa, Homo sapiens; identical to SEQ ID NO: 1672

SEQ ID NO: 1677 - protein, 31 aa, Homo sapiens; identical to SEQ ID NO: 1672

SEQ ID NO: 1678 - protein, 14 aa, Homo sapiens
KLRIYISNTFSPSK

SEQ ID NO: 1679 - protein, 9 aa, Homo sapiens
HIFAKVQQR

SEQ ID NO: 1680 - protein, 9 aa, Homo sapiens
MADKVLPQR

SEQ ID NO: 1681 - protein, 10 aa, Homo sapiens
KMADKVLPQR

SEQ ID NO: 1682 - protein, 10 aa, Homo sapiens
KMADKVLPQR

SEQ ID NO: 1683 - protein, 10 aa, Homo sapiens
KMADKVLPQR

SEQ ID NO: 1684 - protein, 10 aa, Homo sapiens
KMADKVLPQR

SEQ ID NO: 1685 - protein, 9 aa, Homo sapiens
MADKVLPQR

SEQ ID NO: 1686 - protein, 15 aa, Homo sapiens
MKEEVPTALVEAHVR

SEQ ID NO: 1687 - protein, 12 aa, Homo sapiens
KLEAELLQIEER

SEQ ID NO: 1688 - protein, 12 aa, Homo sapiens
KLEAELLQIEER

SEQ ID NO: 1689 - protein, 13 aa, Homo sapiens
SLVALLVETQMKK

SEQ ID NO: 1690 - protein, 13 aa, Homo sapiens
SLVALLVETQMKK

SEQ ID NO: 1691 - protein, 12 aa, Homo sapiens
KLEAELLQIEER

SEQ ID NO: 1692 - protein, 13 aa, Homo sapiens
SLVALLVETQMKK

SEQ ID NO: 1693 - protein, 13 aa, Homo sapiens
SLVALLVETQMKK

SEQ ID NO: 1694 - protein, 12 aa, Homo sapiens
KLEAELLQIEER

SEQ ID NO: 1695 - protein, 12 aa, Homo sapiens
KLEAELLQIEER

SEQ ID NO: 1696 - protein, 12 aa, Homo sapiens
KLEAELLQIEER

SEQ ID NO: 1697 - protein, 12 aa, Homo sapiens
KLEAELLQIEER

SEQ ID NO: 1698 - protein, 12 aa, Homo sapiens
KLEAELLQIEER

SEQ ID NO: 1699 - protein, 16 aa, Homo sapiens
KLEAELLQIEERHQEK

SEQ ID NO: 1700 - protein, 12 aa, Homo sapiens
KLEAELLQIEER

SEQ ID NO: 1701 - protein, 12 aa, Homo sapiens
KLEAELLQIEER

SEQ ID NO: 1702 - protein, 12 aa, Homo sapiens
KLEAELLQIEER

SEQ ID NO: 1703 - protein, 12 aa, Homo sapiens
KLEAELLQIEER

SEQ ID NO: 1704 - protein, 12 aa, Homo sapiens
KLEAELLQIEER

SEQ ID NO: 1705 - protein, 15 aa, Homo sapiens
KIKSLVALLVETQMK

SEQ ID NO: 1706 - protein, 15 aa, Homo sapiens
KIKSLVALLVETQMK

SEQ ID NO: 1707 - protein, 15 aa, Homo sapiens
KIKSLVALLVETQMK

SEQ ID NO: 1708 - protein, 15 aa, Homo sapiens
KIKSLVALLVETQMK

SEQ ID NO: 1709 - protein, 15 aa, Homo sapiens
KIKSLVALLVETQMK

SEQ ID NO: 1710 - protein, 15 aa, Homo sapiens
KIKSLVALLVETQMK

SEQ ID NO: 1711 - protein, 10 aa, Homo sapiens
AKHLAAVEER

SEQ ID NO: 1712 - protein, 10 aa, Homo sapiens
AKHLAAVEER

SEQ ID NO: 1713 - protein, 6 aa, Homo sapiens
MQVLKR

SEQ ID NO: 1714 - protein, 23 aa, Homo sapiens
DIGEGNLSTAAAAALAAAAVKAK

SEQ ID NO: 1715 - protein, 23 aa, Homo sapiens
DIGEGNLSTAAAAALAAAAVKAK

SEQ ID NO: 1716 - protein, 23 aa, Homo sapiens
DIGEGNLSTAAAAALAAAAVKAK

SEQ ID NO: 1717 - protein, 23 aa, Homo sapiens
DIGEGNLSTAAAAALAAAAVKAK

SEQ ID NO: 1718 - protein, 23 aa, Homo sapiens
DIGEGNLSTAAAAALAAAAVKAK

SEQ ID NO: 1719 - protein, 23 aa, Homo sapiens
DIGEGNLSTAAAAALAAAAVKAK

SEQ ID NO: 1720 - protein, 23 aa, Homo sapiens
DIGEGNLSTAAAAALAAAAVKAK

SEQ ID NO: 1721 - protein, 23 aa, Homo sapiens
DIGEGNLSTAAAAALAAAAVKAK

SEQ ID NO: 1722 - protein, 23 aa, Homo sapiens
DIGEGNLSTAAAAALAAAAVKAK

SEQ ID NO: 1723 - protein, 23 aa, Homo sapiens
DIGEGNLSTAAAAALAAAAVKAK

SEQ ID NO: 1724 - protein, 7 aa, Homo sapiens
KLEIKLR

SEQ ID NO: 1725 - protein, 7 aa, Homo sapiens
KLEIKLR

SEQ ID NO: 1726 - protein, 6 aa, Homo sapiens
HQEKKR

SEQ ID NO: 1727 - protein, 6 aa, Homo sapiens
HQEKKR

SEQ ID NO: 1728 - protein, 6 aa, Homo sapiens
HQEKKR

SEQ ID NO: 1729 - protein, 12 aa, Homo sapiens
KLEAELLQIEER

SEQ ID NO: 1730 - protein, 20 aa, Homo sapiens
ASNPDLKLWEIGKIIGGMWR

SEQ ID NO: 1731 - protein, 19 aa, Homo sapiens
KRPAPQQIQQVQQQAVQNR

SEQ ID NO: 1732 - protein, 13 aa, Homo sapiens
SLVALLVETQMKK

SEQ ID NO: 1733 - protein, 13 aa, Homo sapiens
SLVALLVETQMKK

SEQ ID NO: 1734 - protein, 19 aa, Homo sapiens
KRPAPQQIQQVQQQAVQNR

SEQ ID NO: 1735 - protein, 14 aa, Homo sapiens
QAFHMEQLKYAEMR

SEQ ID NO: 1736 - protein, 14 aa, Homo sapiens
QAFHMEQLKYAEMR

SEQ ID NO: 1737 - protein, 14 aa, Homo sapiens
QAFHMEQLKYAEMR

SEQ ID NO: 1738 - protein, 14 aa, Homo sapiens
QAFHMEQLKYAEMR

SEQ ID NO: 1739 - protein, 14 aa, Homo sapiens
QAFHMEQLKYAEMR

SEQ ID NO: 1740 - protein, 14 aa, Homo sapiens
QAFHMEQLKYAEMR

SEQ ID NO: 1741 - protein, 17 aa, Homo sapiens
EFVICDKYLQQIFESQR

SEQ ID NO: 1742 - protein, 9 aa, Homo sapiens
MADKILPQR

SEQ ID NO: 1743 - protein, 14 aa, Homo sapiens
LLEDSALSKYDATK

SEQ ID NO: 1744 - protein, 14 aa, Homo sapiens
LLEDSALSKYDATK

SEQ ID NO: 1745 - protein, 15 aa, Homo sapiens
KFLESTDSFNNELKR

SEQ ID NO: 1746 - protein, 15 aa, Homo sapiens
KFLESTDSFNNELKR

SEQ ID NO: 1747 - protein, 15 aa, Homo sapiens
KFLESTDSFNNELKR

SEQ ID NO: 1748 - protein, 15 aa, Homo sapiens
KFLESTDSFNNELKR

SEQ ID NO: 1749 - protein, 15 aa, Homo sapiens
KFLESTDSFNNELKR

SEQ ID NO: 1750 - protein, 15 aa, Homo sapiens
KFLESTDSFNNELKR

SEQ ID NO: 1751 - protein, 15 aa, Homo sapiens
KFLESTDSFNNELKR

SEQ ID NO: 1752 - protein, 15 aa, Homo sapiens
KFLESTDSFNNELKR

SEQ ID NO: 1753 - protein, 15 aa, Homo sapiens
KFLESTDSFNNELKR

SEQ ID NO: 1754 - protein, 26 aa, Homo sapiens
MEKGEPYMSIQPAEDPDDYDDGFSMK

SEQ ID NO: 1755 - protein, 26 aa, Homo sapiens
MEKGEPYMSIQPAEDPDDYDDGFSMK

SEQ ID NO: 1756 - protein, 26 aa, Homo sapiens
MEKGEPYMSIQPAEDPDDYDDGFSMK

SEQ ID NO: 1757 - protein, 26 aa, Homo sapiens
MEKGEPYMSIQPAEDPDDYDDGFSMK

SEQ ID NO: 1758 - protein, 26 aa, Homo sapiens
MEKGEPYMSIQPAEDPDDYDDGFSMK

SEQ ID NO: 1759 - protein, 26 aa, Homo sapiens
MEKGEPYMSIQPAEDPDDYDDGFSMK

SEQ ID NO: 1760 - protein, 19 aa, Homo sapiens
KRPAPQQIQQVQQQAVQNR

SEQ ID NO: 1761 - protein, 19 aa, Homo sapiens
KRPAPQQIQQVQQQAVQNR

SEQ ID NO: 1762 - protein, 19 aa, Homo sapiens
KRPAPQQIQQVQQQAVQNR

SEQ ID NO: 1763 - protein, 19 aa, Homo sapiens
KRPAPQQIQQVQQQAVQNR

SEQ ID NO: 1764 - protein, 19 aa, Homo sapiens
KRPAPQQIQQVQQQAVQNR

SEQ ID NO: 1765 - protein, 19 aa, Homo sapiens
KRPAPQQIQQVQQQAVQNR

SEQ ID NO: 1766 - protein, 19 aa, Homo sapiens
KRPAPQQIQQVQQQAVQNR

SEQ ID NO: 1767 - protein, 19 aa, Homo sapiens
KRPAPQQIQQVQQQAVQNR

SEQ ID NO: 1768 - protein, 19 aa, Homo sapiens
KRPAPQQIQQVQQQAVQNR

SEQ ID NO: 1769 - protein, 19 aa, Homo sapiens
KRPAPQQIQQVQQQAVQNR

SEQ ID NO: 1770 - protein, 14 aa, Homo sapiens
FLESTDSFNNELKR

SEQ ID NO: 1771 - protein, 14 aa, Homo sapiens
FLESTDSFNNELKR

SEQ ID NO: 1772 - protein, 22 aa, Homo sapiens
SSEAIKESSKFPFGISPAQSHR

SEQ ID NO: 1773 - protein, 22 aa, Homo sapiens
SSEAIKESSKFPFGISPAQSHR

SEQ ID NO: 1774 - protein, 15 aa, Homo sapiens
KFLESTDSFNNELKR

SEQ ID NO: 1775 - protein, 15 aa, Homo sapiens
KFLESTDSFNNELKR

SEQ ID NO: 1776 - protein, 19 aa, Homo sapiens
DITFPPGSVEATQPVLKQR

SEQ ID NO: 1777 - protein, 27 aa, Homo sapiens
KHVTTAEGTPGTTDQEGPPPDGPPEKR

SEQ ID NO: 1778 - protein, 27 aa, Homo sapiens
KHVTTAEGTPGTTDQEGPPPDGPPEKR

SEQ ID NO: 1779 - protein, 26 aa, Homo sapiens
MEKGEPYMSIQPAEDPDDYDDGFSMK

SEQ ID NO: 1780 - protein, 26 aa, Homo sapiens
MEKGEPYMSIQPAEDPDDYDDGFSMK

SEQ ID NO: 1781 - protein, 17 aa, Homo sapiens
AYHNSPAYLAYINAKSR

SEQ ID NO: 1782 - protein, 17 aa, Homo sapiens
AYHNSPAYLAYINAKSR

SEQ ID NO: 1783 - protein, 17 aa, Homo sapiens
AYHNSPAYLAYINAKSR

SEQ ID NO: 1784 - protein, 17 aa, Homo sapiens
AYHNSPAYLAYINAKSR

SEQ ID NO: 1785 - protein, 17 aa, Homo sapiens
AYHNSPAYLAYINAKSR

SEQ ID NO: 1786 - protein, 17 aa, Homo sapiens
AYHNSPAYLAYINAKSR

SEQ ID NO: 1787 - protein, 17 aa, Homo sapiens
AYHNSPAYLAYINAKSR

SEQ ID NO: 1788 - protein, 17 aa, Homo sapiens
AYHNSPAYLAYINAKSR

SEQ ID NO: 1789 - protein, 17 aa, Homo sapiens
AYHNSPAYLAYINAKSR

SEQ ID NO: 1790 - protein, 17 aa, Homo sapiens
AYHNSPAYLAYINAKSR

SEQ ID NO: 1791 - protein, 17 aa, Homo sapiens
AYHNSPAYLAYINAKSR

SEQ ID NO: 1792 - protein, 17 aa, Homo sapiens
AYHNSPAYLAYINAKSR

SEQ ID NO: 1793 - protein, 17 aa, Homo sapiens
AYHNSPAYLAYINAKSR

SEQ ID NO: 1794 - protein, 17 aa, Homo sapiens
AYHNSPAYLAYINAKSR

SEQ ID NO: 1795 - protein, 17 aa, Homo sapiens
AYHNSPAYLAYINAKSR

SEQ ID NO: 1796 - protein, 17 aa, Homo sapiens
AYHNSPAYLAYINAKSR

SEQ ID NO: 1797 - protein, 17 aa, Homo sapiens
AYHNSPAYLAYINAKSR

SEQ ID NO: 1798 - protein, 17 aa, Homo sapiens
AYHNSPAYLAYINAKSR

SEQ ID NO: 1799 - protein, 17 aa, Homo sapiens
AYHNSPAYLAYINAKSR

SEQ ID NO: 1800 - protein, 17 aa, Homo sapiens
AYHNSPAYLAYINAKSR

SEQ ID NO: 1801 - protein, 17 aa, Homo sapiens
AYHNSPAYLAYINAKSR

SEQ ID NO: 1802 - protein, 17 aa, Homo sapiens
AYHNSPAYLAYINAKSR

SEQ ID NO: 1803 - protein, 17 aa, Homo sapiens
AYHNSPAYLAYINAKSR

SEQ ID NO: 1804 - protein, 16 aa, Homo sapiens
ESSKFPFGISPAQSHR

SEQ ID NO: 1805 - protein, 22 aa, Homo sapiens
SSEAIKESSKFPFGISPAQSHR

SEQ ID NO: 1806 - protein, 22 aa, Homo sapiens
SSEAIKESSKFPFGISPAQSHR

SEQ ID NO: 1807 - protein, 26 aa, Homo sapiens
MEKGEPYMSIQPAEDPDDYDDGFSMK

SEQ ID NO: 1808 - protein, 17 aa, Homo sapiens
AYHNSPAYLAYINAKSR

SEQ ID NO: 1809 - protein, 17 aa, Homo sapiens
AYHNSPAYLAYINAKSR

SEQ ID NO: 1810 - protein, 17 aa, Homo sapiens
AYHNSPAYLAYINAKSR

SEQ ID NO: 1811 - protein, 7 aa, Homo sapiens
KVWDQVK

SEQ ID NO: 1812 - protein, 29 aa, Homo sapiens
NIKILEDEPHSKDETPLCTLLDWQDSLAK

SEQ ID NO: 1813 - protein, 29 aa, Homo sapiens
NIKILEDEPHSKDETPLCTLLDWQDSLAK

SEQ ID NO: 1814 - protein, 29 aa, Homo sapiens
NIKILEDEPHSKDETPLCTLLDWQDSLAK

SEQ ID NO: 1815 - protein, 29 aa, Homo sapiens
NIKILEDEPHSKDETPLCTLLDWQDSLAK

SEQ ID NO: 1816 - protein, 29 aa, Homo sapiens
NIKILEDEPHSKDETPLCTLLDWQDSLAK

SEQ ID NO: 1817 - protein, 19 aa, Homo sapiens
KRPAPQQIQQVQQQAVQNR

SEQ ID NO: 1818 - protein, 19 aa, Homo sapiens
KRPAPQQIQQVQQQAVQNR

SEQ ID NO: 1819 - protein, 19 aa, Homo sapiens
KRPAPQQIQQVQQQAVQNR

SEQ ID NO: 1820 - protein, 19 aa, Homo sapiens
KRPAPQQIQQVQQQAVQNR

SEQ ID NO: 1821 - protein, 19 aa, Homo sapiens
KRPAPQQIQQVQQQAVQNR

SEQ ID NO: 1822 - protein, 19 aa, Homo sapiens
KRPAPQQIQQVQQQAVQNR

SEQ ID NO: 1823 - protein, 19 aa, Homo sapiens
KRPAPQQIQQVQQQAVQNR

SEQ ID NO: 1824 - protein, 19 aa, Homo sapiens
KRPAPQQIQQVQQQAVQNR

SEQ ID NO: 1825 - protein, 19 aa, Homo sapiens
KRPAPQQIQQVQQQAVQNR

SEQ ID NO: 1826 - protein, 10 aa, Homo sapiens
LEKLYSTMVR

SEQ ID NO: 1827 - protein, 10 aa, Homo sapiens
LEKLYSTMVR

SEQ ID NO: 1828 - protein, 10 aa, Homo sapiens
LEKLYSTMVR

SEQ ID NO: 1829 - protein, 10 aa, Homo sapiens
LEKLYSTMVR

SEQ ID NO: 1830 - protein, 10 aa, Homo sapiens
LEKLYSTMVR

SEQ ID NO: 1831 - protein, 10 aa, Homo sapiens
LEKLYSTMVR

SEQ ID NO: 1832 - protein, 10 aa, Homo sapiens
LEKLYSTMVR

SEQ ID NO: 1833 - protein, 10 aa, Homo sapiens
LEKLYSTMVR

SEQ ID NO: 1834 - protein, 10 aa, Homo sapiens
LEKLYSTMVR

SEQ ID NO: 1835 - protein, 10 aa, Homo sapiens
LEKLYSTMVR

SEQ ID NO: 1836 - protein, 10 aa, Homo sapiens
LEKLYSTMVR

SEQ ID NO: 1837 - protein, 10 aa, Homo sapiens
LEKLYSTMVR

SEQ ID NO: 1838 - protein, 10 aa, Homo sapiens
LEKLYSTMVR

SEQ ID NO: 1839 - protein, 10 aa, Homo sapiens
LEKLYSTMVR

SEQ ID NO: 1840 - protein, 10 aa, Homo sapiens
LEKLYSTMVR

SEQ ID NO: 1841 - protein, 10 aa, Homo sapiens
LEKLYSTMVR

SEQ ID NO: 1842 - protein, 25 aa, Homo sapiens
KAPGSDPFMSSGQGPNGGMGDPYSR

SEQ ID NO: 1843 - protein, 25 aa, Homo sapiens
KAPGSDPFMSSGQGPNGGMGDPYSR

SEQ ID NO: 1844 - protein, 19 aa, Homo sapiens
KRPAPQQIQQVQQQAVQNR

SEQ ID NO: 1845 - protein, 19 aa, Homo sapiens
KRPAPQQIQQVQQQAVQNR

SEQ ID NO: 1846 - protein, 19 aa, Homo sapiens
KRPAPQQIQQVQQQAVQNR

SEQ ID NO: 1847 - protein, 19 aa, Homo sapiens
KRPAPQQIQQVQQQAVQNR

SEQ ID NO: 1848 - protein, 19 aa, Homo sapiens
KRPAPQQIQQVQQQAVQNR

SEQ ID NO: 1849 - protein, 19 aa, Homo sapiens
KRPAPQQIQQVQQQAVQNR

SEQ ID NO: 1850 - protein, 19 aa, Homo sapiens
KRPAPQQIQQVQQQAVQNR

SEQ ID NO: 1851 - protein, 19 aa, Homo sapiens
KRPAPQQIQQVQQQAVQNR

SEQ ID NO: 1852 - protein, 19 aa, Homo sapiens
KRPAPQQIQQVQQQAVQNR

SEQ ID NO: 1853 - protein, 19 aa, Homo sapiens
KRPAPQQIQQVQQQAVQNR

SEQ ID NO: 1854 - protein, 16 aa, Homo sapiens
ESSKFPFGISPAQSHR

SEQ ID NO: 1855 - protein, 16 aa, Homo sapiens
ESSKFPFGISPAQSHR

SEQ ID NO: 1856 - protein, 19 aa, Homo sapiens
KRPAPQQIQQVQQQAVQNR

SEQ ID NO: 1857 - protein, 19 aa, Homo sapiens
KRPAPQQIQQVQQQAVQNR

SEQ ID NO: 1858 - protein, 19 aa, Homo sapiens
KRPAPQQIQQVQQQAVQNR

SEQ ID NO: 1859 - protein, 19 aa, Homo sapiens
KRPAPQQIQQVQQQAVQNR

SEQ ID NO: 1860 - protein, 19 aa, Homo sapiens
KRPAPQQIQQVQQQAVQNR

SEQ ID NO: 1861 - protein, 19 aa, Homo sapiens
KRPAPQQIQQVQQQAVQNR

SEQ ID NO: 1862 - protein, 19 aa, Homo sapiens
KRPAPQQIQQVQQQAVQNR

SEQ ID NO: 1863 - protein, 19 aa, Homo sapiens
KRPAPQQIQQVQQQAVQNR

SEQ ID NO: 1864 - protein, 19 aa, Homo sapiens
KRPAPQQIQQVQQQAVQNR

SEQ ID NO: 1865 - protein, 19 aa, Homo sapiens
KRPAPQQIQQVQQQAVQNR

SEQ ID NO: 1866 - protein, 19 aa, Homo sapiens
KRPAPQQIQQVQQQAVQNR

SEQ ID NO: 1867 - protein, 9 aa, Homo sapiens
MADKILPQR

SEQ ID NO: 1868 - protein, 10 aa, Homo sapiens
KMADKILPQR

SEQ ID NO: 1869 - protein, 7 aa, Homo sapiens
NHNAKKK

SEQ ID NO: 1870 - protein, 7 aa, Homo sapiens
NHNAKKK

SEQ ID NO: 1871 - protein, 7 aa, Homo sapiens
NHNAKKK

SEQ ID NO: 1872 - protein, 7 aa, Homo sapiens
NHNAKKK

SEQ ID NO: 1873 - protein, 7 aa, Homo sapiens
NHNAKKK

SEQ ID NO: 1874 - protein, 7 aa, Homo sapiens
NHNAKKK

SEQ ID NO: 1875 - protein, 6 aa, Homo sapiens
KNPVCR

SEQ ID NO: 1876 - protein, 11 aa, Homo sapiens
FLSDRKNPVCR

SEQ ID NO: 1877 - protein, 7 aa, Homo sapiens
NHNAKKK

SEQ ID NO: 1878 - protein, 6 aa, Homo sapiens
KNPVCR

SEQ ID NO: 1879 - protein, 7 aa, Homo sapiens
NHNAKKK

SEQ ID NO: 1880 - protein, 6 aa, Homo sapiens
KNPVCR

SEQ ID NO: 1881 - protein, 12 aa, Homo sapiens
LDIQEALKRPIK

SEQ ID NO: 1882 - protein, 12 aa, Homo sapiens
LDIQEALKRPIK

SEQ ID NO: 1883 - protein, 10 aa, Homo sapiens
RLDIQEALKR

SEQ ID NO: 1884 - protein, 12 aa, Homo sapiens
LDIQEALKRPIK

SEQ ID NO: 1885 - protein, 12 aa, Homo sapiens
LDIQEALKRPIK

SEQ ID NO: 1886 - protein, 12 aa, Homo sapiens
LDIQEALKRPIK

SEQ ID NO: 1887 - protein, 12 aa, Homo sapiens
LDIQEALKRPIK

SEQ ID NO: 1888 - protein, 21 aa, Homo sapiens
SNSVGIQDAFNDGSDSTFQKR

SEQ ID NO: 1889 - protein, 10 aa, Homo sapiens
AKHLAAVEER

SEQ ID NO: 1890 - protein, 32 aa, Homo sapiens
QAPLTYEKEEEQDQGVSCNKVEWWWDCLEMLR

SEQ ID NO: 1891 - protein, 10 aa, Homo sapiens
LPIKCFLDFK

SEQ ID NO: 1892 - protein, 10 aa, Homo sapiens
AKHLAAVEER

SEQ ID NO: 1893 - protein, 10 aa, Homo sapiens
AKHLAAVEER

SEQ ID NO: 1894 - protein, 6 aa, Homo sapiens
LEIKLR

SEQ ID NO: 1895 - protein, 7 aa, Homo sapiens
KLEIKLR

SEQ ID NO: 1896 - protein, 27 aa, Homo sapiens
KHVTTAEGTPGTTDQEGPPPDGPPEKR

SEQ ID NO: 1897 - protein, 27 aa, Homo sapiens
KHVTTAEGTPGTTDQEGPPPDGPPEKR

SEQ ID NO: 1898 - protein, 27 aa, Homo sapiens
KHVTTAEGTPGTTDQEGPPPDGPPEKR

SEQ ID NO: 1899 - protein, 27 aa, Homo sapiens
KHVTTAEGTPGTTDQEGPPPDGPPEKR

SEQ ID NO: 1900 - protein, 27 aa, Homo sapiens
KHVTTAEGTPGTTDQEGPPPDGPPEKR

SEQ ID NO: 1901 - protein, 27 aa, Homo sapiens
KHVTTAEGTPGTTDQEGPPPDGPPEKR

SEQ ID NO: 1902 - protein, 27 aa, Homo sapiens
KHVTTAEGTPGTTDQEGPPPDGPPEKR

SEQ ID NO: 1903 - protein, 27 aa, Homo sapiens
KHVTTAEGTPGTTDQEGPPPDGPPEKR

SEQ ID NO: 1904 - protein, 27 aa, Homo sapiens
KHVTTAEGTPGTTDQEGPPPDGPPEKR

SEQ ID NO: 1905 - protein, 27 aa, Homo sapiens
KHVTTAEGTPGTTDQEGPPPDGPPEKR

SEQ ID NO: 1906 - protein, 27 aa, Homo sapiens
KHVTTAEGTPGTTDQEGPPPDGPPEKR

SEQ ID NO: 1907 - protein, 27 aa, Homo sapiens
KHVTTAEGTPGTTDQEGPPPDGPPEKR

SEQ ID NO: 1908 - protein, 27 aa, Homo sapiens
KHVTTAEGTPGTTDQEGPPPDGPPEKR

SEQ ID NO: 1909 - protein, 26 aa, Homo sapiens
KHVTTAEGTPGTTDQEGPPPDGPPEK

SEQ ID NO: 1910 - protein, 27 aa, Homo sapiens
KHVTTAEGTPGTTDQEGPPPDGPPEKR

SEQ ID NO: 1911 - protein, 27 aa, Homo sapiens
KHVTTAEGTPGTTDQEGPPPDGPPEKR

SEQ ID NO: 1912 - protein, 27 aa, Homo sapiens
KHVTTAEGTPGTTDQEGPPPDGPPEKR

SEQ ID NO: 1913 - protein, 27 aa, Homo sapiens
KHVTTAEGTPGTTDQEGPPPDGPPEKR

SEQ ID NO: 1914 - protein, 27 aa, Homo sapiens
KHVTTAEGTPGTTDQEGPPPDGPPEKR

SEQ ID NO: 1915 - protein, 27 aa, Homo sapiens
KHVTTAEGTPGTTDQEGPPPDGPPEKR

SEQ ID NO: 1916 - protein, 27 aa, Homo sapiens
KHVTTAEGTPGTTDQEGPPPDGPPEKR

SEQ ID NO: 1917 - protein, 27 aa, Homo sapiens
KHVTTAEGTPGTTDQEGPPPDGPPEKR

SEQ ID NO: 1918 - protein, 27 aa, Homo sapiens
KHVTTAEGTPGTTDQEGPPPDGPPEKR

SEQ ID NO: 1919 - protein, 26 aa, Homo sapiens
KHVTTAEGTPGTTDQEGPPPDGPPEK

SEQ ID NO: 1920 - protein, 27 aa, Homo sapiens
KHVTTAEGTPGTTDQEGPPPDGPPEKR

SEQ ID NO: 1921 - protein, 27 aa, Homo sapiens
KHVTTAEGTPGTTDQEGPPPDGPPEKR

SEQ ID NO: 1922 - protein, 27 aa, Homo sapiens
KHVTTAEGTPGTTDQEGPPPDGPPEKR

SEQ ID NO: 1923 - protein, 27 aa, Homo sapiens
KHVTTAEGTPGTTDQEGPPPDGPPEKR

SEQ ID NO: 1924 - protein, 26 aa, Homo sapiens
KHVTTAEGTPGTTDQEGPPPDGPPEK

SEQ ID NO: 1925 - protein, 26 aa, Homo sapiens
KHVTTAEGTPGTTDQEGPPPDGPPEK

SEQ ID NO: 1926 - protein, 26 aa, Homo sapiens
KHVTTAEGTPGTTDQEGPPPDGPPEK

SEQ ID NO: 1927 - protein, 27 aa, Homo sapiens
KHVTTAEGTPGTTDQEGPPPDGPPEKR

SEQ ID NO: 1928 - protein, 27 aa, Homo sapiens
KHVTTAEGTPGTTDQEGPPPDGPPEKR

SEQ ID NO: 1929 - protein, 27 aa, Homo sapiens
KHVTTAEGTPGTTDQEGPPPDGPPEKR

SEQ ID NO: 1930 - protein, 27 aa, Homo sapiens
KHVTTAEGTPGTTDQEGPPPDGPPEKR

SEQ ID NO: 1931 - protein, 27 aa, Homo sapiens
KHVTTAEGTPGTTDQEGPPPDGPPEKR

SEQ ID NO: 1932 - protein, 27 aa, Homo sapiens
KHVTTAEGTPGTTDQEGPPPDGPPEKR

SEQ ID NO: 1933 - protein, 27 aa, Homo sapiens
KHVTTAEGTPGTTDQEGPPPDGPPEKR

SEQ ID NO: 1934 - protein, 27 aa, Homo sapiens
KHVTTAEGTPGTTDQEGPPPDGPPEKR

SEQ ID NO: 1935 - protein, 27 aa, Homo sapiens
KHVTTAEGTPGTTDQEGPPPDGPPEKR

SEQ ID NO: 1936 - protein, 27 aa, Homo sapiens
KHVTTAEGTPGTTDQEGPPPDGPPEKR

SEQ ID NO: 1937 - protein, 27 aa, Homo sapiens
KHVTTAEGTPGTTDQEGPPPDGPPEKR

SEQ ID NO: 1938 - protein, 27 aa, Homo sapiens
KHVTTAEGTPGTTDQEGPPPDGPPEKR

SEQ ID NO: 1939 - protein, 27 aa, Homo sapiens
KHVTTAEGTPGTTDQEGPPPDGPPEKR

SEQ ID NO: 1940 - protein, 27 aa, Homo sapiens
KHVTTAEGTPGTTDQEGPPPDGPPEKR

SEQ ID NO: 1941 - protein, 27 aa, Homo sapiens
KHVTTAEGTPGTTDQEGPPPDGPPEKR

SEQ ID NO: 1942 - protein, 24 aa, Homo sapiens
IGGGDTTEHIQTHFESKTELLPSR

SEQ ID NO: 1943 - protein, 34 aa, Homo sapiens
IGGGDTTEHIQTHFESKTELLPSRPHAPCPPAPR

SEQ ID NO: 1944 - protein, 34 aa, Homo sapiens; identical to SEQ ID NO: 1943

SEQ ID NO: 1945 - protein, 34 aa, Homo sapiens; identical to SEQ ID NO: 1943

SEQ ID NO: 1946 - protein, 34 aa, Homo sapiens; identical to SEQ ID NO: 1943

SEQ ID NO: 1947 - protein, 34 aa, Homo sapiens; identical to SEQ ID NO: 1943

SEQ ID NO: 1948 - protein, 34 aa, Homo sapiens; identical to SEQ ID NO: 1943

SEQ ID NO: 1949 - protein, 34 aa, Homo sapiens; identical to SEQ ID NO: 1943

SEQ ID NO: 1950 - protein, 34 aa, Homo sapiens; identical to SEQ ID NO: 1943

SEQ ID NO: 1951 - protein, 34 aa, Homo sapiens; identical to SEQ ID NO: 1943

SEQ ID NO: 1952 - protein, 34 aa, Homo sapiens; identical to SEQ ID NO: 1943

SEQ ID NO: 1953 - protein, 11 aa, Homo sapiens
DKPASENSEEK

SEQ ID NO: 1954 - protein, 6 aa, Homo sapiens
KNPVCR

SEQ ID NO: 1955 - protein, 12 aa, Homo sapiens
VDIQEALKRPMK

SEQ ID NO: 1956 - protein, 12 aa, Homo sapiens
VDIQEALKRPMK

SEQ ID NO: 1957 - protein, 9 aa, Homo sapiens
VDIQEALKR

SEQ ID NO: 1958 - protein, 12 aa, Homo sapiens
VDIQEALKRPMK

SEQ ID NO: 1959 - protein, 10 aa, Homo sapiens
RVDIQEALKR

SEQ ID NO: 1960 - protein, 12 aa, Homo sapiens
VDIQEALKRPMK

SEQ ID NO: 1961 - protein, 12 aa, Homo sapiens
VDIQEALKRPMK

SEQ ID NO: 1962 - protein, 12 aa, Homo sapiens
VDIQEALKRPMK

SEQ ID NO: 1963 - protein, 12 aa, Homo sapiens
VDIQEALKRPMK

SEQ ID NO: 1964 - protein, 12 aa, Homo sapiens
VDIQEALKRPMK

SEQ ID NO: 1965 - protein, 27 aa, Homo sapiens
ILEDEPHSKDETPLCTLLDWQDSLAKR

SEQ ID NO: 1966 - protein, 21 aa, Homo sapiens
ALLALAKVDENHSEFTLYESR

SEQ ID NO: 1967 - protein, 22 aa, Homo sapiens
SSEAIKESSKFPFGISPAQSHR

SEQ ID NO: 1968 - protein, 5 aa, Homo sapiens
NHKYR

SEQ ID NO: 1969 - protein, 8 aa, Homo sapiens
YKLNVDQK

SEQ ID NO: 1970 - protein, 16 aa, Homo sapiens
GQPLPDHLQMAVQGKR

SEQ ID NO: 1971 - protein, 16 aa, Homo sapiens
GQPLPDHLQMAVQGKR

SEQ ID NO: 1972 - protein, 10 aa, Homo sapiens
YNQMKGMGMR

SEQ ID NO: 1973 - protein, 16 aa, Homo sapiens
GQPLPDHLQMAVQGKR

SEQ ID NO: 1974 - protein, 10 aa, Homo sapiens
YNQMKGMGMR

SEQ ID NO: 1975 - protein, 10 aa, Homo sapiens
YNQMKGMGMR

SEQ ID NO: 1976 - protein, 10 aa, Homo sapiens
YNQMKGMGMR

SEQ ID NO: 1977 - protein, 10 aa, Homo sapiens
YNQMKGMGMR

SEQ ID NO: 1978 - protein, 27 aa, Homo sapiens
KHVTTAEGTPGTTDQEGPPPDGPPEKR

SEQ ID NO: 1979 - protein, 27 aa, Homo sapiens
KHVTTAEGTPGTTDQEGPPPDGPPEKR

SEQ ID NO: 1980 - protein, 27 aa, Homo sapiens
KHVTTAEGTPGTTDQEGPPPDGPPEKR

SEQ ID NO: 1981 - protein, 7 aa, Homo sapiens
KPLDLYR

SEQ ID NO: 1982 - protein, 27 aa, Homo sapiens
KHVTTAEGTPGTTDQEGPPPDGPPEKR

SEQ ID NO: 1983 - protein, 18 aa, Homo sapiens
IVQKNDPFVVDCSDKLGR

SEQ ID NO: 1984 - protein, 27 aa, Homo sapiens
KHVTTAEGTPGTTDQEGPPPDGPPEKR

SEQ ID NO: 1985 - protein, 27 aa, Homo sapiens
KHVTTAEGTPGTTDQEGPPPDGPPEKR

SEQ ID NO: 1986 - protein, 27 aa, Homo sapiens
KHVTTAEGTPGTTDQEGPPPDGPPEKR

SEQ ID NO: 1987 - protein, 27 aa, Homo sapiens
KHVTTAEGTPGTTDQEGPPPDGPPEKR

SEQ ID NO: 1988 - protein, 27 aa, Homo sapiens
KHVTTAEGTPGTTDQEGPPPDGPPEKR

SEQ ID NO: 1989 - protein, 27 aa, Homo sapiens
KHVTTAEGTPGTTDQEGPPPDGPPEKR

SEQ ID NO: 1990 - protein, 27 aa, Homo sapiens
KHVTTAEGTPGTTDQEGPPPDGPPEKR

SEQ ID NO: 1991 - protein, 27 aa, Homo sapiens
KHVTTAEGTPGTTDQEGPPPDGPPEKR

SEQ ID NO: 1992 - protein, 27 aa, Homo sapiens
KHVTTAEGTPGTTDQEGPPPDGPPEKR

SEQ ID NO: 1993 - protein, 27 aa, Homo sapiens
KHVTTAEGTPGTTDQEGPPPDGPPEKR

SEQ ID NO: 1994 - protein, 27 aa, Homo sapiens
KHVTTAEGTPGTTDQEGPPPDGPPEKR

SEQ ID NO: 1995 - protein, 27 aa, Homo sapiens
KHVTTAEGTPGTTDQEGPPPDGPPEKR

SEQ ID NO: 1996 - protein, 27 aa, Homo sapiens
KHVTTAEGTPGTTDQEGPPPDGPPEKR

SEQ ID NO: 1997 - protein, 27 aa, Homo sapiens
KHVTTAEGTPGTTDQEGPPPDGPPEKR

SEQ ID NO: 1998 - protein, 27 aa, Homo sapiens
KHVTTAEGTPGTTDQEGPPPDGPPEKR

SEQ ID NO: 1999 - protein, 27 aa, Homo sapiens
KHVTTAEGTPGTTDQEGPPPDGPPEKR

SEQ ID NO: 2000 - protein, 27 aa, Homo sapiens
KHVTTAEGTPGTTDQEGPPPDGPPEKR

SEQ ID NO: 2001 - protein, 27 aa, Homo sapiens
KHVTTAEGTPGTTDQEGPPPDGPPEKR

SEQ ID NO: 2002 - protein, 27 aa, Homo sapiens
KHVTTAEGTPGTTDQEGPPPDGPPEKR

SEQ ID NO: 2003 - protein, 27 aa, Homo sapiens
KHVTTAEGTPGTTDQEGPPPDGPPEKR

SEQ ID NO: 2004 - protein, 27 aa, Homo sapiens
KHVTTAEGTPGTTDQEGPPPDGPPEKR

SEQ ID NO: 2005 - protein, 27 aa, Homo sapiens
KHVTTAEGTPGTTDQEGPPPDGPPEKR

SEQ ID NO: 2006 - protein, 27 aa, Homo sapiens
KHVTTAEGTPGTTDQEGPPPDGPPEKR

SEQ ID NO: 2007 - protein, 27 aa, Homo sapiens
CLIEIFGILKEYEVGDPGQRTLLDPGR

SEQ ID NO: 2008 - protein, 7 aa, Homo sapiens
KASANAR

SEQ ID NO: 2009 - protein, 6 aa, Homo sapiens
KNPVCR

SEQ ID NO: 2010 - protein, 34 aa, Homo sapiens; identical to SEQ ID NO: 1943

SEQ ID NO: 2011 - protein, 34 aa, Homo sapiens; identical to SEQ ID NO: 1943

SEQ ID NO: 2012 - protein, 34 aa, Homo sapiens; identical to SEQ ID NO: 1943

SEQ ID NO: 2013 - protein, 34 aa, Homo sapiens; identical to SEQ ID NO: 1943

SEQ ID NO: 2014 - protein, 34 aa, Homo sapiens; identical to SEQ ID NO: 1943

SEQ ID NO: 2015 - protein, 34 aa, Homo sapiens; identical to SEQ ID NO: 1943

SEQ ID NO: 2016 - protein, 34 aa, Homo sapiens; identical to SEQ ID NO: 1943

SEQ ID NO: 2017 - protein, 34 aa, Homo sapiens; identical to SEQ ID NO: 1943

SEQ ID NO: 2018 - protein, 34 aa, Homo sapiens; identical to SEQ ID NO: 1943

SEQ ID NO: 2019 - protein, 34 aa, Homo sapiens; identical to SEQ ID NO: 1943

SEQ ID NO: 2020 - protein, 34 aa, Homo sapiens; identical to SEQ ID NO: 1943

SEQ ID NO: 2021 - protein, 34 aa, Homo sapiens; identical to SEQ ID NO: 1943

SEQ ID NO: 2022 - protein, 34 aa, Homo sapiens; identical to SEQ ID NO: 1943

SEQ ID NO: 2023 - protein, 34 aa, Homo sapiens; identical to SEQ ID NO: 1943

SEQ ID NO: 2024 - protein, 34 aa, Homo sapiens; identical to SEQ ID NO: 1943

SEQ ID NO: 2025 - protein, 34 aa, Homo sapiens; identical to SEQ ID NO: 1943

SEQ ID NO: 2026 - protein, 34 aa, Homo sapiens; identical to SEQ ID NO: 1943

SEQ ID NO: 2027 - protein, 11 aa, Homo sapiens
HQGTFTDEKSK

SEQ ID NO: 2028 - protein, 11 aa, Homo sapiens
HQGTFTDEKSK

SEQ ID NO: 2029 - protein, 12 aa, Homo sapiens
GKGEITPAAIQK

SEQ ID NO: 2030 - protein, 12 aa, Homo sapiens
GKGEITPAAIQK

SEQ ID NO: 2031 - protein, 14 aa, Homo sapiens
MSYEPNKDPYGSMR

SEQ ID NO: 2032 - protein, 33 aa, Homo sapiens
SPFLHSGMKMQKAGPPVPASHIAPAPVQPPMIR

SEQ ID NO: 2033 - protein, 20 aa, Homo sapiens
LLGEQYYKDAMEQCHNYNAR

SEQ ID NO: 2034 - protein, 20 aa, Homo sapiens
LLGEQYYKDAMEQCHNYNAR

SEQ ID NO: 2035 - protein, 20 aa, Homo sapiens
LLGEQYYKDAMEQCHNYNAR

SEQ ID NO: 2036 - protein, 20 aa, Homo sapiens
LLGEQYYKDAMEQCHNYNAR

SEQ ID NO: 2037 - protein, 20 aa, Homo sapiens
LLGEQYYKDAMEQCHNYNAR

SEQ ID NO: 2038 - protein, 20 aa, Homo sapiens
LLGEQYYKDAMEQCHNYNAR

SEQ ID NO: 2039 - protein, 20 aa, Homo sapiens
LLGEQYYKDAMEQCHNYNAR

SEQ ID NO: 2040 - protein, 20 aa, Homo sapiens
LLGEQYYKDAMEQCHNYNAR

SEQ ID NO: 2041 - protein, 17 aa, Homo sapiens
KEGLISQDGSSLEALLR

SEQ ID NO: 2042 - protein, 14 aa, Homo sapiens
RLTMKDIGTPEAWR

SEQ ID NO: 2043 - protein, 13 aa, Homo sapiens
LTMKDIGTPEAWR

SEQ ID NO: 2044 - protein, 14 aa, Homo sapiens
RLTMKDIGTPEAWR

SEQ ID NO: 2045 - protein, 27 aa, Homo sapiens
ILEDEPHSKDETPLCTLLDWQDSLAKR

SEQ ID NO: 2046 - protein, 27 aa, Homo sapiens
ILEDEPHSKDETPLCTLLDWQDSLAKR

SEQ ID NO: 2047 - protein, 27 aa, Homo sapiens
ILEDEPHSKDETPLCTLLDWQDSLAKR

SEQ ID NO: 2048 - protein, 10 aa, Homo sapiens
LEKLYSTMVR

SEQ ID NO: 2049 - protein, 10 aa, Homo sapiens
LEKLYSTMVR

SEQ ID NO: 2050 - protein, 10 aa, Homo sapiens
LEKLYSTMVR

SEQ ID NO: 2051 - protein, 10 aa, Homo sapiens
LEKLYSTMVR

SEQ ID NO: 2052 - protein, 10 aa, Homo sapiens
LEKLYSTMVR

SEQ ID NO: 2053 - protein, 10 aa, Homo sapiens
LEKLYSTMVR

SEQ ID NO: 2054 - protein, 10 aa, Homo sapiens
LEKLYSTMVR

SEQ ID NO: 2055 - protein, 16 aa, Homo sapiens
ESSKFPFGISPAQSHR

SEQ ID NO: 2056 - protein, 16 aa, Homo sapiens
ESSKFPFGISPAQSHR

SEQ ID NO: 2057 - protein, 16 aa, Homo sapiens
ESSKFPFGISPAQSHR

SEQ ID NO: 2058 - protein, 29 aa, Homo sapiens
NIKILEDEPHSKDETPLCTLLDWQDSLAK

SEQ ID NO: 2059 - protein, 29 aa, Homo sapiens
NIKILEDEPHSKDETPLCTLLDWQDSLAK

SEQ ID NO: 2060 - protein, 10 aa, Homo sapiens
KMADKVLPQR

SEQ ID NO: 2061 - protein, 14 aa, Homo sapiens
MEIQEAIKKPLTQK

SEQ ID NO: 2062 - protein, 14 aa, Homo sapiens
MEIQEAIKKPLTQK

SEQ ID NO: 2063 - protein, 14 aa, Homo sapiens
MEIQEAIKKPLTQK

SEQ ID NO: 2064 - protein, 14 aa, Homo sapiens
MEIQEAIKKPLTQK

SEQ ID NO: 2065 - protein, 14 aa, Homo sapiens
MEIQEAIKKPLTQK

SEQ ID NO: 2066 - protein, 14 aa, Homo sapiens
MEIQEAIKKPLTQK

SEQ ID NO: 2067 - protein, 14 aa, Homo sapiens
MEIQEAIKKPLTQK

SEQ ID NO: 2068 - protein, 14 aa, Homo sapiens
MEIQEAIKKPLTQK

SEQ ID NO: 2069 - protein, 14 aa, Homo sapiens
MEIQEAIKKPLTQK

SEQ ID NO: 2070 - protein, 14 aa, Homo sapiens
MEIQEAIKKPLTQK

SEQ ID NO: 2071 - protein, 14 aa, Homo sapiens
MEIQEAIKKPLTQK

SEQ ID NO: 2072 - protein, 14 aa, Homo sapiens
MEIQEAIKKPLTQK

SEQ ID NO: 2073 - protein, 14 aa, Homo sapiens
MEIQEAIKKPLTQK

SEQ ID NO: 2074 - protein, 14 aa, Homo sapiens
MEIQEAIKKPLTQK

SEQ ID NO: 2075 - protein, 14 aa, Homo sapiens
MEIQEAIKKPLTQK

SEQ ID NO: 2076 - protein, 14 aa, Homo sapiens
MEIQEAIKKPLTQK

SEQ ID NO: 2077 - protein, 14 aa, Homo sapiens
MEIQEAIKKPLTQK

SEQ ID NO: 2078 - protein, 14 aa, Homo sapiens
MEIQEAIKKPLTQK

SEQ ID NO: 2079 - protein, 14 aa, Homo sapiens
MEIQEAIKKPLTQK

SEQ ID NO: 2080 - protein, 14 aa, Homo sapiens
MEIQEAIKKPLTQK

SEQ ID NO: 2081 - protein, 14 aa, Homo sapiens
MEIQEAIKKPLTQK

SEQ ID NO: 2082 - protein, 14 aa, Homo sapiens
MEIQEAIKKPLTQK

SEQ ID NO: 2083 - protein, 14 aa, Homo sapiens
MEIQEAIKKPLTQK

SEQ ID NO: 2084 - protein, 14 aa, Homo sapiens
MEIQEAIKKPLTQK

SEQ ID NO: 2085 - protein, 14 aa, Homo sapiens
MEIQEAIKKPLTQK

SEQ ID NO: 2086 - protein, 14 aa, Homo sapiens
MEIQEAIKKPLTQK

SEQ ID NO: 2087 - protein, 14 aa, Homo sapiens
MEIQEAIKKPLTQK

SEQ ID NO: 2088 - protein, 14 aa, Homo sapiens
MEIQEAIKKPLTQK

SEQ ID NO: 2089 - protein, 14 aa, Homo sapiens
MEIQEAIKKPLTQK

SEQ ID NO: 2090 - protein, 14 aa, Homo sapiens
MEIQEAIKKPLTQK

SEQ ID NO: 2091 - protein, 10 aa, Homo sapiens
RMEIQEAIKK

SEQ ID NO: 2092 - protein, 14 aa, Homo sapiens
MEIQEAIKKPLTQK

SEQ ID NO: 2093 - protein, 14 aa, Homo sapiens
MEIQEAIKKPLTQK

SEQ ID NO: 2094 - protein, 14 aa, Homo sapiens
MEIQEAIKKPLTQK

SEQ ID NO: 2095 - protein, 9 aa, Homo sapiens
MADKVLPQR

SEQ ID NO: 2096 - protein, 10 aa, Homo sapiens
KMADKVLPQR

SEQ ID NO: 2097 - protein, 10 aa, Homo sapiens
KMADKVLPQR

SEQ ID NO: 2098 - protein, 13 aa, Homo sapiens
NKSKTPEIYLAYR

SEQ ID NO: 2099 - protein, 8 aa, Homo sapiens
KVMAAIEK

SEQ ID NO: 2100 - protein, 25 aa, Homo sapiens
GQLSWHQKTYAFSENPLPTVEIAIR

SEQ ID NO: 2101 - protein, 25 aa, Homo sapiens
GQLSWHQKTYAFSENPLPTVEIAIR

SEQ ID NO: 2102 - protein, 14 aa, Homo sapiens
MQKEITALAPSTMK

SEQ ID NO: 2103 - protein, 14 aa, Homo sapiens
MQKEITALAPSTMK

SEQ ID NO: 2104 - protein, 14 aa, Homo sapiens
MQKEITALAPSTMK

SEQ ID NO: 2105 - protein, 14 aa, Homo sapiens
MQKEITALAPSTMK

SEQ ID NO: 2106 - protein, 14 aa, Homo sapiens
MQKEITALAPSTMK

SEQ ID NO: 2107 - protein, 14 aa, Homo sapiens
MQKEITALAPSTMK

SEQ ID NO: 2108 - protein, 16 aa, Homo sapiens
MQKEITALAPSTMKIK

SEQ ID NO: 2109 - protein, 21 aa, Homo sapiens
VAPEEHPVLLTEAPLNPKANR

SEQ ID NO: 2110 - protein, 23 aa, Homo sapiens
HQGVMVGMGQKDSYVGDEAQSKR

SEQ ID NO: 2111 - protein, 23 aa, Homo sapiens
HQGVMVGMGQKDSYVGDEAQSKR

SEQ ID NO: 2112 - protein, 21 aa, Homo sapiens
VAPEEHPVLLTEAPLNPKANR

SEQ ID NO: 2113 - protein, 20 aa, Homo sapiens
EITALAPSTMKIKIIAPPER

SEQ ID NO: 2114 - protein, 20 aa, Homo sapiens
EITALAPSTMKIKIIAPPER

SEQ ID NO: 2115 - protein, 20 aa, Homo sapiens
EITALAPSTMKIKIIAPPER

SEQ ID NO: 2116 - protein, 33 aa, Homo sapiens
GILTLKYPIEHGIVTNWDDMEKIWHHTFYNELR

SEQ ID NO: 2117 - protein, 33 aa, Homo sapiens; identical to SEQ ID NO: 2116

SEQ ID NO: 2118 - protein, 33 aa, Homo sapiens; identical to SEQ ID NO: 2116

SEQ ID NO: 2119 - protein, 33 aa, Homo sapiens; identical to SEQ ID NO: 2116

SEQ ID NO: 2120 - protein, 33 aa, Homo sapiens; identical to SEQ ID NO: 2116

SEQ ID NO: 2121 - protein, 23 aa, Homo sapiens
HQGVMVGMGQKDCYVGDEAQSKR

SEQ ID NO: 2122 - protein, 33 aa, Homo sapiens; identical to SEQ ID NO: 2116

SEQ ID NO: 2123 - protein, 23 aa, Homo sapiens
HQGVMVGMGQKDCYVGDEAQSKR

SEQ ID NO: 2124 - protein, 23 aa, Homo sapiens
HQGVMVGMGQKDCYVGDEAQSKR

SEQ ID NO: 2125 - protein, 33 aa, Homo sapiens; identical to SEQ ID NO: 2116

SEQ ID NO: 2126 - protein, 33 aa, Homo sapiens; identical to SEQ ID NO: 2116

SEQ ID NO: 2127 - protein, 33 aa, Homo sapiens; identical to SEQ ID NO: 2116

SEQ ID NO: 2128 - protein, 23 aa, Homo sapiens
HQGVMVGMGQKDCYVGDEAQSKR

SEQ ID NO: 2129 - protein, 33 aa, Homo sapiens; identical to SEQ ID NO: 2116

SEQ ID NO: 2130 - protein, 33 aa, Homo sapiens; identical to SEQ ID NO: 2116

SEQ ID NO: 2131 - protein, 23 aa, Homo sapiens
HQGVMVGMGQKDCYVGDEAQSKR

SEQ ID NO: 2132 - protein, 23 aa, Homo sapiens
HQGVMVGMGQKDCYVGDEAQSKR

SEQ ID NO: 2133 - protein, 23 aa, Homo sapiens
HQGVMVGMGQKDCYVGDEAQSKR

SEQ ID NO: 2134 - protein, 23 aa, Homo sapiens
HQGVMVGMGQKDCYVGDEAQSKR

SEQ ID NO: 2135 - protein, 23 aa, Homo sapiens
HQGVMVGMGQKDCYVGDEAQSKR

SEQ ID NO: 2136 - protein, 23 aa, Homo sapiens
HQGVMVGMGQKDCYVGDEAQSKR

SEQ ID NO: 2137 - protein, 23 aa, Homo sapiens
RGILTLKYPIEHGIVTNWDDMEK

SEQ ID NO: 2138 - protein, 23 aa, Homo sapiens
HQGVMVGMGQKDSYVGDEAQSKR

SEQ ID NO: 2139 - protein, 23 aa, Homo sapiens
HQGVMVGMGQKDSYVGDEAQSKR

SEQ ID NO: 2140 - protein, 11 aa, Homo sapiens
WKYMIVDEGHR

SEQ ID NO: 2141 - protein, 22 aa, Homo sapiens
GILTLKYPIEHGIVTNWDDMEK

SEQ ID NO: 2142 - protein, 41 aa, Homo sapiens
EKLCYVALDFEQEMATAASSSSLEKSYELPDGQVITIGNER

SEQ ID NO: 2143 - protein, 22 aa, Homo sapiens
KDLYANTVLSGGTTMYPGIADR

SEQ ID NO: 2144 - protein, 22 aa, Homo sapiens
KDLYANTVLSGGTTMYPGIADR

SEQ ID NO: 2145 - protein, 22 aa, Homo sapiens
KDLYANTVLSGGTTMYPGIADR

SEQ ID NO: 2146 - protein, 22 aa, Homo sapiens
KDLYANTVLSGGTTMYPGIADR

SEQ ID NO: 2147 - protein, 22 aa, Homo sapiens
KDLYANTVLSGGTTMYPGIADR

SEQ ID NO: 2148 - protein, 22 aa, Homo sapiens
KDLYANTVLSGGTTMYPGIADR

SEQ ID NO: 2149 - protein, 22 aa, Homo sapiens
KDLYANTVLSGGTTMYPGIADR

SEQ ID NO: 2150 - protein, 22 aa, Homo sapiens
KDLYANTVLSGGTTMYPGIADR

SEQ ID NO: 2151 - protein, 22 aa, Homo sapiens
KDLYANTVLSGGTTMYPGIADR

SEQ ID NO: 2152 - protein, 22 aa, Homo sapiens
KDLYANTVLSGGTTMYPGIADR

SEQ ID NO: 2153 - protein, 22 aa, Homo sapiens
KDLYANTVLSGGTTMYPGIADR

SEQ ID NO: 2154 - protein, 8 aa, Homo sapiens
KLDQTIAR

SEQ ID NO: 2155 - protein, 9 aa, Homo sapiens
HIFAKVQQR

SEQ ID NO: 2156 - protein, 29 aa, Homo sapiens
ASEVEEILDGNDEKYKAVSISTEPPTYLR

SEQ ID NO: 2157 - protein, 14 aa, Homo sapiens
QNFHMEQLKYAELR

SEQ ID NO: 2158 - protein, 14 aa, Homo sapiens
QNFHMEQLKYAELR

SEQ ID NO: 2159 - protein, 14 aa, Homo sapiens
QNFHMEQLKYAELR

SEQ ID NO: 2160 - protein, 14 aa, Homo sapiens
QNFHMEQLKYAELR

SEQ ID NO: 2161 - protein, 14 aa, Homo sapiens
QNFHMEQLKYAELR

SEQ ID NO: 2162 - protein, 9 aa, Homo sapiens
DRKASANAR

SEQ ID NO: 2163 - protein, 11 aa, Homo sapiens
HQGTFTDEKSK

SEQ ID NO: 2164 - protein, 7 aa, Homo sapiens
KVQEAAR

SEQ ID NO: 2165 - protein, 23 aa, Homo sapiens
NTGDADQWCPLLETLTDAEMEKK

SEQ ID NO: 2166 - protein, 16 aa, Homo sapiens
KRDSDAGSSTPTTSTR

SEQ ID NO: 2167 - protein, 19 aa, Homo sapiens
QWLKAIEEGTLEEIEEEVR

SEQ ID NO: 2168 - protein, 13 aa, Homo sapiens
LKLIANNTTVERR

SEQ ID NO: 2169 - protein, 12 aa, Homo sapiens
LKLIANNTTVER

SEQ ID NO: 2170 - protein, 13 aa, Homo sapiens
LKLIANNTTVERR

SEQ ID NO: 2171 - protein, 29 aa, Homo sapiens
ENMEAISPLKNGMVEDWDSFQAILDHTYK

SEQ ID NO: 2172 - protein, 14 aa, Homo sapiens
WEKRWVTVGDTSLR

SEQ ID NO: 2173 - protein, 11 aa, Homo sapiens
KELPEYYELIR

SEQ ID NO: 2174 - protein, 11 aa, Homo sapiens
KELPEYYELIR

SEQ ID NO: 2175 - protein, 16 aa, Homo sapiens
VIQAGMFDQKSSSHER

SEQ ID NO: 2176 - protein, 16 aa, Homo sapiens
VIQAGMFDQKSSSHER

SEQ ID NO: 2177 - protein, 16 aa, Homo sapiens
VIQAGMFDQKSSSHER

SEQ ID NO: 2178 - protein, 16 aa, Homo sapiens
VIQAGMFDQKSSSHER

SEQ ID NO: 2179 - protein, 17 aa, Homo sapiens
GIVEDIHCGSMKGTGMR

SEQ ID NO: 2180 - protein, 20 aa, Homo sapiens
HQEYLNSILQHAKDFKEYHR

SEQ ID NO: 2181 - protein, 18 aa, Homo sapiens
QKHQEYLNSILQHAKDFK

SEQ ID NO: 2182 - protein, 18 aa, Homo sapiens
QKHQEYLNSILQHAKDFK

SEQ ID NO: 2183 - protein, 16 aa, Homo sapiens
HQEYLNSILQHAKDFK

SEQ ID NO: 2184 - protein, 18 aa, Homo sapiens
QKHQEYLNSILQHAKDFK

SEQ ID NO: 2185 - protein, 16 aa, Homo sapiens
HQEYLNSILQHAKDFK

SEQ ID NO: 2186 - protein, 20 aa, Homo sapiens
HQEYLNSILQHAKDFKEYHR

SEQ ID NO: 2187 - protein, 18 aa, Homo sapiens
QKHQEYLNSILQHAKDFK

SEQ ID NO: 2188 - protein, 18 aa, Homo sapiens
QKHQEYLNSILQHAKDFK

SEQ ID NO: 2189 - protein, 20 aa, Homo sapiens
HQEYLNSILQHAKDFKEYHR

SEQ ID NO: 2190 - protein, 18 aa, Homo sapiens
QKHQEYLNSILQHAKDFK

SEQ ID NO: 2191 - protein, 18 aa, Homo sapiens
QKHQEYLNSILQHAKDFK

SEQ ID NO: 2192 - protein, 18 aa, Homo sapiens
QKHQEYLNSILQHAKDFK

SEQ ID NO: 2193 - protein, 20 aa, Homo sapiens
HQEYLNSILQHAKDFKEYHR

SEQ ID NO: 2194 - protein, 18 aa, Homo sapiens
QKHQEYLNSILQHAKDFK

SEQ ID NO: 2195 - protein, 18 aa, Homo sapiens
QKHQEYLNSILQHAKDFK

SEQ ID NO: 2196 - protein, 16 aa, Homo sapiens
HQEYLNSILQHAKDFK

SEQ ID NO: 2197 - protein, 18 aa, Homo sapiens
QKHQEYLNSILQHAKDFK

SEQ ID NO: 2198 - protein, 18 aa, Homo sapiens
QKHQEYLNSILQHAKDFK

SEQ ID NO: 2199 - protein, 18 aa, Homo sapiens
QKHQEYLNSILQHAKDFK

SEQ ID NO: 2200 - protein, 18 aa, Homo sapiens
QKHQEYLNSILQHAKDFK

SEQ ID NO: 2201 - protein, 18 aa, Homo sapiens
QKHQEYLNSILQHAKDFK

SEQ ID NO: 2202 - protein, 18 aa, Homo sapiens
QKHQEYLNSILQHAKDFK

SEQ ID NO: 2203 - protein, 18 aa, Homo sapiens
QKHQEYLNSILQHAKDFK

SEQ ID NO: 2204 - protein, 20 aa, Homo sapiens
HQEYLNSILQHAKDFKEYHR

SEQ ID NO: 2205 - protein, 20 aa, Homo sapiens
HQEYLNSILQHAKDFKEYHR

SEQ ID NO: 2206 - protein, 18 aa, Homo sapiens
QKHQEYLNSILQHAKDFK

SEQ ID NO: 2207 - protein, 18 aa, Homo sapiens
QKHQEYLNSILQHAKDFK

SEQ ID NO: 2208 - protein, 18 aa, Homo sapiens
QKHQEYLNSILQHAKDFK

SEQ ID NO: 2209 - protein, 20 aa, Homo sapiens
HQEYLNSILQHAKDFKEYHR

SEQ ID NO: 2210 - protein, 20 aa, Homo sapiens
HQEYLNSILQHAKDFKEYHR

SEQ ID NO: 2211 - protein, 18 aa, Homo sapiens
QKHQEYLNSILQHAKDFK

SEQ ID NO: 2212 - protein, 20 aa, Homo sapiens
HQEYLNSILQHAKDFKEYHR

SEQ ID NO: 2213 - protein, 20 aa, Homo sapiens
HQEYLNSILQHAKDFKEYHR

SEQ ID NO: 2214 - protein, 20 aa, Homo sapiens
HQEYLNSILQHAKDFKEYHR

SEQ ID NO: 2215 - protein, 18 aa, Homo sapiens
QKHQEYLNSILQHAKDFK

SEQ ID NO: 2216 - protein, 20 aa, Homo sapiens
HQEYLNSILQHAKDFKEYHR

SEQ ID NO: 2217 - protein, 18 aa, Homo sapiens
QKHQEYLNSILQHAKDFK

SEQ ID NO: 2218 - protein, 20 aa, Homo sapiens
HQEYLNSILQHAKDFKEYHR

SEQ ID NO: 2219 - protein, 18 aa, Homo sapiens
QKHQEYLNSILQHAKDFK

SEQ ID NO: 2220 - protein, 18 aa, Homo sapiens
QKHQEYLNSILQHAKDFK

SEQ ID NO: 2221 - protein, 16 aa, Homo sapiens
HQEYLNSILQHAKDFK

SEQ ID NO: 2222 - protein, 20 aa, Homo sapiens
HQEYLNSILQHAKDFKEYHR

SEQ ID NO: 2223 - protein, 20 aa, Homo sapiens
HQEYLNSILQHAKDFKEYHR

SEQ ID NO: 2224 - protein, 20 aa, Homo sapiens
HQEYLNSILQHAKDFKEYHR

SEQ ID NO: 2225 - protein, 18 aa, Homo sapiens
QKHQEYLNSILQHAKDFK

SEQ ID NO: 2226 - protein, 16 aa, Homo sapiens
HQEYLNSILQHAKDFK

SEQ ID NO: 2227 - protein, 20 aa, Homo sapiens
HQEYLNSILQHAKDFKEYHR

SEQ ID NO: 2228 - protein, 18 aa, Homo sapiens
QKHQEYLNSILQHAKDFK

SEQ ID NO: 2229 - protein, 20 aa, Homo sapiens
HQEYLNSILQHAKDFKEYHR

SEQ ID NO: 2230 - protein, 20 aa, Homo sapiens
HQEYLNSILQHAKDFKEYHR

SEQ ID NO: 2231 - protein, 18 aa, Homo sapiens
QKHQEYLNSILQHAKDFK

SEQ ID NO: 2232 - protein, 18 aa, Homo sapiens
QKHQEYLNSILQHAKDFK

SEQ ID NO: 2233 - protein, 18 aa, Homo sapiens
QKHQEYLNSILQHAKDFK

SEQ ID NO: 2234 - protein, 18 aa, Homo sapiens
QKHQEYLNSILQHAKDFK

SEQ ID NO: 2235 - protein, 20 aa, Homo sapiens
HQEYLNSILQHAKDFKEYHR

SEQ ID NO: 2236 - protein, 18 aa, Homo sapiens
QKHQEYLNSILQHAKDFK

SEQ ID NO: 2237 - protein, 18 aa, Homo sapiens
QKHQEYLNSILQHAKDFK

SEQ ID NO: 2238 - protein, 16 aa, Homo sapiens
HQEYLNSILQHAKDFK

SEQ ID NO: 2239 - protein, 18 aa, Homo sapiens
QKHQEYLNSILQHAKDFK

SEQ ID NO: 2240 - protein, 20 aa, Homo sapiens
HQEYLNSILQHAKDFKEYHR

SEQ ID NO: 2241 - protein, 18 aa, Homo sapiens
QKHQEYLNSILQHAKDFK

SEQ ID NO: 2242 - protein, 20 aa, Homo sapiens
HQEYLNSILQHAKDFKEYHR

SEQ ID NO: 2243 - protein, 12 aa, Homo sapiens
LKLIANNTTVER

SEQ ID NO: 2244 - protein, 12 aa, Homo sapiens
LKLIANNTTVER

SEQ ID NO: 2245 - protein, 13 aa, Homo sapiens
LKLIANNTTVERR

SEQ ID NO: 2246 - protein, 13 aa, Homo sapiens
LKLIANNTTVERR

SEQ ID NO: 2247 - protein, 12 aa, Homo sapiens
LKLIANNTTVER

SEQ ID NO: 2248 - protein, 12 aa, Homo sapiens
LKLIANNTTVER

SEQ ID NO: 2249 - protein, 12 aa, Homo sapiens
LKLIANNTTVER

SEQ ID NO: 2250 - protein, 13 aa, Homo sapiens
LKLIANNTTVERR

SEQ ID NO: 2251 - protein, 12 aa, Homo sapiens
LKLIANNTTVER

SEQ ID NO: 2252 - protein, 12 aa, Homo sapiens
LKLIANNTTVER

SEQ ID NO: 2253 - protein, 13 aa, Homo sapiens
LKLIANNTTVERR

SEQ ID NO: 2254 - protein, 13 aa, Homo sapiens
LKLIANNTTVERR

SEQ ID NO: 2255 - protein, 13 aa, Homo sapiens
LKLIANNTTVERR

SEQ ID NO: 2256 - protein, 20 aa, Homo sapiens
HQEYLNSILQHAKDFKEYHR

SEQ ID NO: 2257 - protein, 13 aa, Homo sapiens
LKLIANNTTVERR

SEQ ID NO: 2258 - protein, 13 aa, Homo sapiens
LKLIANNTTVERR

SEQ ID NO: 2259 - protein, 11 aa, Homo sapiens
KELPEYYELIR

SEQ ID NO: 2260 - protein, 11 aa, Homo sapiens
WKYMIVDEGHR

SEQ ID NO: 2261 - protein, 9 aa, Homo sapiens
KEKLPQVTR

SEQ ID NO: 2262 - protein, 32 aa, Homo sapiens
RFSSWIGGSILASLGTFQQMWISKQEYEEGGK

SEQ ID NO: 2263 - protein, 21 aa, Homo sapiens
ALLALAKVDENHSEFTLYESR

SEQ ID NO: 2264 - protein, 21 aa, Homo sapiens
ALLALAKVDENHSEFTLYESR

SEQ ID NO: 2265 - protein, 21 aa, Homo sapiens
ALLALAKVDENHSEFTLYESR

SEQ ID NO: 2266 - protein, 21 aa, Homo sapiens
ALLALAKVDENHSEFTLYESR

SEQ ID NO: 2267 - protein, 21 aa, Homo sapiens
ALLALAKVDENHSEFTLYESR

SEQ ID NO: 2268 - protein, 21 aa, Homo sapiens
ALLALAKVDENHSEFTLYESR

SEQ ID NO: 2269 - protein, 21 aa, Homo sapiens
ALLALAKVDENHSEFTLYESR

SEQ ID NO: 2270 - protein, 21 aa, Homo sapiens
ALLALAKVDENHSEFTLYESR

SEQ ID NO: 2271 - protein, 21 aa, Homo sapiens
ALLALAKVDENHSEFTLYESR

SEQ ID NO: 2272 - protein, 21 aa, Homo sapiens
ALLALAKVDENHSEFTLYESR

SEQ ID NO: 2273 - protein, 21 aa, Homo sapiens
ALLALAKVDENHSEFTLYESR

SEQ ID NO: 2274 - protein, 21 aa, Homo sapiens
ALLALAKVDENHSEFTLYESR

SEQ ID NO: 2275 - protein, 21 aa, Homo sapiens
ALLALAKVDENHSEFTLYESR

SEQ ID NO: 2276 - protein, 21 aa, Homo sapiens
ALLALAKVDENHSEFTLYESR

SEQ ID NO: 2277 - protein, 21 aa, Homo sapiens
ALLALAKVDENHSEFTLYESR

SEQ ID NO: 2278 - protein, 21 aa, Homo sapiens
ALLALAKVDENHSEFTLYESR

SEQ ID NO: 2279 - protein, 21 aa, Homo sapiens
ALLALAKVDENHSEFTLYESR

SEQ ID NO: 2280 - protein, 21 aa, Homo sapiens
ALLALAKVDENHSEFTLYESR

SEQ ID NO: 2281 - protein, 21 aa, Homo sapiens
ALLALAKVDENHSEFTLYESR

SEQ ID NO: 2282 - protein, 21 aa, Homo sapiens
ALLALAKVDENHSEFTLYESR

SEQ ID NO: 2283 - protein, 21 aa, Homo sapiens
ALLALAKVDENHSEFTLYESR

SEQ ID NO: 2284 - protein, 21 aa, Homo sapiens
ALLALAKVDENHSEFTLYESR

SEQ ID NO: 2285 - protein, 21 aa, Homo sapiens
ALLALAKVDENHSEFTLYESR

SEQ ID NO: 2286 - protein, 21 aa, Homo sapiens
ALLALAKVDENHSEFTLYESR

SEQ ID NO: 2287 - protein, 21 aa, Homo sapiens
ALLALAKVDENHSEFTLYESR

SEQ ID NO: 2288 - protein, 21 aa, Homo sapiens
ALLALAKVDENHSEFTLYESR

SEQ ID NO: 2289 - protein, 21 aa, Homo sapiens
ALLALAKVDENHSEFTLYESR

SEQ ID NO: 2290 - protein, 11 aa, Homo sapiens
ELSQKTPPSMR

SEQ ID NO: 2291 - protein, 21 aa, Homo sapiens
SNSVGIQDAFNDGSDSTFQKR

SEQ ID NO: 2292 - protein, 14 aa, Homo sapiens
MSYEPNKDPYGSMR

SEQ ID NO: 2293 - protein, 14 aa, Homo sapiens
MSYEPNKDPYGSMR

SEQ ID NO: 2294 - protein, 17 aa, Homo sapiens
AYHNSPAYLAYINAKSR

SEQ ID NO: 2295 - protein, 17 aa, Homo sapiens
AYHNSPAYLAYINAKSR

SEQ ID NO: 2296 - protein, 17 aa, Homo sapiens
AYHNSPAYLAYINAKSR

SEQ ID NO: 2297 - protein, 17 aa, Homo sapiens
AYHNSPAYLAYINAKSR

SEQ ID NO: 2298 - protein, 17 aa, Homo sapiens
AYHNSPAYLAYINAKSR

SEQ ID NO: 2299 - protein, 17 aa, Homo sapiens
AYHNSPAYLAYINAKSR

SEQ ID NO: 2300 - protein, 17 aa, Homo sapiens
AYHNSPAYLAYINAKSR

SEQ ID NO: 2301 - protein, 17 aa, Homo sapiens
AYHNSPAYLAYINAKSR

SEQ ID NO: 2302 - protein, 17 aa, Homo sapiens
AYHNSPAYLAYINAKSR

SEQ ID NO: 2303 - protein, 17 aa, Homo sapiens
AYHNSPAYLAYINAKSR

SEQ ID NO: 2304 - protein, 17 aa, Homo sapiens
AYHNSPAYLAYINAKSR

SEQ ID NO: 2305 - protein, 17 aa, Homo sapiens
AYHNSPAYLAYINAKSR

SEQ ID NO: 2306 - protein, 17 aa, Homo sapiens
AYHNSPAYLAYINAKSR

SEQ ID NO: 2307 - protein, 20 aa, Homo sapiens
ASNPDLKLWEIGKIIGGMWR

SEQ ID NO: 2308 - protein, 20 aa, Homo sapiens
ASNPDLKLWEIGKIIGGMWR

SEQ ID NO: 2309 - protein, 20 aa, Homo sapiens
ASNPDLKLWEIGKIIGGMWR

SEQ ID NO: 2310 - protein, 12 aa, Homo sapiens
LKLIANNTTVER

SEQ ID NO: 2311 - protein, 22 aa, Homo sapiens
QVQSLMVHQRKLEAELLQIEER

SEQ ID NO: 2312 - protein, 14 aa, Homo sapiens
LKIPEGLFDPSNVK

SEQ ID NO: 2313 - protein, 13 aa, Homo sapiens
SPSPSPTPEAKKK

SEQ ID NO: 2314 - protein, 12 aa, Homo sapiens
SPSPSPTPEAKK

SEQ ID NO: 2315 - protein, 17 aa, Homo sapiens
VASAAAKSALEEFSKMK

SEQ ID NO: 2316 - protein, 43 aa, Homo sapiens
STGLILDSGATHTTAIPVHDGYVLQQGIVKSPLAGDFITMQCR

SEQ ID NO: 2317 - protein, 43 aa, Homo sapiens; identical to SEQ ID NO: 2316

SEQ ID NO: 2318 - protein, 43 aa, Homo sapiens; identical to SEQ ID NO: 2316

SEQ ID NO: 2319 - protein, 43 aa, Homo sapiens; identical to SEQ ID NO: 2316

SEQ ID NO: 2320 - protein, 43 aa, Homo sapiens; identical to SEQ ID NO: 2316

SEQ ID NO: 2321 - protein, 20 aa, Homo sapiens
EPKEGQEEVLKEVVESEGER

SEQ ID NO: 2322 - protein, 20 aa, Homo sapiens
EPKEGQEEVLKEVVESEGER

SEQ ID NO: 2323 - protein, 20 aa, Homo sapiens
EPKEGQEEVLKEVVESEGER

SEQ ID NO: 2324 - protein, 20 aa, Homo sapiens
EPKEGQEEVLKEVVESEGER

SEQ ID NO: 2325 - protein, 18 aa, Homo sapiens
TPPSMRLKLIANNTTVER

SEQ ID NO: 2326 - protein, 13 aa, Homo sapiens
QEYEEGGKQCVER

SEQ ID NO: 2327 - protein, 13 aa, Homo sapiens
QEYEEGGKQCVER

SEQ ID NO: 2328 - protein, 13 aa, Homo sapiens
QEYEEGGKQCVER

SEQ ID NO: 2329 - protein, 13 aa, Homo sapiens
QEYEEGGKQCVER

SEQ ID NO: 2330 - protein, 13 aa, Homo sapiens
QEYEEGGKQCVER

SEQ ID NO: 2331 - protein, 13 aa, Homo sapiens
QEYEEGGKQCVER

SEQ ID NO: 2332 - protein, 14 aa, Homo sapiens
QEYEEGGKQCVERK

SEQ ID NO: 2333 - protein, 13 aa, Homo sapiens
QEYEEGGKQCVER

SEQ ID NO: 2334 - protein, 14 aa, Homo sapiens
QEYEEGGKQCVERK

SEQ ID NO: 2335 - protein, 43 aa, Homo sapiens; identical to SEQ ID NO: 2316

SEQ ID NO: 2336 - protein, 20 aa, Homo sapiens
EKLTELMFEHYNIPAFFLCK

SEQ ID NO: 2337 - protein, 20 aa, Homo sapiens
EKLTELMFEHYNIPAFFLCK

SEQ ID NO: 2338 - protein, 20 aa, Homo sapiens
EKLTELMFEHYNIPAFFLCK

SEQ ID NO: 2339 - protein, 20 aa, Homo sapiens
EKLTELMFEHYNIPAFFLCK

SEQ ID NO: 2340 - protein, 20 aa, Homo sapiens
EKLTELMFEHYNIPAFFLCK

SEQ ID NO: 2341 - protein, 20 aa, Homo sapiens
EKLTELMFEHYNIPAFFLCK

SEQ ID NO: 2342 - protein, 20 aa, Homo sapiens
EKLTELMFEHYNIPAFFLCK

SEQ ID NO: 2343 - protein, 20 aa, Homo sapiens
EKLTELMFEHYNIPAFFLCK

SEQ ID NO: 2344 - protein, 37 aa, Homo sapiens
RHEPYGQQYPGQGPPSGQPPYGGHQPGLYPQQPNYKR

SEQ ID NO: 2345 - protein, 36 aa, Homo sapiens
HEPYGQQYPGQGPPSGQPPYGGHQPGLYPQQPNYKR

SEQ ID NO: 2346 - protein, 12 aa, Homo sapiens
HMDGMYGPPAKR

SEQ ID NO: 2347 - protein, 16 aa, Homo sapiens
KTGQPEELVSCSDCGR

SEQ ID NO: 2348 - protein, 12 aa, Homo sapiens
LKLIANNTTVER

SEQ ID NO: 2349 - protein, 13 aa, Homo sapiens
LKLIANNTTVERR

SEQ ID NO: 2350 - protein, 12 aa, Homo sapiens
LKLIANNTTVER

SEQ ID NO: 2351 - protein, 34 aa, Homo sapiens
NRPGLSYHYAHSHLAEEEGEDKEDSQPPTPVSQR

SEQ ID NO: 2352 - protein, 20 aa, Homo sapiens
EKLTELMFEHYNIPAFFLCK

SEQ ID NO: 2353 - protein, 20 aa, Homo sapiens
EKLTELMFEHYNIPAFFLCK

SEQ ID NO: 2354 - protein, 11 aa, Homo sapiens
ELSQKTPPSMR

SEQ ID NO: 2355 - protein, 11 aa, Homo sapiens
ELSQKTPPSMR

SEQ ID NO: 2356 - protein, 24 aa, Homo sapiens
PVKFQLEDDGEFYMIGSEVGNYLR

SEQ ID NO: 2357 - protein, 24 aa, Homo sapiens
PVKFQLEDDGEFYMIGSEVGNYLR

SEQ ID NO: 2358 - protein, 13 aa, Homo sapiens
LKLIANNTTVERR

SEQ ID NO: 2359 - protein, 12 aa, Homo sapiens
LKLIANNTTVER

SEQ ID NO: 2360 - protein, 13 aa, Homo sapiens
LKLIANNTTVERR

SEQ ID NO: 2361 - protein, 11 aa, Homo sapiens
IVASSHGKKTK

SEQ ID NO: 2362 - protein, 11 aa, Homo sapiens
IVASSHGKKTK

SEQ ID NO: 2363 - protein, 43 aa, Homo sapiens; identical to SEQ ID NO: 2316

SEQ ID NO: 2364 - protein, 43 aa, Homo sapiens; identical to SEQ ID NO: 2316

SEQ ID NO: 2365 - protein, 43 aa, Homo sapiens; identical to SEQ ID NO: 2316

SEQ ID NO: 2366 - protein, 43 aa, Homo sapiens; identical to SEQ ID NO: 2316

SEQ ID NO: 2367 - protein, 43 aa, Homo sapiens; identical to SEQ ID NO: 2316

SEQ ID NO: 2368 - protein, 43 aa, Homo sapiens; identical to SEQ ID NO: 2316

SEQ ID NO: 2369 - protein, 43 aa, Homo sapiens; identical to SEQ ID NO: 2316

SEQ ID NO: 2370 - protein, 29 aa, Homo sapiens
ENMEAISPLKNGMVEDWDSFQAILDHTYK

SEQ ID NO: 2371 - protein, 20 aa, Homo sapiens
EKLTELMFEHYNIPAFFLCK

SEQ ID NO: 2372 - protein, 20 aa, Homo sapiens
EKLTELMFEHYNIPAFFLCK

SEQ ID NO: 2373 - protein, 20 aa, Homo sapiens
EKLTELMFEHYNIPAFFLCK

SEQ ID NO: 2374 - protein, 11 aa, Homo sapiens
HQGTFTDEKSK

SEQ ID NO: 2375 - protein, 25 aa, Homo sapiens
SKASHHIYPYSSSQDDEEWLRPVMR

SEQ ID NO: 2376 - protein, 12 aa, Homo sapiens
LKLIANNTTVER

SEQ ID NO: 2377 - protein, 15 aa, Homo sapiens
DTALETALNAKAYKR

SEQ ID NO: 2378 - protein, 17 aa, Homo sapiens
VIHVESGKILTGTDAPK

SEQ ID NO: 2379 - protein, 17 aa, Homo sapiens
VIHVESGKILTGTDAPK

SEQ ID NO: 2380 - protein, 11 aa, Homo sapiens
HQGTFTDEKSK

SEQ ID NO: 2381 - protein, 8 aa, Homo sapiens
ITPIQKPR

SEQ ID NO: 2382 - protein, 11 aa, Homo sapiens
TKATIELKALR

SEQ ID NO: 2383 - protein, 11 aa, Homo sapiens
TKATIELKALR

SEQ ID NO: 2384 - protein, 8 aa, Homo sapiens
TKATIELK

SEQ ID NO: 2385 - protein, 8 aa, Homo sapiens
TKATIELK

SEQ ID NO: 2386 - protein, 11 aa, Homo sapiens
TKATIELKALR

SEQ ID NO: 2387 - protein, 11 aa, Homo sapiens
TKATIELKALR

SEQ ID NO: 2388 - protein, 8 aa, Homo sapiens
TKATIELK

SEQ ID NO: 2389 - protein, 8 aa, Homo sapiens
TKATIELK

SEQ ID NO: 2390 - protein, 11 aa, Homo sapiens
HQGTFTDEKSK

SEQ ID NO: 2391 - protein, 10 aa, Homo sapiens
VSYKGSPAAR

SEQ ID NO: 2392 - protein, 11 aa, Homo sapiens
HQGTFTDEKSK

SEQ ID NO: 2393 - protein, 11 aa, Homo sapiens
HQGTFTDEKSK

SEQ ID NO: 2394 - protein, 14 aa, Homo sapiens
HRKEVDYSDSLTEK

SEQ ID NO: 2395 - protein, 16 aa, Homo sapiens
KRDSDAGSSTPTTSTR

SEQ ID NO: 2396 - protein, 11 aa, Homo sapiens
TKATIELKALR

SEQ ID NO: 2397 - protein, 12 aa, Homo sapiens
EKPVDLQNFGLR

SEQ ID NO: 2398 - protein, 14 aa, Homo sapiens
NKEKPVDLQNFGLR

SEQ ID NO: 2399 - protein, 14 aa, Homo sapiens
NKEKPVDLQNFGLR

SEQ ID NO: 2400 - protein, 18 aa, Homo sapiens
SPQVPAAQQMLNFPEKNK

SEQ ID NO: 2401 - protein, 18 aa, Homo sapiens
SPQVPAAQQMLNFPEKNK

SEQ ID NO: 2402 - protein, 18 aa, Homo sapiens
SPQVPAAQQMLNFPEKNK

SEQ ID NO: 2403 - protein, 18 aa, Homo sapiens
SPQVPAAQQMLNFPEKNK

SEQ ID NO: 2404 - protein, 18 aa, Homo sapiens
SPQVPAAQQMLNFPEKNK

SEQ ID NO: 2405 - protein, 19 aa, Homo sapiens
KRPAPQQIQQVQQQAVQNR

SEQ ID NO: 2406 - protein, 19 aa, Homo sapiens
KRPAPQQIQQVQQQAVQNR

SEQ ID NO: 2407 - protein, 19 aa, Homo sapiens
KRPAPQQIQQVQQQAVQNR

SEQ ID NO: 2408 - protein, 19 aa, Homo sapiens
KRPAPQQIQQVQQQAVQNR

SEQ ID NO: 2409 - protein, 23 aa, Homo sapiens
EVEAQLPEKVEYVIKCDMSALQR

SEQ ID NO: 2410 - protein, 19 aa, Homo sapiens
KRPAPQQIQQVQQQAVQNR

SEQ ID NO: 2411 - protein, 19 aa, Homo sapiens
KRPAPQQIQQVQQQAVQNR

SEQ ID NO: 2412 - protein, 15 aa, Homo sapiens
DTALETALNAKAYKR

SEQ ID NO: 2413 - protein, 15 aa, Homo sapiens
DTALETALNAKAYKR

SEQ ID NO: 2414 - protein, 15 aa, Homo sapiens
DTALETALNAKAYKR

SEQ ID NO: 2415 - protein, 15 aa, Homo sapiens
RDTALETALNAKAYK

SEQ ID NO: 2416 - protein, 14 aa, Homo sapiens
DTALETALNAKAYK

SEQ ID NO: 2417 - protein, 15 aa, Homo sapiens
RDTALETALNAKAYK

SEQ ID NO: 2418 - protein, 15 aa, Homo sapiens
RDTALETALNAKAYK

SEQ ID NO: 2419 - protein, 19 aa, Homo sapiens
KRPAPQQIQQVQQQAVQNR

SEQ ID NO: 2420 - protein, 19 aa, Homo sapiens
KRPAPQQIQQVQQQAVQNR

SEQ ID NO: 2421 - protein, 19 aa, Homo sapiens
KRPAPQQIQQVQQQAVQNR

SEQ ID NO: 2422 - protein, 19 aa, Homo sapiens
KRPAPQQIQQVQQQAVQNR

SEQ ID NO: 2423 - protein, 31 aa, Homo sapiens; identical to SEQ ID NO: 1672

SEQ ID NO: 2424 - protein, 31 aa, Homo sapiens; identical to SEQ ID NO: 1672

SEQ ID NO: 2425 - protein, 12 aa, Homo sapiens
EKPTDMQNFGLR

SEQ ID NO: 2426 - protein, 12 aa, Homo sapiens
EKPTDMQNFGLR

SEQ ID NO: 2427 - protein, 16 aa, Homo sapiens
GQPLPDHLQMAVQGKR

SEQ ID NO: 2428 - protein, 8 aa, Homo sapiens
TKATIELK

SEQ ID NO: 2429 - protein, 8 aa, Homo sapiens
TKATIELK

SEQ ID NO: 2430 - protein, 8 aa, Homo sapiens
TKATIELK

SEQ ID NO: 2431 - protein, 41 aa, Homo sapiens
PSPAPPAVPPAASPVMPPQTQSPGQPAQPAPMVPLHQKQSR

SEQ ID NO: 2432 - protein, 41 aa, Homo sapiens; identical to SEQ ID NO: 2431

SEQ ID NO: 2433 - protein, 41 aa, Homo sapiens; identical to SEQ ID NO: 2431

SEQ ID NO: 2434 - protein, 15 aa, Homo sapiens
DTALETALNAKAYKR

SEQ ID NO: 2435 - protein, 15 aa, Homo sapiens
RDTALETALNAKAYK

SEQ ID NO: 2436 - protein, 18 aa, Homo sapiens
ISAKTLTDEVNSPDSDRR

SEQ ID NO: 2437 - protein, 26 aa, Homo sapiens
MEKGEPYMSIQPAEDPDDYDDGFSMK

SEQ ID NO: 2438 - protein, 26 aa, Homo sapiens
MEKGEPYMSIQPAEDPDDYDDGFSMK

SEQ ID NO: 2439 - protein, 26 aa, Homo sapiens
MEKGEPYMSIQPAEDPDDYDDGFSMK

SEQ ID NO: 2440 - protein, 26 aa, Homo sapiens
MEKGEPYMSIQPAEDPDDYDDGFSMK

SEQ ID NO: 2441 - protein, 26 aa, Homo sapiens
MEKGEPYMSIQPAEDPDDYDDGFSMK

SEQ ID NO: 2442 - protein, 17 aa, Homo sapiens
AYHNSPAYLAYINAKSR

SEQ ID NO: 2443 - protein, 12 aa, Homo sapiens
KLEAELLQIEER

SEQ ID NO: 2444 - protein, 8 aa, Homo sapiens
SVTGKIQK

SEQ ID NO: 2445 - protein, 6 aa, Homo sapiens
EQKAKR

SEQ ID NO: 2446 - protein, 10 aa, Homo sapiens
LDGTTKAEDR

SEQ ID NO: 2447 - protein, 6 aa, Homo sapiens
EQKAKR

SEQ ID NO: 2448 - protein, 6 aa, Homo sapiens
EQKAKR

SEQ ID NO: 2449 - protein, 10 aa, Homo sapiens
VSYKGSPAAR

SEQ ID NO: 2450 - protein, 10 aa, Homo sapiens
VSYKGSPAAR

SEQ ID NO: 2451 - protein, 6 aa, Homo sapiens
GFKYLR

SEQ ID NO: 2452 - protein, 15 aa, Homo sapiens
DTALETALNAKAYKR

SEQ ID NO: 2453 - protein, 15 aa, Homo sapiens
RDTALETALNAKAYK

SEQ ID NO: 2454 - protein, 15 aa, Homo sapiens
RDTALETALNAKAYK

SEQ ID NO: 2455 - protein, 15 aa, Homo sapiens
RDTALETALNAKAYK

SEQ ID NO: 2456 - protein, 15 aa, Homo sapiens
RDTALETALNAKAYK

SEQ ID NO: 2457 - protein, 16 aa, Homo sapiens
KRDSDAGSSTPTTSTR

SEQ ID NO: 2458 - protein, 14 aa, Homo sapiens
QRGKGEITPAAIQK

SEQ ID NO: 2459 - protein, 14 aa, Homo sapiens
QRGKGEITPAAIQK

SEQ ID NO: 2460 - protein, 19 aa, Homo sapiens
LDLAGRDLTDYLMKILTER

SEQ ID NO: 2461 - protein, 19 aa, Homo sapiens
LDLAGRDLTDYLMKILTER

SEQ ID NO: 2462 - protein, 13 aa, Homo sapiens
DLTDYLMKILTER

SEQ ID NO: 2463 - protein, 19 aa, Homo sapiens
LDLAGRDLTDYLMKILTER

SEQ ID NO: 2464 - protein, 13 aa, Homo sapiens
DLTDYLMKILTER

SEQ ID NO: 2465 - protein, 19 aa, Homo sapiens
LDLAGRDLTDYLMKILTER

SEQ ID NO: 2466 - protein, 13 aa, Homo sapiens
DLTDYLMKILTER

SEQ ID NO: 2467 - protein, 13 aa, Homo sapiens
DLTDYLMKILTER

SEQ ID NO: 2468 - protein, 13 aa, Homo sapiens
DLTDYLMKILTER

SEQ ID NO: 2469 - protein, 19 aa, Homo sapiens
LDLAGRDLTDYLMKILTER

SEQ ID NO: 2470 - protein, 13 aa, Homo sapiens
DLTDYLMKILTER

SEQ ID NO: 2471 - protein, 13 aa, Homo sapiens
DLTDYLMKILTER

SEQ ID NO: 2472 - protein, 13 aa, Homo sapiens
DLTDYLMKILTER

SEQ ID NO: 2473 - protein, 19 aa, Homo sapiens
LDLAGRDLTDYLMKILTER

SEQ ID NO: 2474 - protein, 19 aa, Homo sapiens
LDLAGRDLTDYLMKILTER

SEQ ID NO: 2475 - protein, 13 aa, Homo sapiens
DLTDYLMKILTER

SEQ ID NO: 2476 - protein, 13 aa, Homo sapiens
DLTDYLMKILTER

SEQ ID NO: 2477 - protein, 13 aa, Homo sapiens
DLTDYLMKILTER

SEQ ID NO: 2478 - protein, 19 aa, Homo sapiens
LDLAGRDLTDYLMKILTER

SEQ ID NO: 2479 - protein, 13 aa, Homo sapiens
DLTDYLMKILTER

SEQ ID NO: 2480 - protein, 13 aa, Homo sapiens
DLTDYLMKILTER

SEQ ID NO: 2481 - protein, 13 aa, Homo sapiens
DLTDYLMKILTER

SEQ ID NO: 2482 - protein, 13 aa, Homo sapiens
DLTDYLMKILTER

SEQ ID NO: 2483 - protein, 13 aa, Homo sapiens
DLTDYLMKILTER

SEQ ID NO: 2484 - protein, 13 aa, Homo sapiens
DLTDYLMKILTER

SEQ ID NO: 2485 - protein, 28 aa, Homo sapiens
VDFPTAIGMVVERDDGSTLMEIDGDKGK

SEQ ID NO: 2486 - protein, 23 aa, Homo sapiens
HQGVMVGMGQKDCYVGDEAQSKR

SEQ ID NO: 2487 - protein, 8 aa, Homo sapiens
EQKKENER

SEQ ID NO: 2488 - protein, 8 aa, Homo sapiens
KENERIEK

SEQ ID NO: 2489 - protein, 8 aa, Homo sapiens
KENERIEK

SEQ ID NO: 2490 - protein, 8 aa, Homo sapiens
KENERIEK

SEQ ID NO: 2491 - protein, 15 aa, Homo sapiens
AVATYHANTEREQKK

SEQ ID NO: 2492 - protein, 8 aa, Homo sapiens
EQKKENER

SEQ ID NO: 2493 - protein, 17 aa, Homo sapiens
KKIPDPDSDDVSEVDAR

SEQ ID NO: 2494 - protein, 17 aa, Homo sapiens
IQKLTKAVATYHANTER

SEQ ID NO: 2495 - protein, 17 aa, Homo sapiens
IQKLTKAVATYHANTER

SEQ ID NO: 2496 - protein, 20 aa, Homo sapiens
EIITLAPSTMKIKIIAPPER

SEQ ID NO: 2497 - protein, 20 aa, Homo sapiens
EIITLAPSTMKIKIIAPPER

SEQ ID NO: 2498 - protein, 22 aa, Homo sapiens
KDLYANTVLSGGSTMYPGIADR

SEQ ID NO: 2499 - protein, 11 aa, Homo sapiens
WKYMIVDEGHR

SEQ ID NO: 2500 - protein, 15 aa, Homo sapiens
AVATWHANTEREQKK

SEQ ID NO: 2501 - protein, 9 aa, Homo sapiens
IKIIAPPER

SEQ ID NO: 2502 - protein, 9 aa, Homo sapiens
IKIIAPPER

SEQ ID NO: 2503 - protein, 9 aa, Homo sapiens
IKIIAPPER

SEQ ID NO: 2504 - protein, 9 aa, Homo sapiens
IKIIAPPER

SEQ ID NO: 2505 - protein, 9 aa, Homo sapiens
IKIIAPPER

SEQ ID NO: 2506 - protein, 9 aa, Homo sapiens
ETERIEKER

SEQ ID NO: 2507 - protein, 9 aa, Homo sapiens
IKIIAPPER

SEQ ID NO: 2508 - protein, 23 aa, Homo sapiens
DIGEGNLSTAAAAALAAAAVKAK

SEQ ID NO: 2509 - protein, 13 aa, Homo sapiens
NKSKTPEIYLAYR

SEQ ID NO: 2510 - protein, 13 aa, Homo sapiens
NKSKTPEIYLAYR

SEQ ID NO: 2511 - protein, 13 aa, Homo sapiens
NKSKTPEIYLAYR

SEQ ID NO: 2512 - protein, 8 aa, Homo sapiens
KVMATIEK

SEQ ID NO: 2513 - protein, 8 aa, Homo sapiens
KVMATIEK

SEQ ID NO: 2514 - protein, 6 aa, Homo sapiens
EQKAKR

SEQ ID NO: 2515 - protein, 8 aa, Homo sapiens
SRAKDDIK

SEQ ID NO: 2516 - protein, 15 aa, Homo sapiens
IFKWVPVVDPQEEER

SEQ ID NO: 2517 - protein, 15 aa, Homo sapiens
IFKWVPVVDPQEEER

SEQ ID NO: 2518 - protein, 15 aa, Homo sapiens
IFKWVPVVDPQEEER

SEQ ID NO: 2519 - protein, 20 aa, Homo sapiens
HQEYLNSILQHAKDFKEYHR

SEQ ID NO: 2520 - protein, 11 aa, Homo sapiens
WKYMIVDEGHR

SEQ ID NO: 2521 - protein, 11 aa, Homo sapiens
WKYMIVDEGHR

SEQ ID NO: 2522 - protein, 11 aa, Homo sapiens
WKYMIVDEGHR

SEQ ID NO: 2523 - protein, 11 aa, Homo sapiens
WKYMIVDEGHR

SEQ ID NO: 2524 - protein, 11 aa, Homo sapiens
WKYMIVDEGHR

SEQ ID NO: 2525 - protein, 10 aa, Homo sapiens
VSYKGSPAAR

SEQ ID NO: 2526 - protein, 7 aa, Homo sapiens
AKDDIKK

SEQ ID NO: 2527 - protein, 10 aa, Homo sapiens
EARITEKLEK

SEQ ID NO: 2528 - protein, 10 aa, Homo sapiens
VSYKGSPAAR

SEQ ID NO: 2529 - protein, 7 aa, Homo sapiens
AKDDIKK

SEQ ID NO: 2530 - protein, 8 aa, Homo sapiens
SRAKDDIK

SEQ ID NO: 2531 - protein, 8 aa, Homo sapiens
SVTGKIQK

SEQ ID NO: 2532 - protein, 8 aa, Homo sapiens
SVTGKIQK

SEQ ID NO: 2533 - protein, 8 aa, Homo sapiens
SVTGKIQK

SEQ ID NO: 2534 - protein, 16 aa, Homo sapiens
KRDSDAGSSTPTTSTR

SEQ ID NO: 2535 - protein, 17 aa, Homo sapiens
AYHNSPAYLAYINAKSR

SEQ ID NO: 2536 - protein, 17 aa, Homo sapiens
KEGLISQDGSSLEALLR

SEQ ID NO: 2537 - protein, 16 aa, Homo sapiens
LSFPSIKPDTDQTLKK

SEQ ID NO: 2538 - protein, 15 aa, Homo sapiens
LSFPSIKPDTDQTLK

SEQ ID NO: 2539 - protein, 15 aa, Homo sapiens
LSFPSIKPDTDQTLK

SEQ ID NO: 2540 - protein, 15 aa, Homo sapiens
LSFPSIKPDTDQTLK

SEQ ID NO: 2541 - protein, 16 aa, Homo sapiens
LSFPSIKPDTDQTLKK

SEQ ID NO: 2542 - protein, 15 aa, Homo sapiens
LSFPSIKPDTDQTLK

SEQ ID NO: 2543 - protein, 16 aa, Homo sapiens
LSFPSIKPDTDQTLKK

SEQ ID NO: 2544 - protein, 16 aa, Homo sapiens
LSFPSIKPDTDQTLKK

SEQ ID NO: 2545 - protein, 16 aa, Homo sapiens
KTGQPEELVSCSDCGR

SEQ ID NO: 2546 - protein, 16 aa, Homo sapiens
KTGQPEELVSCSDCGR

SEQ ID NO: 2547 - protein, 16 aa, Homo sapiens
KRDSDAGSSTPTTSTR

SEQ ID NO: 2548 - protein, 11 aa, Homo sapiens
KELPEYYELIR

SEQ ID NO: 2549 - protein, 11 aa, Homo sapiens
TKATVELKALR

SEQ ID NO: 2550 - protein, 17 aa, Homo sapiens
IQKLSKAVATWHANTER

SEQ ID NO: 2551 - protein, 20 aa, Homo sapiens
LDASILEDRDKPYACDICGK

SEQ ID NO: 2552 - protein, 20 aa, Homo sapiens
LDASILEDRDKPYACDICGK

SEQ ID NO: 2553 - protein, 21 aa, Homo sapiens
SGHPSCLQFTPVMMAAVKTYR

SEQ ID NO: 2554 - protein, 21 aa, Homo sapiens
SGHPSCLQFTPVMMAAVKTYR

SEQ ID NO: 2555 - protein, 21 aa, Homo sapiens
SGHPSCLQFTPVMMAAVKTYR

SEQ ID NO: 2556 - protein, 21 aa, Homo sapiens
SGHPSCLQFTPVMMAAVKTYR

SEQ ID NO: 2557 - protein, 11 aa, Homo sapiens
KELPEYYELIR

SEQ ID NO: 2558 - protein, 17 aa, Homo sapiens
KEGLISQDGSSLEALLR

SEQ ID NO: 2559 - protein, 21 aa, Homo sapiens
KGPDGLALPNNYCDFCLGDSK

SEQ ID NO: 2560 - protein, 24 aa, Homo sapiens
ILEPDDFLDDLDDEDYEEDTPKRR

SEQ ID NO: 2561 - protein, 22 aa, Homo sapiens
CTLLLMLDYQPPQFKLDPRLAR

SEQ ID NO: 2562 - protein, 12 aa, Homo sapiens
DKPYACDICGKR

SEQ ID NO: 2563 - protein, 9 aa, Homo sapiens
KKDGGPNVK

SEQ ID NO: 2564 - protein, 22 aa, Homo sapiens
LPFLDSQTGVAQSNCYIWMEKR

SEQ ID NO: 2565 - protein, 22 aa, Homo sapiens
LPFLDSQTGVAQSNCYIWMEKR

SEQ ID NO: 2566 - protein, 10 aa, Homo sapiens
SKGKGVGSAR

SEQ ID NO: 2567 - protein, 9 aa, Homo sapiens
KKDGGPNVK

SEQ ID NO: 2568 - protein, 32 aa, Homo sapiens
PGLSYHYAHSHLAEEEGEDKEDSQPPTPVSQR

SEQ ID NO: 2569 - protein, 32 aa, Homo sapiens; identical to SEQ ID NO: 2568

SEQ ID NO: 2570 - protein, 32 aa, Homo sapiens; identical to SEQ ID NO: 2568

SEQ ID NO: 2571 - protein, 32 aa, Homo sapiens; identical to SEQ ID NO: 2568

SEQ ID NO: 2572 - protein, 32 aa, Homo sapiens; identical to SEQ ID NO: 2568

SEQ ID NO: 2573 - protein, 32 aa, Homo sapiens; identical to SEQ ID NO: 2568

SEQ ID NO: 2574 - protein, 32 aa, Homo sapiens; identical to SEQ ID NO: 2568

SEQ ID NO: 2575 - protein, 32 aa, Homo sapiens; identical to SEQ ID NO: 2568

SEQ ID NO: 2576 - protein, 32 aa, Homo sapiens; identical to SEQ ID NO: 2568

SEQ ID NO: 2577 - protein, 32 aa, Homo sapiens; identical to SEQ ID NO: 2568

SEQ ID NO: 2578 - protein, 19 aa, Homo sapiens
KRPAPQQIQQVQQQAVQNR

SEQ ID NO: 2579 - protein, 19 aa, Homo sapiens
KRPAPQQIQQVQQQAVQNR

SEQ ID NO: 2580 - protein, 9 aa, Homo sapiens
KLDQTIMRK

SEQ ID NO: 2581 - protein, 10 aa, Homo sapiens
SKGKGVGSAR

SEQ ID NO: 2582 - protein, 15 aa, Homo sapiens
LSFPSIKPDTDQTLK

SEQ ID NO: 2583 - protein, 17 aa, Homo sapiens
KEGLISQDGSSLEALLR

SEQ ID NO: 2584 - protein, 14 aa, Homo sapiens
KVWDQVKASNPDLK

SEQ ID NO: 2585 - protein, 21 aa, Homo sapiens
SGHPSCLQFTPVMMAAVKTYR

SEQ ID NO: 2586 - protein, 11 aa, Homo sapiens
HQGTFTDEKSK

SEQ ID NO: 2587 - protein, 11 aa, Homo sapiens
HQGTFTDEKSK

SEQ ID NO: 2588 - protein, 7 aa, Homo sapiens
KVQEAAR

SEQ ID NO: 2589 - protein, 21 aa, Homo sapiens
QQLLTERQNFHMEQLKYAELR

SEQ ID NO: 2590 - protein, 21 aa, Homo sapiens
SGHPSCLQFTPVMMAAVKTYR

SEQ ID NO: 2591 - protein, 7 aa, Homo sapiens
TDPLEKR

SEQ ID NO: 2592 - protein, 7 aa, Homo sapiens
TDPLEKR

SEQ ID NO: 2593 - protein, 9 aa, Homo sapiens
DRKASANAR

SEQ ID NO: 2594 - protein, 7 aa, Homo sapiens
TDPLEKR

SEQ ID NO: 2595 - protein, 7 aa, Homo sapiens
TDPLEKR

SEQ ID NO: 2596 - protein, 12 aa, Homo sapiens
RHQGTFTDEKSK

SEQ ID NO: 2597 - protein, 12 aa, Homo sapiens
RHQGTFTDEKSK

SEQ ID NO: 2598 - protein, 25 aa, Homo sapiens
SKASHHIYPYSSSQDDEEWLRPVMR

SEQ ID NO: 2599 - protein, 25 aa, Homo sapiens
SKASHHIYPYSSSQDDEEWLRPVMR

SEQ ID NO: 2600 - protein, 25 aa, Homo sapiens
SKASHHIYPYSSSQDDEEWLRPVMR

SEQ ID NO: 2601 - protein, 7 aa, Homo sapiens
KIRDQDR

SEQ ID NO: 2602 - protein, 16 aa, Homo sapiens
KTGQPEELVSCSDCGR

SEQ ID NO: 2603 - protein, 25 aa, Homo sapiens
GQLSWHQKTYAFSENPLPTVEIAIR

SEQ ID NO: 2604 - protein, 25 aa, Homo sapiens
GQLSWHQKTYAFSENPLPTVEIAIR

SEQ ID NO: 2605 - protein, 20 aa, Homo sapiens
SRDETPLCTIAHWQDSLAKR

SEQ ID NO: 2606 - protein, 20 aa, Homo sapiens
SRDETPLCTIAHWQDSLAKR

SEQ ID NO: 2607 - protein, 20 aa, Homo sapiens
SRDETPLCTIAHWQDSLAKR

SEQ ID NO: 2608 - protein, 20 aa, Homo sapiens
SRDETPLCTIAHWQDSLAKR

SEQ ID NO: 2609 - protein, 20 aa, Homo sapiens
SRDETPLCTIAHWQDSLAKR

SEQ ID NO: 2610 - protein, 20 aa, Homo sapiens
SRDETPLCTIAHWQDSLAKR

SEQ ID NO: 2611 - protein, 20 aa, Homo sapiens
SRDETPLCTIAHWQDSLAKR

SEQ ID NO: 2612 - protein, 20 aa, Homo sapiens
SRDETPLCTIAHWQDSLAKR

SEQ ID NO: 2613 - protein, 20 aa, Homo sapiens
SRDETPLCTIAHWQDSLAKR

SEQ ID NO: 2614 - protein, 20 aa, Homo sapiens
SRDETPLCTIAHWQDSLAKR

SEQ ID NO: 2615 - protein, 10 aa, Homo sapiens
MTEKLEKQQK

SEQ ID NO: 2616 - protein, 10 aa, Homo sapiens
MTEKLEKQQK

SEQ ID NO: 2617 - protein, 10 aa, Homo sapiens
AAKALLAMAR

SEQ ID NO: 2618 - protein, 10 aa, Homo sapiens
MTEKLEKQQK

SEQ ID NO: 2619 - protein, 10 aa, Homo sapiens
MTEKLEKQQK

SEQ ID NO: 2620 - protein, 10 aa, Homo sapiens
MTEKLEKQQK

SEQ ID NO: 2621 - protein, 10 aa, Homo sapiens
MTEKLEKQQK

SEQ ID NO: 2622 - protein, 8 aa, Homo sapiens
QQKIEQER

SEQ ID NO: 2623 - protein, 8 aa, Homo sapiens
QQKIEQER

SEQ ID NO: 2624 - protein, 8 aa, Homo sapiens
QQKIEQER

SEQ ID NO: 2625 - protein, 15 aa, Homo sapiens
RDTTLETALNSKAYK

SEQ ID NO: 2626 - protein, 15 aa, Homo sapiens
DTTLETALNSKAYKR

SEQ ID NO: 2627 - protein, 15 aa, Homo sapiens
DTTLETALNSKAYKR

SEQ ID NO: 2628 - protein, 20 aa, Homo sapiens
SRDETPLCTIAHWQDSLAKR

SEQ ID NO: 2629 - protein, 20 aa, Homo sapiens
SRDETPLCTIAHWQDSLAKR

SEQ ID NO: 2630 - protein, 16 aa, Homo sapiens
GKGGTKTLMNTIMQLR

SEQ ID NO: 2631 - protein, 10 aa, Homo sapiens
ITEKLEKQQK

SEQ ID NO: 2632 - protein, 10 aa, Homo sapiens
ITEKLEKQQK

SEQ ID NO: 2633 - protein, 10 aa, Homo sapiens
ITEKLEKQQK

SEQ ID NO: 2634 - protein, 10 aa, Homo sapiens
ITEKLEKQQK

SEQ ID NO: 2635 - protein, 10 aa, Homo sapiens
ITEKLEKQQK

SEQ ID NO: 2636 - protein, 10 aa, Homo sapiens
ITEKLEKQQK

SEQ ID NO: 2637 - protein, 10 aa, Homo sapiens
ITEKLEKQQK

SEQ ID NO: 2638 - protein, 10 aa, Homo sapiens
ITEKLEKQQK

SEQ ID NO: 2639 - protein, 20 aa, Homo sapiens
SRDETPLCTIAHWQDSLAKR

SEQ ID NO: 2640 - protein, 20 aa, Homo sapiens
SRDETPLCTIAHWQDSLAKR

SEQ ID NO: 2641 - protein, 20 aa, Homo sapiens
SRDETPLCTIAHWQDSLAKR

SEQ ID NO: 2642 - protein, 20 aa, Homo sapiens
SRDETPLCTIAHWQDSLAKR

SEQ ID NO: 2643 - protein, 20 aa, Homo sapiens
SRDETPLCTIAHWQDSLAKR

SEQ ID NO: 2644 - protein, 20 aa, Homo sapiens
SRDETPLCTIAHWQDSLAKR

SEQ ID NO: 2645 - protein, 20 aa, Homo sapiens
SRDETPLCTIAHWQDSLAKR

SEQ ID NO: 2646 - protein, 16 aa, Homo sapiens
GQPLPDHLQMAVQGKR

SEQ ID NO: 2647 - protein, 25 aa, Homo sapiens
KNPVCREMSMALLSNLAQGDALAAR

SEQ ID NO: 2648 - protein, 15 aa, Homo sapiens
DTALETALNAKAYKR

SEQ ID NO: 2649 - protein, 15 aa, Homo sapiens
DTALETALNAKAYKR

SEQ ID NO: 2650 - protein, 15 aa, Homo sapiens
DTALETALNAKAYKR

SEQ ID NO: 2651 - protein, 15 aa, Homo sapiens
RDTALETALNAKAYK

SEQ ID NO: 2652 - protein, 15 aa, Homo sapiens
RDTALETALNAKAYK

SEQ ID NO: 2653 - protein, 15 aa, Homo sapiens
RDTALETALNAKAYK

SEQ ID NO: 2654 - protein, 15 aa, Homo sapiens
RDTALETALNAKAYK

SEQ ID NO: 2655 - protein, 15 aa, Homo sapiens
RDTALETALNAKAYK

SEQ ID NO: 2656 - protein, 15 aa, Homo sapiens
RDTALETALNAKAYK

SEQ ID NO: 2657 - protein, 17 aa, Homo sapiens
AYHNSPAYLAYINAKSR

SEQ ID NO: 2658 - protein, 17 aa, Homo sapiens
AYHNSPAYLAYINAKSR

SEQ ID NO: 2659 - protein, 17 aa, Homo sapiens
AYHNSPAYLAYINAKSR

SEQ ID NO: 2660 - protein, 17 aa, Homo sapiens
AYHNSPAYLAYINAKSR

SEQ ID NO: 2661 - protein, 17 aa, Homo sapiens
AYHNSPAYLAYINAKSR

SEQ ID NO: 2662 - protein, 17 aa, Homo sapiens
AYHNSPAYLAYINAKSR

SEQ ID NO: 2663 - protein, 26 aa, Homo sapiens
MEKGEPYMSIQPAEDPDDYDDGFSMK

SEQ ID NO: 2664 - protein, 26 aa, Homo sapiens
MEKGEPYMSIQPAEDPDDYDDGFSMK

SEQ ID NO: 2665 - protein, 26 aa, Homo sapiens
MEKGEPYMSIQPAEDPDDYDDGFSMK

SEQ ID NO: 2666 - protein, 26 aa, Homo sapiens
MEKGEPYMSIQPAEDPDDYDDGFSMK

SEQ ID NO: 2667 - protein, 12 aa, Homo sapiens
KLEAELLQIEER

SEQ ID NO: 2668 - protein, 17 aa, Homo sapiens
AYHNSPAYLAYINAKSR

SEQ ID NO: 2669 - protein, 17 aa, Homo sapiens
AYHNSPAYLAYINAKSR

SEQ ID NO: 2670 - protein, 17 aa, Homo sapiens
AYHNSPAYLAYINAKSR

SEQ ID NO: 2671 - protein, 17 aa, Homo sapiens
AYHNSPAYLAYINAKSR

SEQ ID NO: 2672 - protein, 37 aa, Homo sapiens; identical to SEQ ID NO: 2344

SEQ ID NO: 2673 - protein, 37 aa, Homo sapiens; identical to SEQ ID NO: 2344

SEQ ID NO: 2674 - protein, 37 aa, Homo sapiens; identical to SEQ ID NO: 2344

SEQ ID NO: 2675 - protein, 11 aa, Homo sapiens
YVGDRKNPVCR

SEQ ID NO: 2676 - protein, 11 aa, Homo sapiens
YVGDRKNPVCR

SEQ ID NO: 2677 - protein, 20 aa, Homo sapiens
SRDETPLCTIAHWQDSLAKR

SEQ ID NO: 2678 - protein, 20 aa, Homo sapiens
SRDETPLCTIAHWQDSLAKR

SEQ ID NO: 2679 - protein, 20 aa, Homo sapiens
SRDETPLCTIAHWQDSLAKR

SEQ ID NO: 2680 - protein, 20 aa, Homo sapiens
SRDETPLCTIAHWQDSLAKR

SEQ ID NO: 2681 - protein, 20 aa, Homo sapiens
SRDETPLCTIAHWQDSLAKR

SEQ ID NO: 2682 - protein, 20 aa, Homo sapiens
SRDETPLCTIAHWQDSLAKR

SEQ ID NO: 2683 - protein, 20 aa, Homo sapiens
SRDETPLCTIAHWQDSLAKR

SEQ ID NO: 2684 - protein, 20 aa, Homo sapiens
SRDETPLCTIAHWQDSLAKR

SEQ ID NO: 2685 - protein, 20 aa, Homo sapiens
SRDETPLCTIAHWQDSLAKR

SEQ ID NO: 2686 - protein, 20 aa, Homo sapiens
SRDETPLCTIAHWQDSLAKR

SEQ ID NO: 2687 - protein, 20 aa, Homo sapiens
SRDETPLCTIAHWQDSLAKR

SEQ ID NO: 2688 - protein, 13 aa, Homo sapiens
ITKVYELGNEPER

SEQ ID NO: 2689 - protein, 12 aa, Homo sapiens
FPFGIQQAKSHR

SEQ ID NO: 2690 - protein, 12 aa, Homo sapiens
FPFGIQQAKSHR

SEQ ID NO: 2691 - protein, 10 aa, Homo sapiens
NIKLLEDEPR

SEQ ID NO: 2692 - protein, 10 aa, Homo sapiens
NIKLLEDEPR

SEQ ID NO: 2693 - protein, 10 aa, Homo sapiens
NIKLLEDEPR

SEQ ID NO: 2694 - protein, 10 aa, Homo sapiens
NIKLLEDEPR

SEQ ID NO: 2695 - protein, 10 aa, Homo sapiens
QEKFYATLVR

SEQ ID NO: 2696 - protein, 10 aa, Homo sapiens
QEKFYATLVR

SEQ ID NO: 2697 - protein, 10 aa, Homo sapiens
QEKFYATLVR

SEQ ID NO: 2698 - protein, 10 aa, Homo sapiens
QEKFYATLVR

SEQ ID NO: 2699 - protein, 10 aa, Homo sapiens
QEKFYATLVR

SEQ ID NO: 2700 - protein, 10 aa, Homo sapiens
QEKFYATLVR

SEQ ID NO: 2701 - protein, 10 aa, Homo sapiens
QEKFYATLVR

SEQ ID NO: 2702 - protein, 10 aa, Homo sapiens
QEKFYATLVR

SEQ ID NO: 2703 - protein, 10 aa, Homo sapiens
QEKFYATLVR

SEQ ID NO: 2704 - protein, 10 aa, Homo sapiens
QEKFYATLVR

SEQ ID NO: 2705 - protein, 10 aa, Homo sapiens
QEKFYATLVR

SEQ ID NO: 2706 - protein, 10 aa, Homo sapiens
QEKFYATLVR

SEQ ID NO: 2707 - protein, 19 aa, Homo sapiens
KRPAPQQIQQVQQQAVQNR

SEQ ID NO: 2708 - protein, 19 aa, Homo sapiens
KRPAPQQIQQVQQQAVQNR

SEQ ID NO: 2709 - protein, 19 aa, Homo sapiens
KRPAPQQIQQVQQQAVQNR

SEQ ID NO: 2710 - protein, 19 aa, Homo sapiens
KRPAPQQIQQVQQQAVQNR

SEQ ID NO: 2711 - protein, 19 aa, Homo sapiens
KRPAPQQIQQVQQQAVQNR

SEQ ID NO: 2712 - protein, 19 aa, Homo sapiens
KRPAPQQIQQVQQQAVQNR

SEQ ID NO: 2713 - protein, 19 aa, Homo sapiens
KRPAPQQIQQVQQQAVQNR

SEQ ID NO: 2714 - protein, 19 aa, Homo sapiens
KRPAPQQIQQVQQQAVQNR

SEQ ID NO: 2715 - protein, 19 aa, Homo sapiens
KRPAPQQIQQVQQQAVQNR

SEQ ID NO: 2716 - protein, 19 aa, Homo sapiens
KRPAPQQIQQVQQQAVQNR

SEQ ID NO: 2717 - protein, 21 aa, Homo sapiens
KCLIDIFGILMEYEVGDPSQK

SEQ ID NO: 2718 - protein, 19 aa, Homo sapiens
APQTYEKEEDEDKGVACSK

SEQ ID NO: 2719 - protein, 19 aa, Homo sapiens
APQTYEKEEDEDKGVACSK

SEQ ID NO: 2720 - protein, 19 aa, Homo sapiens
APQTYEKEEDEDKGVACSK

SEQ ID NO: 2721 - protein, 19 aa, Homo sapiens
APQTYEKEEDEDKGVACSK

SEQ ID NO: 2722 - protein, 10 aa, Homo sapiens
AKHLAAVEER

SEQ ID NO: 2723 - protein, 10 aa, Homo sapiens
AKHLAAVEER

SEQ ID NO: 2724 - protein, 13 aa, Homo sapiens
SLVALLVETQMKK

SEQ ID NO: 2725 - protein, 13 aa, Homo sapiens
SLVALLVETQMKK

SEQ ID NO: 2726 - protein, 10 aa, Homo sapiens
AKHLAAVEER

SEQ ID NO: 2727 - protein, 9 aa, Homo sapiens
KNNLFVVDR

SEQ ID NO: 2728 - protein, 9 aa, Homo sapiens
KNNLFVVDR

SEQ ID NO: 2729 - protein, 9 aa, Homo sapiens
KNNLFVVDR

SEQ ID NO: 2730 - protein, 12 aa, Homo sapiens
HMDGMYGPPAKR

SEQ ID NO: 2731 - protein, 12 aa, Homo sapiens
HMDGMYGPPAKR

SEQ ID NO: 2732 - protein, 20 aa, Homo sapiens
SRDETPLCTIAHWQDSLAKR

SEQ ID NO: 2733 - protein, 20 aa, Homo sapiens
SRDETPLCTIAHWQDSLAKR

SEQ ID NO: 2734 - protein, 20 aa, Homo sapiens
SRDETPLCTIAHWQDSLAKR

SEQ ID NO: 2735 - protein, 20 aa, Homo sapiens
SRDETPLCTIAHWQDSLAKR

SEQ ID NO: 2736 - protein, 20 aa, Homo sapiens
SRDETPLCTIAHWQDSLAKR

SEQ ID NO: 2737 - protein, 20 aa, Homo sapiens
SRDETPLCTIAHWQDSLAKR

SEQ ID NO: 2738 - protein, 20 aa, Homo sapiens
SRDETPLCTIAHWQDSLAKR

SEQ ID NO: 2739 - protein, 20 aa, Homo sapiens
SRDETPLCTIAHWQDSLAKR

SEQ ID NO: 2740 - protein, 20 aa, Homo sapiens
SRDETPLCTIAHWQDSLAKR

SEQ ID NO: 2741 - protein, 20 aa, Homo sapiens
SRDETPLCTIAHWQDSLAKR

SEQ ID NO: 2742 - protein, 20 aa, Homo sapiens
SRDETPLCTIAHWQDSLAKR

SEQ ID NO: 2743 - protein, 20 aa, Homo sapiens
SRDETPLCTIAHWQDSLAKR

SEQ ID NO: 2744 - protein, 20 aa, Homo sapiens
SRDETPLCTIAHWQDSLAKR

SEQ ID NO: 2745 - protein, 20 aa, Homo sapiens
SRDETPLCTIAHWQDSLAKR

SEQ ID NO: 2746 - protein, 20 aa, Homo sapiens
SRDETPLCTIAHWQDSLAKR

SEQ ID NO: 2747 - protein, 20 aa, Homo sapiens
SRDETPLCTIAHWQDSLAKR

SEQ ID NO: 2748 - protein, 18 aa, Homo sapiens
DETPLCTIAHWQDSLAKR

SEQ ID NO: 2749 - protein, 20 aa, Homo sapiens
SRDETPLCTIAHWQDSLAKR

SEQ ID NO: 2750 - protein, 20 aa, Homo sapiens
SRDETPLCTIAHWQDSLAKR

SEQ ID NO: 2751 - protein, 20 aa, Homo sapiens
SRDETPLCTIAHWQDSLAKR

SEQ ID NO: 2752 - protein, 18 aa, Homo sapiens
DETPLCTIAHWQDSLAKR

SEQ ID NO: 2753 - protein, 18 aa, Homo sapiens
DETPLCTIAHWQDSLAKR

SEQ ID NO: 2754 - protein, 20 aa, Homo sapiens
SRDETPLCTIAHWQDSLAKR

SEQ ID NO: 2755 - protein, 18 aa, Homo sapiens
DETPLCTIAHWQDSLAKR

SEQ ID NO: 2756 - protein, 20 aa, Homo sapiens
SRDETPLCTIAHWQDSLAKR

SEQ ID NO: 2757 - protein, 20 aa, Homo sapiens
SRDETPLCTIAHWQDSLAKR

SEQ ID NO: 2758 - protein, 20 aa, Homo sapiens
SRDETPLCTIAHWQDSLAKR

SEQ ID NO: 2759 - protein, 20 aa, Homo sapiens
SRDETPLCTIAHWQDSLAKR

SEQ ID NO: 2760 - protein, 20 aa, Homo sapiens
SRDETPLCTIAHWQDSLAKR

SEQ ID NO: 2761 - protein, 20 aa, Homo sapiens
SRDETPLCTIAHWQDSLAKR

SEQ ID NO: 2762 - protein, 20 aa, Homo sapiens
SRDETPLCTIAHWQDSLAKR

SEQ ID NO: 2763 - protein, 20 aa, Homo sapiens
SRDETPLCTIAHWQDSLAKR

SEQ ID NO: 2764 - protein, 20 aa, Homo sapiens
SRDETPLCTIAHWQDSLAKR

SEQ ID NO: 2765 - protein, 20 aa, Homo sapiens
SRDETPLCTIAHWQDSLAKR

SEQ ID NO: 2766 - protein, 20 aa, Homo sapiens
SRDETPLCTIAHWQDSLAKR

SEQ ID NO: 2767 - protein, 20 aa, Homo sapiens
SRDETPLCTIAHWQDSLAKR

SEQ ID NO: 2768 - protein, 20 aa, Homo sapiens
SRDETPLCTIAHWQDSLAKR

SEQ ID NO: 2769 - protein, 20 aa, Homo sapiens
SRDETPLCTIAHWQDSLAKR

SEQ ID NO: 2770 - protein, 20 aa, Homo sapiens
SRDETPLCTIAHWQDSLAKR

SEQ ID NO: 2771 - protein, 20 aa, Homo sapiens
SRDETPLCTIAHWQDSLAKR

SEQ ID NO: 2772 - protein, 20 aa, Homo sapiens
SRDETPLCTIAHWQDSLAKR

SEQ ID NO: 2773 - protein, 20 aa, Homo sapiens
SRDETPLCTIAHWQDSLAKR

SEQ ID NO: 2774 - protein, 20 aa, Homo sapiens
SRDETPLCTIAHWQDSLAKR

SEQ ID NO: 2775 - protein, 20 aa, Homo sapiens
SRDETPLCTIAHWQDSLAKR

SEQ ID NO: 2776 - protein, 18 aa, Homo sapiens
DETPLCTIAHWQDSLAKR

SEQ ID NO: 2777 - protein, 20 aa, Homo sapiens
SRDETPLCTIAHWQDSLAKR

SEQ ID NO: 2778 - protein, 20 aa, Homo sapiens
SRDETPLCTIAHWQDSLAKR

SEQ ID NO: 2779 - protein, 20 aa, Homo sapiens
SRDETPLCTIAHWQDSLAKR

SEQ ID NO: 2780 - protein, 20 aa, Homo sapiens
SRDETPLCTIAHWQDSLAKR

SEQ ID NO: 2781 - protein, 20 aa, Homo sapiens
SRDETPLCTIAHWQDSLAKR

SEQ ID NO: 2782 - protein, 18 aa, Homo sapiens
DETPLCTIAHWQDSLAKR

SEQ ID NO: 2783 - protein, 20 aa, Homo sapiens
SRDETPLCTIAHWQDSLAKR

SEQ ID NO: 2784 - protein, 20 aa, Homo sapiens
SRDETPLCTIAHWQDSLAKR

SEQ ID NO: 2785 - protein, 20 aa, Homo sapiens
SRDETPLCTIAHWQDSLAKR

SEQ ID NO: 2786 - protein, 20 aa, Homo sapiens
SRDETPLCTIAHWQDSLAKR

SEQ ID NO: 2787 - protein, 20 aa, Homo sapiens
SRDETPLCTIAHWQDSLAKR

SEQ ID NO: 2788 - protein, 14 aa, Homo sapiens
MEIQEAIKKPLTQK

SEQ ID NO: 2789 - protein, 14 aa, Homo sapiens
MEIQEAIKKPLTQK

SEQ ID NO: 2790 - protein, 10 aa, Homo sapiens
NIKLLEDEPR

SEQ ID NO: 2791 - protein, 10 aa, Homo sapiens
NIKLLEDEPR

SEQ ID NO: 2792 - protein, 10 aa, Homo sapiens
NIKLLEDEPR

SEQ ID NO: 2793 - protein, 12 aa, Homo sapiens
FPFGIQQAKSHR

SEQ ID NO: 2794 - protein, 12 aa, Homo sapiens
FPFGIQQAKSHR

SEQ ID NO: 2795 - protein, 10 aa, Homo sapiens
QEKFYATLVR

SEQ ID NO: 2796 - protein, 10 aa, Homo sapiens
QEKFYATLVR

SEQ ID NO: 2797 - protein, 10 aa, Homo sapiens
QEKFYATLVR

SEQ ID NO: 2798 - protein, 10 aa, Homo sapiens
QEKFYATLVR

SEQ ID NO: 2799 - protein, 10 aa, Homo sapiens
AAKALLAMAR

SEQ ID NO: 2800 - protein, 10 aa, Homo sapiens
NIKLLEDEPR

SEQ ID NO: 2801 - protein, 10 aa, Homo sapiens
NIKLLEDEPR

SEQ ID NO: 2802 - protein, 12 aa, Homo sapiens
HMDGMYGPPAKR

SEQ ID NO: 2803 - protein, 12 aa, Homo sapiens
HMDGMYGPPAKR

SEQ ID NO: 2804 - protein, 35 aa, Homo sapiens
VQEFNSGLLHWQLGGGDTTEHIQTHFESKMEIPPR

SEQ ID NO: 2805 - protein, 35 aa, Homo sapiens; identical to SEQ ID NO: 2804

SEQ ID NO: 2806 - protein, 16 aa, Homo sapiens
VREEVPLELVEAHVKK

SEQ ID NO: 2807 - protein, 7 aa, Homo sapiens
TDIYSKK

SEQ ID NO: 2808 - protein, 7 aa, Homo sapiens
TDIYSKK

SEQ ID NO: 2809 - protein, 32 aa, Homo sapiens
QQGGGMMMGPGGGGAASLSKAAAGSAAGGFQR

SEQ ID NO: 2810 - protein, 32 aa, Homo sapiens; identical to SEQ ID NO: 2809

SEQ ID NO: 2811 - protein, 32 aa, Homo sapiens; identical to SEQ ID NO: 2809

SEQ ID NO: 2812 - protein, 20 aa, Homo sapiens
HFEELETIMDREKEALEQQR

SEQ ID NO: 2813 - protein, 20 aa, Homo sapiens
HFEELETIMDREKEALEQQR

SEQ ID NO: 2814 - protein, 20 aa, Homo sapiens
HFEELETIMDREKEALEQQR

SEQ ID NO: 2815 - protein, 9 aa, Homo sapiens
EKEALEQQR

SEQ ID NO: 2816 - protein, 22 aa, Homo sapiens
AAIMQALWLYIKHNQLQDGHER

SEQ ID NO: 2817 - protein, 22 aa, Homo sapiens
AAIMQALWLYIKHNQLQDGHER

SEQ ID NO: 2818 - protein, 22 aa, Homo sapiens
AAIMQALWLYIKHNQLQDGHER

SEQ ID NO: 2819 - protein, 22 aa, Homo sapiens
AAIMQALWLYIKHNQLQDGHER

SEQ ID NO: 2820 - protein, 22 aa, Homo sapiens
AAIMQALWLYIKHNQLQDGHER

SEQ ID NO: 2821 - protein, 22 aa, Homo sapiens
AAIMQALWLYIKHNQLQDGHER

SEQ ID NO: 2822 - protein, 22 aa, Homo sapiens
AAIMQALWLYIKHNQLQDGHER

SEQ ID NO: 2823 - protein, 22 aa, Homo sapiens
AAIMQALWLYIKHNQLQDGHER

SEQ ID NO: 2824 - protein, 9 aa, Homo sapiens
HIFAKVQQR

SEQ ID NO: 2825 - protein, 9 aa, Homo sapiens
HIFAKVQQR

SEQ ID NO: 2826 - protein, 14 aa, Homo sapiens
QRGKGEITPAAIQK

SEQ ID NO: 2827 - protein, 15 aa, Homo sapiens
VASAAAKAALEEFSR

SEQ ID NO: 2828 - protein, 14 aa, Homo sapiens
TPTTQETDGFQVKR

SEQ ID NO: 2829 - protein, 24 aa, Homo sapiens
LQDSHDKEYINGDKYFQQIFDCPR

SEQ ID NO: 2830 - protein, 24 aa, Homo sapiens
LQDSHDKEYINGDKYFQQIFDCPR

SEQ ID NO: 2831 - protein, 24 aa, Homo sapiens
LQDSHDKEYINGDKYFQQIFDCPR

SEQ ID NO: 2832 - protein, 24 aa, Homo sapiens
LQDSHDKEYINGDKYFQQIFDCPR

SEQ ID NO: 2833 - protein, 24 aa, Homo sapiens
LQDSHDKEYINGDKYFQQIFDCPR

SEQ ID NO: 2834 - protein, 24 aa, Homo sapiens
LQDSHDKEYINGDKYFQQIFDCPR

SEQ ID NO: 2835 - protein, 17 aa, Homo sapiens
EYINGDKYFQQIFDCPR

SEQ ID NO: 2836 - protein, 24 aa, Homo sapiens
LQDSHDKEYINGDKYFQQIFDCPR

SEQ ID NO: 2837 - protein, 9 aa, Homo sapiens
YFYSKVQQR

SEQ ID NO: 2838 - protein, 19 aa, Homo sapiens
KRPAPQQIQQVQQQAVQNR

SEQ ID NO: 2839 - protein, 19 aa, Homo sapiens
KRPAPQQIQQVQQQAVQNR

SEQ ID NO: 2840 - protein, 15 aa, Homo sapiens
VASAAAKAALEEFSR

SEQ ID NO: 2841 - protein, 15 aa, Homo sapiens
VASAAAKAALEEFSR

SEQ ID NO: 2842 - protein, 17 aa, Homo sapiens
EFVICDKYLQQIFESQR

SEQ ID NO: 2843 - protein, 17 aa, Homo sapiens
EFVICDKYLQQIFESQR

SEQ ID NO: 2844 - protein, 24 aa, Homo sapiens
LQDPHEREFVICDKYLQQIFESQR

SEQ ID NO: 2845 - protein, 17 aa, Homo sapiens
EFVICDKYLQQIFESQR

SEQ ID NO: 2846 - protein, 24 aa, Homo sapiens
LQDPHEREFVICDKYLQQIFESQR

SEQ ID NO: 2847 - protein, 17 aa, Homo sapiens
EFVICDKYLQQIFESQR

SEQ ID NO: 2848 - protein, 24 aa, Homo sapiens
LQDPHEREFVICDKYLQQIFESQR

SEQ ID NO: 2849 - protein, 24 aa, Homo sapiens
LQDPHEREFVICDKYLQQIFESQR

SEQ ID NO: 2850 - protein, 17 aa, Homo sapiens
EFVICDKYLQQIFESQR

SEQ ID NO: 2851 - protein, 17 aa, Homo sapiens
EFVICDKYLQQIFESQR

SEQ ID NO: 2852 - protein, 17 aa, Homo sapiens
EFVICDKYLQQIFESQR

SEQ ID NO: 2853 - protein, 17 aa, Homo sapiens
EFVICDKYLQQIFESQR

SEQ ID NO: 2854 - protein, 24 aa, Homo sapiens
LQDPHEREFVICDKYLQQIFESQR

SEQ ID NO: 2855 - protein, 17 aa, Homo sapiens
EFVICDKYLQQIFESQR

SEQ ID NO: 2856 - protein, 17 aa, Homo sapiens
EFVICDKYLQQIFESQR

SEQ ID NO: 2857 - protein, 17 aa, Homo sapiens
EFVICDKYLQQIFESQR

SEQ ID NO: 2858 - protein, 17 aa, Homo sapiens
EFVICDKYLQQIFESQR

SEQ ID NO: 2859 - protein, 17 aa, Homo sapiens
EFVICDKYLQQIFESQR

SEQ ID NO: 2860 - protein, 17 aa, Homo sapiens
EFVICDKYLQQIFESQR

SEQ ID NO: 2861 - protein, 17 aa, Homo sapiens
EFVICDKYLQQIFESQR

SEQ ID NO: 2862 - protein, 17 aa, Homo sapiens
EFVICDKYLQQIFESQR

SEQ ID NO: 2863 - protein, 17 aa, Homo sapiens
EFVICDKYLQQIFESQR

SEQ ID NO: 2864 - protein, 17 aa, Homo sapiens
EFVICDKYLQQIFESQR

SEQ ID NO: 2865 - protein, 17 aa, Homo sapiens
EFVICDKYLQQIFESQR

SEQ ID NO: 2866 - protein, 17 aa, Homo sapiens
EFVICDKYLQQIFESQR

SEQ ID NO: 2867 - protein, 17 aa, Homo sapiens
EFVICDKYLQQIFESQR

SEQ ID NO: 2868 - protein, 14 aa, Homo sapiens
QNFHMEQLKYAELR

SEQ ID NO: 2869 - protein, 14 aa, Homo sapiens
QNFHMEQLKYAELR

SEQ ID NO: 2870 - protein, 14 aa, Homo sapiens
QNFHMEQLKYAELR

SEQ ID NO: 2871 - protein, 14 aa, Homo sapiens
QNFHMEQLKYAELR

SEQ ID NO: 2872 - protein, 14 aa, Homo sapiens
QNFHMEQLKYAELR

SEQ ID NO: 2873 - protein, 17 aa, Homo sapiens
THKLQDPHEREFVICDK

SEQ ID NO: 2874 - protein, 14 aa, Homo sapiens
QNFHMEQLKYAELR

SEQ ID NO: 2875 - protein, 14 aa, Homo sapiens
QNFHMEQLKYAELR

SEQ ID NO: 2876 - protein, 14 aa, Homo sapiens
QNFHMEQLKYAELR

SEQ ID NO: 2877 - protein, 14 aa, Homo sapiens
QNFHMEQLKYAELR

SEQ ID NO: 2878 - protein, 14 aa, Homo sapiens
QNFHMEQLKYAELR

SEQ ID NO: 2879 - protein, 14 aa, Homo sapiens
QNFHMEQLKYAELR

SEQ ID NO: 2880 - protein, 17 aa, Homo sapiens
THKLQDPHEREFVICDK

SEQ ID NO: 2881 - protein, 14 aa, Homo sapiens
QNFHMEQLKYAELR

SEQ ID NO: 2882 - protein, 17 aa, Homo sapiens
THKLQDPHEREFVICDK

SEQ ID NO: 2883 - protein, 14 aa, Homo sapiens
QNFHMEQLKYAELR

SEQ ID NO: 2884 - protein, 14 aa, Homo sapiens
QNFHMEQLKYAELR

SEQ ID NO: 2885 - protein, 17 aa, Homo sapiens
THKLQDPHEREFVICDK

SEQ ID NO: 2886 - protein, 17 aa, Homo sapiens
THKLQDPHEREFVICDK

SEQ ID NO: 2887 - protein, 14 aa, Homo sapiens
QNFHMEQLKYAELR

SEQ ID NO: 2888 - protein, 14 aa, Homo sapiens
QNFHMEQLKYAELR

SEQ ID NO: 2889 - protein, 14 aa, Homo sapiens
QNFHMEQLKYAELR

SEQ ID NO: 2890 - protein, 14 aa, Homo sapiens
QNFHMEQLKYAELR

SEQ ID NO: 2891 - protein, 14 aa, Homo sapiens
QNFHMEQLKYAELR

SEQ ID NO: 2892 - protein, 14 aa, Homo sapiens
QNFHMEQLKYAELR

SEQ ID NO: 2893 - protein, 14 aa, Homo sapiens
QNFHMEQLKYAELR

SEQ ID NO: 2894 - protein, 14 aa, Homo sapiens
QNFHMEQLKYAELR

SEQ ID NO: 2895 - protein, 14 aa, Homo sapiens
QNFHMEQLKYAELR

SEQ ID NO: 2896 - protein, 14 aa, Homo sapiens
QNFHMEQLKYAELR

SEQ ID NO: 2897 - protein, 14 aa, Homo sapiens
QNFHMEQLKYAELR

SEQ ID NO: 2898 - protein, 19 aa, Homo sapiens
KRPAPQQIQQVQQQAVQNR

SEQ ID NO: 2899 - protein, 19 aa, Homo sapiens
KRPAPQQIQQVQQQAVQNR

SEQ ID NO: 2900 - protein, 12 aa, Homo sapiens
TLAKSKGASAGR

SEQ ID NO: 2901 - protein, 18 aa, Homo sapiens
SPQVPAAQQMLNFPEKNK

SEQ ID NO: 2902 - protein, 11 aa, Homo sapiens
HQGTFTDEKSK

SEQ ID NO: 2903 - protein, 15 aa, Homo sapiens
MKEEVPTALVEAHVR

SEQ ID NO: 2904 - protein, 11 aa, Homo sapiens
KVEEAAKVTGK

SEQ ID NO: 2905 - protein, 15 aa, Homo sapiens
VASAAAKAALEEFSR

SEQ ID NO: 2906 - protein, 15 aa, Homo sapiens
VASAAAKAALEEFSR

SEQ ID NO: 2907 - protein, 15 aa, Homo sapiens
VASAAAKAALEEFSR

SEQ ID NO: 2908 - protein, 15 aa, Homo sapiens
VASAAAKAALEEFSR

SEQ ID NO: 2909 - protein, 15 aa, Homo sapiens
VASAAAKAALEEFSR

SEQ ID NO: 2910 - protein, 15 aa, Homo sapiens
VASAAAKAALEEFSR

SEQ ID NO: 2911 - protein, 15 aa, Homo sapiens
VASAAAKAALEEFSR

SEQ ID NO: 2912 - protein, 23 aa, Homo sapiens
SALEEFSKMKEEVPTALVEAHVR

SEQ ID NO: 2913 - protein, 23 aa, Homo sapiens
SALEEFSKMKEEVPTALVEAHVR

SEQ ID NO: 2914 - protein, 31 aa, Homo sapiens
DIGEGNLSTAAAAALAAAAVKAKHLAAVEER

SEQ ID NO: 2915 - protein, 23 aa, Homo sapiens
SALEEFSKMKEEVPTALVEAHVR

SEQ ID NO: 2916 - protein, 23 aa, Homo sapiens
SALEEFSKMKEEVPTALVEAHVR

SEQ ID NO: 2917 - protein, 23 aa, Homo sapiens
SALEEFSKMKEEVPTALVEAHVR

SEQ ID NO: 2918 - protein, 23 aa, Homo sapiens
SALEEFSKMKEEVPTALVEAHVR

SEQ ID NO: 2919 - protein, 23 aa, Homo sapiens
SALEEFSKMKEEVPTALVEAHVR

SEQ ID NO: 2920 - protein, 23 aa, Homo sapiens
SALEEFSKMKEEVPTALVEAHVR

SEQ ID NO: 2921 - protein, 23 aa, Homo sapiens
SALEEFSKMKEEVPTALVEAHVR

SEQ ID NO: 2922 - protein, 23 aa, Homo sapiens
SALEEFSKMKEEVPTALVEAHVR

SEQ ID NO: 2923 - protein, 23 aa, Homo sapiens
SALEEFSKMKEEVPTALVEAHVR

SEQ ID NO: 2924 - protein, 23 aa, Homo sapiens
SALEEFSKMKEEVPTALVEAHVR

SEQ ID NO: 2925 - protein, 15 aa, Homo sapiens
VASAAAKAALEEFSR

SEQ ID NO: 2926 - protein, 7 aa, Homo sapiens
TDMYTKK

SEQ ID NO: 2927 - protein, 7 aa, Homo sapiens
KVQEAAR

SEQ ID NO: 2928 - protein, 7 aa, Homo sapiens
KVQEAAR

SEQ ID NO: 2929 - protein, 15 aa, Homo sapiens
VASAAAKSALEEFSK

SEQ ID NO: 2930 - protein, 22 aa, Homo sapiens
AGGALCHILGAAYKYKNEQGWR

SEQ ID NO: 2931 - protein, 18 aa, Homo sapiens
ISAKTLTDEVNSPDSDRR

SEQ ID NO: 2932 - protein, 9 aa, Homo sapiens
KKDGGPNVK

SEQ ID NO: 2933 - protein, 20 aa, Homo sapiens
HFEELETIMDREKEALEQQR

SEQ ID NO: 2934 - protein, 20 aa, Homo sapiens
HFEELETIMDREKEALEQQR

SEQ ID NO: 2935 - protein, 20 aa, Homo sapiens
HFEELETIMDREKEALEQQR

SEQ ID NO: 2936 - protein, 15 aa, Homo sapiens
KFLESTDSFNNELKR

SEQ ID NO: 2937 - protein, 20 aa, Homo sapiens
HFEELETIMDREKEALEQQR

SEQ ID NO: 2938 - protein, 20 aa, Homo sapiens
HFEELETIMDREKEALEQQR

SEQ ID NO: 2939 - protein, 20 aa, Homo sapiens
HFEELETIMDREKEALEQQR

SEQ ID NO: 2940 - protein, 20 aa, Homo sapiens
HFEELETIMDREKEALEQQR

SEQ ID NO: 2941 - protein, 20 aa, Homo sapiens
HFEELETIMDREKEALEQQR

SEQ ID NO: 2942 - protein, 20 aa, Homo sapiens
HFEELETIMDREKEALEQQR

SEQ ID NO: 2943 - protein, 20 aa, Homo sapiens
HFEELETIMDREKEALEQQR

SEQ ID NO: 2944 - protein, 20 aa, Homo sapiens
HFEELETIMDREKEALEQQR

SEQ ID NO: 2945 - protein, 20 aa, Homo sapiens
HFEELETIMDREKEALEQQR

SEQ ID NO: 2946 - protein, 15 aa, Homo sapiens
KFLESTDSFNNELKR

SEQ ID NO: 2947 - protein, 20 aa, Homo sapiens
HFEELETIMDREKEALEQQR

SEQ ID NO: 2948 - protein, 20 aa, Homo sapiens
HFEELETIMDREKEALEQQR

SEQ ID NO: 2949 - protein, 20 aa, Homo sapiens
HFEELETIMDREKEALEQQR

SEQ ID NO: 2950 - protein, 20 aa, Homo sapiens
HFEELETIMDREKEALEQQR

SEQ ID NO: 2951 - protein, 20 aa, Homo sapiens
HFEELETIMDREKEALEQQR

SEQ ID NO: 2952 - protein, 20 aa, Homo sapiens
HFEELETIMDREKEALEQQR

SEQ ID NO: 2953 - protein, 20 aa, Homo sapiens
HFEELETIMDREKEALEQQR

SEQ ID NO: 2954 - protein, 20 aa, Homo sapiens
HFEELETIMDREKEALEQQR

SEQ ID NO: 2955 - protein, 25 aa, Homo sapiens
LCGLKVEVDMEKIAAEIAQAEEQAR

SEQ ID NO: 2956 - protein, 20 aa, Homo sapiens
VEVDMEKIAAEIAQAEEQAR

SEQ ID NO: 2957 - protein, 25 aa, Homo sapiens
LCGLKVEVDMEKIAAEIAQAEEQAR

SEQ ID NO: 2958 - protein, 7 aa, Homo sapiens
KVQEAAR

SEQ ID NO: 2959 - protein, 7 aa, Homo sapiens
KVQEAAR

SEQ ID NO: 2960 - protein, 7 aa, Homo sapiens
KVQEAAR

SEQ ID NO: 2961 - protein, 16 aa, Homo sapiens
VREEVPLELVEAHVKK

SEQ ID NO: 2962 - protein, 16 aa, Homo sapiens
VREEVPLELVEAHVKK

SEQ ID NO: 2963 - protein, 16 aa, Homo sapiens
RKHSPSPPPPTPTESR

SEQ ID NO: 2964 - protein, 27 aa, Homo sapiens
KVEHEISEGNVATAAAAALASAATKAK

SEQ ID NO: 2965 - protein, 26 aa, Homo sapiens
VEHEISEGNVATAAAAALASAATKAK

SEQ ID NO: 2966 - protein, 26 aa, Homo sapiens
VEHEISEGNVATAAAAALASAATKAK

SEQ ID NO: 2967 - protein, 26 aa, Homo sapiens
VEHEISEGNVATAAAAALASAATKAK

SEQ ID NO: 2968 - protein, 27 aa, Homo sapiens
KVEHEISEGNVATAAAAALASAATKAK

SEQ ID NO: 2969 - protein, 27 aa, Homo sapiens
KVEHEISEGNVATAAAAALASAATKAK

SEQ ID NO: 2970 - protein, 27 aa, Homo sapiens
KVEHEISEGNVATAAAAALASAATKAK

SEQ ID NO: 2971 - protein, 27 aa, Homo sapiens
KVEHEISEGNVATAAAAALASAATKAK

SEQ ID NO: 2972 - protein, 26 aa, Homo sapiens
VEHEISEGNVATAAAAALASAATKAK

SEQ ID NO: 2973 - protein, 26 aa, Homo sapiens
VEHEISEGNVATAAAAALASAATKAK

SEQ ID NO: 2974 - protein, 12 aa, Homo sapiens
PYACDICGKRYK

SEQ ID NO: 2975 - protein, 7 aa, Homo sapiens
TDPLEKR

SEQ ID NO: 2976 - protein, 8 aa, Homo sapiens
SVTGKIQK

SEQ ID NO: 2977 - protein, 8 aa, Homo sapiens
SVTGKIQK

SEQ ID NO: 2978 - protein, 8 aa, Homo sapiens
SVTGKIQK

SEQ ID NO: 2979 - protein, 8 aa, Homo sapiens
SVTGKIQK

SEQ ID NO: 2980 - protein, 17 aa, Homo sapiens
IQKLTKAVATYHANTER

SEQ ID NO: 2981 - protein, 17 aa, Homo sapiens
IQKLTKAVATYHANTER

SEQ ID NO: 2982 - protein, 7 aa, Homo sapiens
AKDDIKR

SEQ ID NO: 2983 - protein, 7 aa, Homo sapiens
AKDDIKR

SEQ ID NO: 2984 - protein, 10 aa, Homo sapiens
VSYKGSPAAR

SEQ ID NO: 2985 - protein, 10 aa, Homo sapiens
VSYKGSPAAR

SEQ ID NO: 2986 - protein, 10 aa, Homo sapiens
VSYKGSPAAR

SEQ ID NO: 2987 - protein, 10 aa, Homo sapiens
VSYKGSPAAR

SEQ ID NO: 2988 - protein, 10 aa, Homo sapiens
VSYKGSPAAR

SEQ ID NO: 2989 - protein, 9 aa, Homo sapiens
VMAAIEKVR

SEQ ID NO: 2990 - protein, 10 aa, Homo sapiens
ITEKLEKQQK

SEQ ID NO: 2991 - protein, 10 aa, Homo sapiens
VSYKGSPAAR

SEQ ID NO: 2992 - protein, 10 aa, Homo sapiens
VSYKGSPAAR

SEQ ID NO: 2993 - protein, 10 aa, Homo sapiens
VSYKGSPAAR

SEQ ID NO: 2994 - protein, 7 aa, Homo sapiens
AKDDIKR

SEQ ID NO: 2995 - protein, 16 aa, Homo sapiens
KRDSDAGSSTPTTSTR

SEQ ID NO: 2996 - protein, 7 aa, Homo sapiens
AKDDIKR

SEQ ID NO: 2997 - protein, 7 aa, Homo sapiens
AKDDIKR

SEQ ID NO: 2998 - protein, 11 aa, Homo sapiens
WKYMIVDEGHR

SEQ ID NO: 2999 - protein, 11 aa, Homo sapiens
WKYMIVDEGHR

SEQ ID NO: 3000 - protein, 11 aa, Homo sapiens
WKYMIVDEGHR

SEQ ID NO: 3001 - protein, 11 aa, Homo sapiens
WKYMIVDEGHR

SEQ ID NO: 3002 - protein, 11 aa, Homo sapiens
WKYMIVDEGHR

SEQ ID NO: 3003 - protein, 7 aa, Homo sapiens
AKDDIKR

SEQ ID NO: 3004 - protein, 10 aa, Homo sapiens
ISYKGTPAMR

SEQ ID NO: 3005 - protein, 6 aa, Homo sapiens
EQKAKR

SEQ ID NO: 3006 - protein, 25 aa, Homo sapiens
GQLSWHQKTYAFSENPLPTVEIAIR

SEQ ID NO: 3007 - protein, 25 aa, Homo sapiens
GQLSWHQKTYAFSENPLPTVEIAIR

SEQ ID NO: 3008 - protein, 25 aa, Homo sapiens
GQLSWHQKTYAFSENPLPTVEIAIR

SEQ ID NO: 3009 - protein, 6 aa, Homo sapiens
EQKAKR

SEQ ID NO: 3010 - protein, 15 aa, Homo sapiens
YKAVSISTEPPTYLR

SEQ ID NO: 3011 - protein, 29 aa, Homo sapiens
ASEVEEILDGNDEKYKAVSISTEPPTYLR

SEQ ID NO: 3012 - protein, 15 aa, Homo sapiens
YKAVSISTEPPTYLR

SEQ ID NO: 3013 - protein, 29 aa, Homo sapiens
ASEVEEILDGNDEKYKAVSISTEPPTYLR

SEQ ID NO: 3014 - protein, 16 aa, Homo sapiens
ASEVEEILDGNDEKYK

SEQ ID NO: 3015 - protein, 16 aa, Homo sapiens
ASEVEEILDGNDEKYK

SEQ ID NO: 3016 - protein, 9 aa, Homo sapiens
VMAAIEKVR

SEQ ID NO: 3017 - protein, 9 aa, Homo sapiens
VMAAIEKVR

SEQ ID NO: 3018 - protein, 11 aa, Homo sapiens
IYKWVPVTEPK

SEQ ID NO: 3019 - protein, 15 aa, Homo sapiens
MKEEVPTALVEAHVR

SEQ ID NO: 3020 - protein, 11 aa, Homo sapiens
HQGTFTDEKSK

SEQ ID NO: 3021 - protein, 11 aa, Homo sapiens
HQGTFTDEKSK

SEQ ID NO: 3022 - protein, 8 aa, Homo sapiens
RRKMADKV

SEQ ID NO: 3023 - protein, 12 aa, Homo sapiens
MAADEVAGGARK

SEQ ID NO: 3024 - protein, 9 aa, Homo sapiens
RKLIDQKKD

SEQ ID NO: 3025 - protein, 8 aa, Homo sapiens
REQKAKRN

SEQ ID NO: 3026 - protein, 8 aa, Homo sapiens
RGSLYKRY

SEQ ID NO: 3027 - protein, 8 aa, Homo sapiens
RGSLYKRY

SEQ ID NO: 3028 - protein, 8 aa, Homo sapiens
RGSLYKRY

SEQ ID NO: 3029 - protein, 8 aa, Homo sapiens
RGSLYKRY

SEQ ID NO: 3030 - protein, 8 aa, Homo sapiens
RGSLYKRY

SEQ ID NO: 3031 - protein, 8 aa, Homo sapiens
RGSLYKRY

SEQ ID NO: 3032 - protein, 8 aa, Homo sapiens
RGSLYKRY

SEQ ID NO: 3033 - protein, 8 aa, Homo sapiens
RGSLYKRY

SEQ ID NO: 3034 - protein, 8 aa, Homo sapiens
RGSLYKRY

SEQ ID NO: 3035 - protein, 13 aa, Homo sapiens
RHQGTFTDEKSKA

SEQ ID NO: 3036 - protein, 9 aa, Homo sapiens
RKASANARK

SEQ ID NO: 3037 - protein, 8 aa, Homo sapiens
RKPVDFKK

SEQ ID NO: 3038 - protein, 7 aa, Homo sapiens
RIEKERM

SEQ ID NO: 3039 - protein, 7 aa, Homo sapiens
RNHKYRS

SEQ ID NO: 3040 - protein, 9 aa, Homo sapiens
RIRNHKYRS

SEQ ID NO: 3041 - protein, 9 aa, Homo sapiens
RKASANARK

SEQ ID NO: 3042 - protein, 9 aa, Homo sapiens
RIRNHKYRS

SEQ ID NO: 3043 - protein, 7 aa, Homo sapiens
RNHKYRS

SEQ ID NO: 3044 - protein, 8 aa, Homo sapiens
KLIDQKKD

SEQ ID NO: 3045 - protein, 16 aa, Homo sapiens
KGGAKTLMNTIMQLRK

SEQ ID NO: 3046 - protein, 16 aa, Homo sapiens
KGGAKTLMNTIMQLRK

SEQ ID NO: 3047 - protein, 14 aa, Homo sapiens
KEKPVDLQNFGLRT

SEQ ID NO: 3048 - protein, 9 aa, Homo sapiens
KKVQEAARA

SEQ ID NO: 3049 - protein, 9 aa, Homo sapiens
RTDIYSKKT

SEQ ID NO: 3050 - protein, 7 aa, Homo sapiens
RKMADKV

SEQ ID NO: 3051 - protein, 12 aa, Homo sapiens
RASGKFELLDRI

SEQ ID NO: 3052 - protein, 6 aa, Homo sapiens
KKNAKK

SEQ ID NO: 3053 - protein, 10 aa, Homo sapiens
RNVDKDPAKE

SEQ ID NO: 3054 - protein, 10 aa, Homo sapiens
RNVDKDPAKE

SEQ ID NO: 3055 - protein, 10 aa, Homo sapiens
RNVDKDPAKE

SEQ ID NO: 3056 - protein, 10 aa, Homo sapiens
RNVDKDPAKE

SEQ ID NO: 3057 - protein, 16 aa, Homo sapiens
RQAFHMEQLKYAEMRA

SEQ ID NO: 3058 - protein, 16 aa, Homo sapiens
RQAFHMEQLKYAEMRA

SEQ ID NO: 3059 - protein, 16 aa, Homo sapiens
RQAFHMEQLKYAEMRA

SEQ ID NO: 3060 - protein, 11 aa, Homo sapiens
RHIFAKVQQRR

SEQ ID NO: 3061 - protein, 11 aa, Homo sapiens
RHIFAKVQQRR

SEQ ID NO: 3062 - protein, 11 aa, Homo sapiens
RHIFAKVQQRR

SEQ ID NO: 3063 - protein, 11 aa, Homo sapiens
RHIFAKVQQRR

SEQ ID NO: 3064 - protein, 11 aa, Homo sapiens
RHIFAKVQQRR

SEQ ID NO: 3065 - protein, 11 aa, Homo sapiens
RHIFAKVQQRR

SEQ ID NO: 3066 - protein, 10 aa, Homo sapiens
KFKSDQGWRR

SEQ ID NO: 3067 - protein, 12 aa, Homo sapiens
KAKHLAAVEERK

SEQ ID NO: 3068 - protein, 9 aa, Homo sapiens
KKLEIKLRH

SEQ ID NO: 3069 - protein, 8 aa, Homo sapiens
KLEIKLRH

SEQ ID NO: 3070 - protein, 8 aa, Homo sapiens
KLEIKLRH

SEQ ID NO: 3071 - protein, 9 aa, Homo sapiens
KKLEIKLRH

SEQ ID NO: 3072 - protein, 9 aa, Homo sapiens
KKLEIKLRH

SEQ ID NO: 3073 - protein, 8 aa, Homo sapiens
KLEIKLRH

SEQ ID NO: 3074 - protein, 11 aa, Homo sapiens
RHIFAKVQQRR

SEQ ID NO: 3075 - protein, 15 aa, Homo sapiens
KSLVALLVETQMKKL

SEQ ID NO: 3076 - protein, 15 aa, Homo sapiens
KSLVALLVETQMKKL

SEQ ID NO: 3077 - protein, 14 aa, Homo sapiens
RKLEAELLQIEERH

SEQ ID NO: 3078 - protein, 14 aa, Homo sapiens
RKLEAELLQIEERH

SEQ ID NO: 3079 - protein, 15 aa, Homo sapiens
KSLVALLVETQMKKL

SEQ ID NO: 3080 - protein, 14 aa, Homo sapiens
RKLEAELLQIEERH

SEQ ID NO: 3081 - protein, 14 aa, Homo sapiens
RKLEAELLQIEERH

SEQ ID NO: 3082 - protein, 15 aa, Homo sapiens
KSLVALLVETQMKKL

SEQ ID NO: 3083 - protein, 7 aa, Homo sapiens
KKLEIKL

SEQ ID NO: 3084 - protein, 7 aa, Homo sapiens
KKLEIKL

SEQ ID NO: 3085 - protein, 7 aa, Homo sapiens
KKLEIKL

SEQ ID NO: 3086 - protein, 7 aa, Homo sapiens
KKLEIKL

SEQ ID NO: 3087 - protein, 7 aa, Homo sapiens
KKLEIKL

SEQ ID NO: 3088 - protein, 7 aa, Homo sapiens
KKLEIKL

SEQ ID NO: 3089 - protein, 7 aa, Homo sapiens
KKLEIKL

SEQ ID NO: 3090 - protein, 7 aa, Homo sapiens
KKLEIKL

SEQ ID NO: 3091 - protein, 7 aa, Homo sapiens
KKLEIKL

SEQ ID NO: 3092 - protein, 7 aa, Homo sapiens
KKLEIKL

SEQ ID NO: 3093 - protein, 8 aa, Homo sapiens
RMQVLKRQ

SEQ ID NO: 3094 - protein, 8 aa, Homo sapiens
RMQVLKRQ

SEQ ID NO: 3095 - protein, 8 aa, Homo sapiens
RMQVLKRQ

SEQ ID NO: 3096 - protein, 8 aa, Homo sapiens
RMQVLKRQ

SEQ ID NO: 3097 - protein, 8 aa, Homo sapiens
RMQVLKRQ

SEQ ID NO: 3098 - protein, 8 aa, Homo sapiens
RMQVLKRQ

SEQ ID NO: 3099 - protein, 8 aa, Homo sapiens
RMQVLKRQ

SEQ ID NO: 3100 - protein, 8 aa, Homo sapiens
RMQVLKRQ

SEQ ID NO: 3101 - protein, 8 aa, Homo sapiens
RKTKVERD

SEQ ID NO: 3102 - protein, 8 aa, Homo sapiens
RMQVLKRQ

SEQ ID NO: 3103 - protein, 8 aa, Homo sapiens
RMQVLKRQ

SEQ ID NO: 3104 - protein, 8 aa, Homo sapiens
RMQVLKRQ

SEQ ID NO: 3105 - protein, 8 aa, Homo sapiens
RMQVLKRQ

SEQ ID NO: 3106 - protein, 8 aa, Homo sapiens
RMQVLKRQ

SEQ ID NO: 3107 - protein, 8 aa, Homo sapiens
RMQVLKRQ

SEQ ID NO: 3108 - protein, 8 aa, Homo sapiens
RMQVLKRQ

SEQ ID NO: 3109 - protein, 8 aa, Homo sapiens
RMQVLKRQ

SEQ ID NO: 3110 - protein, 8 aa, Homo sapiens
RMQVLKRQ

SEQ ID NO: 3111 - protein, 8 aa, Homo sapiens
RMQVLKRQ

SEQ ID NO: 3112 - protein, 7 aa, Homo sapiens
RHQEKKR

SEQ ID NO: 3113 - protein, 8 aa, Homo sapiens
RHQEKKRK

SEQ ID NO: 3114 - protein, 9 aa, Homo sapiens
KKLEIKLRH

SEQ ID NO: 3115 - protein, 8 aa, Homo sapiens
KLEIKLRH

SEQ ID NO: 3116 - protein, 8 aa, Homo sapiens
KLEIKLRH

SEQ ID NO: 3117 - protein, 9 aa, Homo sapiens
KKLEIKLRH

SEQ ID NO: 3118 - protein, 16 aa, Homo sapiens
KNYKKYIQAEPPTNKS

SEQ ID NO: 3119 - protein, 9 aa, Homo sapiens
RKVEEAAKV

SEQ ID NO: 3120 - protein, 10 aa, Homo sapiens
RKLDQTIMRK

SEQ ID NO: 3121 - protein, 10 aa, Homo sapiens
RKLDQTIMRK

SEQ ID NO: 3122 - protein, 15 aa, Homo sapiens
KSLVALLVETQMKKL

SEQ ID NO: 3123 - protein, 12 aa, Homo sapiens
KTHKLQDPHERE

SEQ ID NO: 3124 - protein, 12 aa, Homo sapiens
KTHKLQDPHERE

SEQ ID NO: 3125 - protein, 12 aa, Homo sapiens
KTHKLQDPHERE

SEQ ID NO: 3126 - protein, 12 aa, Homo sapiens
KTHKLQDPHERE

SEQ ID NO: 3127 - protein, 12 aa, Homo sapiens
KTHKLQDPHERE

SEQ ID NO: 3128 - protein, 12 aa, Homo sapiens
KTHKLQDPHERE

SEQ ID NO: 3129 - protein, 16 aa, Homo sapiens
RQAFHMEQLKYAEMRA

SEQ ID NO: 3130 - protein, 8 aa, Homo sapiens
KLEIKLRH

SEQ ID NO: 3131 - protein, 7 aa, Homo sapiens
RHQEKKR

SEQ ID NO: 3132 - protein, 7 aa, Homo sapiens
RHQEKKR

SEQ ID NO: 3133 - protein, 16 aa, Homo sapiens
RLLEDSALSKYDATKQ

SEQ ID NO: 3134 - protein, 16 aa, Homo sapiens
RLLEDSALSKYDATKQ

SEQ ID NO: 3135 - protein, 16 aa, Homo sapiens
RLLEDSALSKYDATKQ

SEQ ID NO: 3136 - protein, 16 aa, Homo sapiens
RLLEDSALSKYDATKQ

SEQ ID NO: 3137 - protein, 16 aa, Homo sapiens
RLLEDSALSKYDATKQ

SEQ ID NO: 3138 - protein, 16 aa, Homo sapiens
RLLEDSALSKYDATKQ

SEQ ID NO: 3139 - protein, 16 aa, Homo sapiens
RLLEDSALSKYDATKQ

SEQ ID NO: 3140 - protein, 16 aa, Homo sapiens
RLLEDSALSKYDATKQ

SEQ ID NO: 3141 - protein, 16 aa, Homo sapiens
RLLEDSALSKYDATKQ

SEQ ID NO: 3142 - protein, 21 aa, Homo sapiens
RKRPAPQQIQQVQQQAVQNRN

SEQ ID NO: 3143 - protein, 21 aa, Homo sapiens
RKRPAPQQIQQVQQQAVQNRN

SEQ ID NO: 3144 - protein, 21 aa, Homo sapiens
RKRPAPQQIQQVQQQAVQNRN

SEQ ID NO: 3145 - protein, 21 aa, Homo sapiens
RKRPAPQQIQQVQQQAVQNRN

SEQ ID NO: 3146 - protein, 21 aa, Homo sapiens
RKRPAPQQIQQVQQQAVQNRN

SEQ ID NO: 3147 - protein, 21 aa, Homo sapiens
RKRPAPQQIQQVQQQAVQNRN

SEQ ID NO: 3148 - protein, 14 aa, Homo sapiens
RKLEAELLQIEERH

SEQ ID NO: 3149 - protein, 14 aa, Homo sapiens
RKLEAELLQIEERH

SEQ ID NO: 3150 - protein, 14 aa, Homo sapiens
RKLEAELLQIEERH

SEQ ID NO: 3151 - protein, 14 aa, Homo sapiens
RKLEAELLQIEERH

SEQ ID NO: 3152 - protein, 14 aa, Homo sapiens
RKLEAELLQIEERH

SEQ ID NO: 3153 - protein, 14 aa, Homo sapiens
RKLEAELLQIEERH

SEQ ID NO: 3154 - protein, 14 aa, Homo sapiens
RKLEAELLQIEERH

SEQ ID NO: 3155 - protein, 19 aa, Homo sapiens
KAYHNSPAYLAYINAKSRA

SEQ ID NO: 3156 - protein, 14 aa, Homo sapiens
RGKGEITPAAIQKM

SEQ ID NO: 3157 - protein, 14 aa, Homo sapiens
RGKGEITPAAIQKM

SEQ ID NO: 3158 - protein, 12 aa, Homo sapiens
KSSEAIKESSKF

SEQ ID NO: 3159 - protein, 12 aa, Homo sapiens
KSSEAIKESSKF

SEQ ID NO: 3160 - protein, 21 aa, Homo sapiens
KFLESTDSFNNELKRLCGLKV

SEQ ID NO: 3161 - protein, 16 aa, Homo sapiens
KFLESTDSFNNELKRL

SEQ ID NO: 3162 - protein, 12 aa, Homo sapiens
KSSEAIKESSKF

SEQ ID NO: 3163 - protein, 12 aa, Homo sapiens
KSSEAIKESSKF

SEQ ID NO: 3164 - protein, 19 aa, Homo sapiens
KAYHNSPAYLAYINAKSRA

SEQ ID NO: 3165 - protein, 8 aa, Homo sapiens
RMQVLKRQ

SEQ ID NO: 3166 - protein, 8 aa, Homo sapiens
RMQVLKRQ

SEQ ID NO: 3167 - protein, 15 aa, Homo sapiens
RLTMKDIGTPEAWRV

SEQ ID NO: 3168 - protein, 15 aa, Homo sapiens
RLTMKDIGTPEAWRV

SEQ ID NO: 3169 - protein, 15 aa, Homo sapiens
RLTMKDIGTPEAWRV

SEQ ID NO: 3170 - protein, 15 aa, Homo sapiens
RLTMKDIGTPEAWRV

SEQ ID NO: 3171 - protein, 15 aa, Homo sapiens
RLTMKDIGTPEAWRV

SEQ ID NO: 3172 - protein, 16 aa, Homo sapiens
RRLTMKDIGTPEAWRV

SEQ ID NO: 3173 - protein, 15 aa, Homo sapiens
RLTMKDIGTPEAWRV

SEQ ID NO: 3174 - protein, 15 aa, Homo sapiens
RLTMKDIGTPEAWRV

SEQ ID NO: 3175 - protein, 16 aa, Homo sapiens
RRLTMKDIGTPEAWRV

SEQ ID NO: 3176 - protein, 16 aa, Homo sapiens
RRLTMKDIGTPEAWRV

SEQ ID NO: 3177 - protein, 16 aa, Homo sapiens
RRLTMKDIGTPEAWRV

SEQ ID NO: 3178 - protein, 16 aa, Homo sapiens
RRLTMKDIGTPEAWRV

SEQ ID NO: 3179 - protein, 16 aa, Homo sapiens
RRLTMKDIGTPEAWRV

SEQ ID NO: 3180 - protein, 16 aa, Homo sapiens
RRLTMKDIGTPEAWRV

SEQ ID NO: 3181 - protein, 15 aa, Homo sapiens
RLTMKDIGTPEAWRV

SEQ ID NO: 3182 - protein, 16 aa, Homo sapiens
RRLTMKDIGTPEAWRV

SEQ ID NO: 3183 - protein, 15 aa, Homo sapiens
RLTMKDIGTPEAWRV

SEQ ID NO: 3184 - protein, 16 aa, Homo sapiens
RRLTMKDIGTPEAWRV

SEQ ID NO: 3185 - protein, 15 aa, Homo sapiens
RLTMKDIGTPEAWRV

SEQ ID NO: 3186 - protein, 16 aa, Homo sapiens
RRLTMKDIGTPEAWRV

SEQ ID NO: 3187 - protein, 16 aa, Homo sapiens
RRLTMKDIGTPEAWRV

SEQ ID NO: 3188 - protein, 16 aa, Homo sapiens
RRLTMKDIGTPEAWRV

SEQ ID NO: 3189 - protein, 15 aa, Homo sapiens
RLTMKDIGTPEAWRV

SEQ ID NO: 3190 - protein, 16 aa, Homo sapiens
RRLTMKDIGTPEAWRV

SEQ ID NO: 3191 - protein, 16 aa, Homo sapiens
RRLTMKDIGTPEAWRV

SEQ ID NO: 3192 - protein, 8 aa, Homo sapiens
RMQVLKRQ

SEQ ID NO: 3193 - protein, 8 aa, Homo sapiens
RMQVLKRQ

SEQ ID NO: 3194 - protein, 17 aa, Homo sapiens
RKFLESTDSFNNELKRL

SEQ ID NO: 3195 - protein, 8 aa, Homo sapiens
RKNPVCRE

SEQ ID NO: 3196 - protein, 8 aa, Homo sapiens
RKNPVCRE

SEQ ID NO: 3197 - protein, 8 aa, Homo sapiens
RKNPVCRE

SEQ ID NO: 3198 - protein, 8 aa, Homo sapiens
RKNPVCRE

SEQ ID NO: 3199 - protein, 8 aa, Homo sapiens
RKNPVCRE

SEQ ID NO: 3200 - protein, 10 aa, Homo sapiens
RKLDQTIMRK

SEQ ID NO: 3201 - protein, 10 aa, Homo sapiens
RKLDQTIMRK

SEQ ID NO: 3202 - protein, 10 aa, Homo sapiens
RKLDQTIMRK

SEQ ID NO: 3203 - protein, 10 aa, Homo sapiens
RKLDQTIMRK

SEQ ID NO: 3204 - protein, 10 aa, Homo sapiens
RKLDQTIMRK

SEQ ID NO: 3205 - protein, 16 aa, Homo sapiens
RMSYEPNKDPYGSMRK

SEQ ID NO: 3206 - protein, 16 aa, Homo sapiens
RMSYEPNKDPYGSMRK

SEQ ID NO: 3207 - protein, 16 aa, Homo sapiens
RMSYEPNKDPYGSMRK

SEQ ID NO: 3208 - protein, 22 aa, Homo sapiens
RRDITFPPGSVEATQPVLKQRR

SEQ ID NO: 3209 - protein, 22 aa, Homo sapiens
RRDITFPPGSVEATQPVLKQRR

SEQ ID NO: 3210 - protein, 22 aa, Homo sapiens
RRDITFPPGSVEATQPVLKQRR

SEQ ID NO: 3211 - protein, 22 aa, Homo sapiens
RRDITFPPGSVEATQPVLKQRR

SEQ ID NO: 3212 - protein, 21 aa, Homo sapiens
RDITFPPGSVEATQPVLKQRR

SEQ ID NO: 3213 - protein, 21 aa, Homo sapiens
RDITFPPGSVEATQPVLKQRR

SEQ ID NO: 3214 - protein, 10 aa, Homo sapiens
RKLDQTIMRK

SEQ ID NO: 3215 - protein, 10 aa, Homo sapiens
RKLDQTIMRK

SEQ ID NO: 3216 - protein, 10 aa, Homo sapiens
RKLDQTIMRK

SEQ ID NO: 3217 - protein, 10 aa, Homo sapiens
RKLDQTIMRK

SEQ ID NO: 3218 - protein, 10 aa, Homo sapiens
RKLDQTIMRK

SEQ ID NO: 3219 - protein, 10 aa, Homo sapiens
RKLDQTIMRK

SEQ ID NO: 3220 - protein, 10 aa, Homo sapiens
RKLDQTIMRK

SEQ ID NO: 3221 - protein, 11 aa, Homo sapiens
RKLDQTIMRKR

SEQ ID NO: 3222 - protein, 10 aa, Homo sapiens
RKLDQTIMRK

SEQ ID NO: 3223 - protein, 11 aa, Homo sapiens
RKLDQTIMRKR

SEQ ID NO: 3224 - protein, 10 aa, Homo sapiens
RKLDQTIMRK

SEQ ID NO: 3225 - protein, 11 aa, Homo sapiens
RKLDQTIMRKR

SEQ ID NO: 3226 - protein, 10 aa, Homo sapiens
RKLDQTIMRK

SEQ ID NO: 3227 - protein, 11 aa, Homo sapiens
RKLDQTIMRKR

SEQ ID NO: 3228 - protein, 11 aa, Homo sapiens
RKLDQTIMRKR

SEQ ID NO: 3229 - protein, 11 aa, Homo sapiens
RKLDQTIMRKR

SEQ ID NO: 3230 - protein, 21 aa, Homo sapiens
RKRPAPQQIQQVQQQAVQNRN

SEQ ID NO: 3231 - protein, 21 aa, Homo sapiens
RKRPAPQQIQQVQQQAVQNRN

SEQ ID NO: 3232 - protein, 15 aa, Homo sapiens
RLTMKDIGTPEAWRV

SEQ ID NO: 3233 - protein, 15 aa, Homo sapiens
RLTMKDIGTPEAWRV

SEQ ID NO: 3234 - protein, 16 aa, Homo sapiens
RRLTMKDIGTPEAWRV

SEQ ID NO: 3235 - protein, 15 aa, Homo sapiens
RLTMKDIGTPEAWRV

SEQ ID NO: 3236 - protein, 15 aa, Homo sapiens
RLTMKDIGTPEAWRV

SEQ ID NO: 3237 - protein, 15 aa, Homo sapiens
RLTMKDIGTPEAWRV

SEQ ID NO: 3238 - protein, 16 aa, Homo sapiens
RRLTMKDIGTPEAWRV

SEQ ID NO: 3239 - protein, 16 aa, Homo sapiens
RRLTMKDIGTPEAWRV

SEQ ID NO: 3240 - protein, 15 aa, Homo sapiens
RLTMKDIGTPEAWRV

SEQ ID NO: 3241 - protein, 15 aa, Homo sapiens
RLTMKDIGTPEAWRV

SEQ ID NO: 3242 - protein, 10 aa, Homo sapiens
RKLDQTIMRK

SEQ ID NO: 3243 - protein, 10 aa, Homo sapiens
RKLDQTIMRK

SEQ ID NO: 3244 - protein, 8 aa, Homo sapiens
RKNPVCRE

SEQ ID NO: 3245 - protein, 8 aa, Homo sapiens
RKNPVCRE

SEQ ID NO: 3246 - protein, 8 aa, Homo sapiens
RKNPVCRE

SEQ ID NO: 3247 - protein, 8 aa, Homo sapiens
RKNPVCRE

SEQ ID NO: 3248 - protein, 8 aa, Homo sapiens
RKNPVCRE

SEQ ID NO: 3249 - protein, 8 aa, Homo sapiens
RKNPVCRE

SEQ ID NO: 3250 - protein, 8 aa, Homo sapiens
RKNPVCRE

SEQ ID NO: 3251 - protein, 8 aa, Homo sapiens
RKNPVCRE

SEQ ID NO: 3252 - protein, 8 aa, Homo sapiens
RKNPVCRE

SEQ ID NO: 3253 - protein, 8 aa, Homo sapiens
RKNPVCRE

SEQ ID NO: 3254 - protein, 8 aa, Homo sapiens
RKNPVCRE

SEQ ID NO: 3255 - protein, 8 aa, Homo sapiens
RKNPVCRE

SEQ ID NO: 3256 - protein, 8 aa, Homo sapiens
RKNPVCRE

SEQ ID NO: 3257 - protein, 8 aa, Homo sapiens
RKNPVCRE

SEQ ID NO: 3258 - protein, 8 aa, Homo sapiens
RKNPVCRE

SEQ ID NO: 3259 - protein, 8 aa, Homo sapiens
RKNPVCRE

SEQ ID NO: 3260 - protein, 8 aa, Homo sapiens
RKNPVCRE

SEQ ID NO: 3261 - protein, 8 aa, Homo sapiens
RKNPVCRE

SEQ ID NO: 3262 - protein, 8 aa, Homo sapiens
RKNPVCRE

SEQ ID NO: 3263 - protein, 8 aa, Homo sapiens
RNHNAKKK

SEQ ID NO: 3264 - protein, 8 aa, Homo sapiens
RNHNAKKK

SEQ ID NO: 3265 - protein, 8 aa, Homo sapiens
RKNPVCRE

SEQ ID NO: 3266 - protein, 8 aa, Homo sapiens
RNHNAKKK

SEQ ID NO: 3267 - protein, 8 aa, Homo sapiens
RKNPVCRE

SEQ ID NO: 3268 - protein, 8 aa, Homo sapiens
RNHNAKKK

SEQ ID NO: 3269 - protein, 13 aa, Homo sapiens
RFLSDRKNPVCRE

SEQ ID NO: 3270 - protein, 8 aa, Homo sapiens
RKNPVCRE

SEQ ID NO: 3271 - protein, 8 aa, Homo sapiens
RKNPVCRE

SEQ ID NO: 3272 - protein, 8 aa, Homo sapiens
RKNPVCRE

SEQ ID NO: 3273 - protein, 8 aa, Homo sapiens
RKNPVCRE

SEQ ID NO: 3274 - protein, 8 aa, Homo sapiens
RKNPVCRE

SEQ ID NO: 3275 - protein, 8 aa, Homo sapiens
RKNPVCRE

SEQ ID NO: 3276 - protein, 21 aa, Homo sapiens
RKRPAPQQIQQVQQQAVQNRN

SEQ ID NO: 3277 - protein, 12 aa, Homo sapiens
KSSEAIKESSKF

SEQ ID NO: 3278 - protein, 12 aa, Homo sapiens
KAKHLAAVEERK

SEQ ID NO: 3279 - protein, 8 aa, Homo sapiens
RKNPVCRE

SEQ ID NO: 3280 - protein, 8 aa, Homo sapiens
RKNPVCRE

SEQ ID NO: 3281 - protein, 8 aa, Homo sapiens
RKNPVCRE

SEQ ID NO: 3282 - protein, 8 aa, Homo sapiens
RKNPVCRE

SEQ ID NO: 3283 - protein, 8 aa, Homo sapiens
RKNPVCRE

SEQ ID NO: 3284 - protein, 25 aa, Homo sapiens
KSALEEFSKMKEEVPTALVEAHVRK

SEQ ID NO: 3285 - protein, 17 aa, Homo sapiens
RVASAAAKSALEEFSKM

SEQ ID NO: 3286 - protein, 17 aa, Homo sapiens
RVASAAAKSALEEFSKM

SEQ ID NO: 3287 - protein, 17 aa, Homo sapiens
RVASAAAKSALEEFSKM

SEQ ID NO: 3288 - protein, 11 aa, Homo sapiens
KSKAAASATRE

SEQ ID NO: 3289 - protein, 11 aa, Homo sapiens
KSKAAASATRE

SEQ ID NO: 3290 - protein, 11 aa, Homo sapiens
KSKAAASATRE

SEQ ID NO: 3291 - protein, 9 aa, Homo sapiens
RKVEEAAKV

SEQ ID NO: 3292 - protein, 9 aa, Homo sapiens
RKVEEAAKV

SEQ ID NO: 3293 - protein, 9 aa, Homo sapiens
RKVEEAAKV

SEQ ID NO: 3294 - protein, 9 aa, Homo sapiens
RKVEEAAKV

SEQ ID NO: 3295 - protein, 9 aa, Homo sapiens
RKVEEAAKV

SEQ ID NO: 3296 - protein, 9 aa, Homo sapiens
RKVEEAAKV

SEQ ID NO: 3297 - protein, 9 aa, Homo sapiens
RKVEEAAKV

SEQ ID NO: 3298 - protein, 9 aa, Homo sapiens
RTDMYTKKN

SEQ ID NO: 3299 - protein, 9 aa, Homo sapiens
RTDMYTKKN

SEQ ID NO: 3300 - protein, 12 aa, Homo sapiens
KAKHLAAVEERK

SEQ ID NO: 3301 - protein, 12 aa, Homo sapiens
KAKHLAAVEERK

SEQ ID NO: 3302 - protein, 12 aa, Homo sapiens
KAKHLAAVEERK

SEQ ID NO: 3303 - protein, 12 aa, Homo sapiens
KAKHLAAVEERK

SEQ ID NO: 3304 - protein, 12 aa, Homo sapiens
KAKHLAAVEERK

SEQ ID NO: 3305 - protein, 12 aa, Homo sapiens
KAKHLAAVEERK

SEQ ID NO: 3306 - protein, 12 aa, Homo sapiens
KAKHLAAVEERK

SEQ ID NO: 3307 - protein, 12 aa, Homo sapiens
KAKHLAAVEERK

SEQ ID NO: 3308 - protein, 12 aa, Homo sapiens
KAKHLAAVEERK

SEQ ID NO: 3309 - protein, 12 aa, Homo sapiens
KAKHLAAVEERK

SEQ ID NO: 3310 - protein, 12 aa, Homo sapiens
KAKHLAAVEERK

SEQ ID NO: 3311 - protein, 12 aa, Homo sapiens
KAKHLAAVEERK

SEQ ID NO: 3312 - protein, 12 aa, Homo sapiens
KAKHLAAVEERK

SEQ ID NO: 3313 - protein, 12 aa, Homo sapiens
KAKHLAAVEERK

SEQ ID NO: 3314 - protein, 12 aa, Homo sapiens
KAKHLAAVEERK

SEQ ID NO: 3315 - protein, 12 aa, Homo sapiens
KAKHLAAVEERK

SEQ ID NO: 3316 - protein, 12 aa, Homo sapiens
KAKHLAAVEERK

SEQ ID NO: 3317 - protein, 12 aa, Homo sapiens
KAKHLAAVEERK

SEQ ID NO: 3318 - protein, 12 aa, Homo sapiens
KAKHLAAVEERK

SEQ ID NO: 3319 - protein, 12 aa, Homo sapiens
KAKHLAAVEERK

SEQ ID NO: 3320 - protein, 12 aa, Homo sapiens
KAKHLAAVEERK

SEQ ID NO: 3321 - protein, 12 aa, Homo sapiens
KAKHLAAVEERK

SEQ ID NO: 3322 - protein, 12 aa, Homo sapiens
KAKHLAAVEERK

SEQ ID NO: 3323 - protein, 9 aa, Homo sapiens
RKVEEAAKV

SEQ ID NO: 3324 - protein, 9 aa, Homo sapiens
RKVEEAAKV

SEQ ID NO: 3325 - protein, 12 aa, Homo sapiens
KAKHLAAVEERK

SEQ ID NO: 3326 - protein, 12 aa, Homo sapiens
KAKHLAAVEERK

SEQ ID NO: 3327 - protein, 12 aa, Homo sapiens
KAKHLAAVEERK

SEQ ID NO: 3328 - protein, 12 aa, Homo sapiens
KAKHLAAVEERK

SEQ ID NO: 3329 - protein, 12 aa, Homo sapiens
KAKHLAAVEERK

SEQ ID NO: 3330 - protein, 11 aa, Homo sapiens
KEKTSEAPKKD

SEQ ID NO: 3331 - protein, 11 aa, Homo sapiens
KSKAAASATRE

SEQ ID NO: 3332 - protein, 11 aa, Homo sapiens
KSKAAASATRE

SEQ ID NO: 3333 - protein, 14 aa, Homo sapiens
RTDMYTKKNVPSKS

SEQ ID NO: 3334 - protein, 8 aa, Homo sapiens
KKNVPSKS

SEQ ID NO: 3335 - protein, 9 aa, Homo sapiens
RTDMYTKKN

SEQ ID NO: 3336 - protein, 9 aa, Homo sapiens
RTDMYTKKN

SEQ ID NO: 3337 - protein, 9 aa, Homo sapiens
RTDMYTKKN

SEQ ID NO: 3338 - protein, 14 aa, Homo sapiens
RTDMYTKKNVPSKS

SEQ ID NO: 3339 - protein, 9 aa, Homo sapiens
RTDMYTKKN

SEQ ID NO: 3340 - protein, 9 aa, Homo sapiens
RTDMYTKKN

SEQ ID NO: 3341 - protein, 11 aa, Homo sapiens
KSKAAASATRE

SEQ ID NO: 3342 - protein, 8 aa, Homo sapiens
RRKMADKV

SEQ ID NO: 3343 - protein, 8 aa, Homo sapiens
RKNPVCRE

SEQ ID NO: 3344 - protein, 8 aa, Homo sapiens
RKNPVCRE

SEQ ID NO: 3345 - protein, 8 aa, Homo sapiens
RKNPVCRE

SEQ ID NO: 3346 - protein, 8 aa, Homo sapiens
RKNPVCRE

SEQ ID NO: 3347 - protein, 8 aa, Homo sapiens
RKNPVCRE

SEQ ID NO: 3348 - protein, 8 aa, Homo sapiens
RKNPVCRE

SEQ ID NO: 3349 - protein, 8 aa, Homo sapiens
RKNPVCRE

SEQ ID NO: 3350 - protein, 8 aa, Homo sapiens
RKNPVCRE

SEQ ID NO: 3351 - protein, 8 aa, Homo sapiens
RKNPVCRE

SEQ ID NO: 3352 - protein, 8 aa, Homo sapiens
RKNPVCRE

SEQ ID NO: 3353 - protein, 13 aa, Homo sapiens
RDPKGYVQDLLRS

SEQ ID NO: 3354 - protein, 10 aa, Homo sapiens
KQQKIEQERK

SEQ ID NO: 3355 - protein, 13 aa, Homo sapiens
RWKYMIVDEGHRM

SEQ ID NO: 3356 - protein, 8 aa, Homo sapiens
RKNPVCRE

SEQ ID NO: 3357 - protein, 8 aa, Homo sapiens
RKNPVCRE

SEQ ID NO: 3358 - protein, 9 aa, Homo sapiens
RKPLDLYRL

SEQ ID NO: 3359 - protein, 9 aa, Homo sapiens
RKPLDLYRL

SEQ ID NO: 3360 - protein, 9 aa, Homo sapiens
RKPLDLYRL

SEQ ID NO: 3361 - protein, 8 aa, Homo sapiens
RKNPVCRE

SEQ ID NO: 3362 - protein, 8 aa, Homo sapiens
RKNPVCRE

SEQ ID NO: 3363 - protein, 8 aa, Homo sapiens
RKNPVCRE

SEQ ID NO: 3364 - protein, 8 aa, Homo sapiens
RKNPVCRE

SEQ ID NO: 3365 - protein, 8 aa, Homo sapiens
RKNPVCRE

SEQ ID NO: 3366 - protein, 10 aa, Homo sapiens
KTFGQKPVKF

SEQ ID NO: 3367 - protein, 10 aa, Homo sapiens
KTFGQKPVKF

SEQ ID NO: 3368 - protein, 10 aa, Homo sapiens
KTFGQKPVKF

SEQ ID NO: 3369 - protein, 8 aa, Homo sapiens
RGSLYKRY

SEQ ID NO: 3370 - protein, 10 aa, Homo sapiens
KTFGQKPVKF

SEQ ID NO: 3371 - protein, 10 aa, Homo sapiens
KSKGASAGRE

SEQ ID NO: 3372 - protein, 10 aa, Homo sapiens
KSKGASAGRE

SEQ ID NO: 3373 - protein, 10 aa, Homo sapiens
KSKGASAGRE

SEQ ID NO: 3374 - protein, 9 aa, Homo sapiens
KKVQEAARA

SEQ ID NO: 3375 - protein, 9 aa, Homo sapiens
KKVQEAARA

SEQ ID NO: 3376 - protein, 9 aa, Homo sapiens
KKVQEAARA

SEQ ID NO: 3377 - protein, 9 aa, Homo sapiens
KKVQEAARA

SEQ ID NO: 3378 - protein, 9 aa, Homo sapiens
KKVQEAARA

SEQ ID NO: 3379 - protein, 9 aa, Homo sapiens
KKVQEAARA

SEQ ID NO: 3380 - protein, 9 aa, Homo sapiens
KKVQEAARA

SEQ ID NO: 3381 - protein, 9 aa, Homo sapiens
KKVQEAARA

SEQ ID NO: 3382 - protein, 9 aa, Homo sapiens
KKVQEAARA

SEQ ID NO: 3383 - protein, 9 aa, Homo sapiens
KKVQEAARA

SEQ ID NO: 3384 - protein, 9 aa, Homo sapiens
KKVQEAARA

SEQ ID NO: 3385 - protein, 17 aa, Homo sapiens
RVASAAAKAALEEFSRV

SEQ ID NO: 3386 - protein, 17 aa, Homo sapiens
RVASAAAKAALEEFSRV

SEQ ID NO: 3387 - protein, 17 aa, Homo sapiens
RVASAAAKAALEEFSRV

SEQ ID NO: 3388 - protein, 17 aa, Homo sapiens
RVASAAAKAALEEFSRV

SEQ ID NO: 3389 - protein, 17 aa, Homo sapiens
RVASAAAKAALEEFSRV

SEQ ID NO: 3390 - protein, 17 aa, Homo sapiens
RVASAAAKAALEEFSRV

SEQ ID NO: 3391 - protein, 17 aa, Homo sapiens
RVASAAAKAALEEFSRV

SEQ ID NO: 3392 - protein, 17 aa, Homo sapiens
RVASAAAKAALEEFSRV

SEQ ID NO: 3393 - protein, 17 aa, Homo sapiens
RVASAAAKAALEEFSRV

SEQ ID NO: 3394 - protein, 17 aa, Homo sapiens
RVASAAAKAALEEFSRV

SEQ ID NO: 3395 - protein, 13 aa, Homo sapiens
KKYVHADAPTNKT

SEQ ID NO: 3396 - protein, 8 aa, Homo sapiens
RKNPVCRE

SEQ ID NO: 3397 - protein, 9 aa, Homo sapiens
RKASANARK

SEQ ID NO: 3398 - protein, 7 aa, Homo sapiens
KKTLAKS

SEQ ID NO: 3399 - protein, 7 aa, Homo sapiens
KKTLAKS

SEQ ID NO: 3400 - protein, 7 aa, Homo sapiens
KKTLAKS

SEQ ID NO: 3401 - protein, 7 aa, Homo sapiens
KKTLAKS

SEQ ID NO: 3402 - protein, 10 aa, Homo sapiens
KSKGASAGRE

SEQ ID NO: 3403 - protein, 10 aa, Homo sapiens
KSKGASAGRE

SEQ ID NO: 3404 - protein, 10 aa, Homo sapiens
KSKGASAGRE

SEQ ID NO: 3405 - protein, 10 aa, Homo sapiens
KSKGASAGRE

SEQ ID NO: 3406 - protein, 9 aa, Homo sapiens
RTDIYSKKT

SEQ ID NO: 3407 - protein, 9 aa, Homo sapiens
RTDIYSKKT

SEQ ID NO: 3408 - protein, 13 aa, Homo sapiens
RTDIYSKKTLAKS

SEQ ID NO: 3409 - protein, 13 aa, Homo sapiens
RTDIYSKKTLAKS

SEQ ID NO: 3410 - protein, 9 aa, Homo sapiens
RTDIYSKKT

SEQ ID NO: 3411 - protein, 13 aa, Homo sapiens
RTDIYSKKTLAKS

SEQ ID NO: 3412 - protein, 13 aa, Homo sapiens
RTDIYSKKTLAKS

SEQ ID NO: 3413 - protein, 9 aa, Homo sapiens
RTDIYSKKT

SEQ ID NO: 3414 - protein, 9 aa, Homo sapiens
KKVQEAARA

SEQ ID NO: 3415 - protein, 9 aa, Homo sapiens
RKPLDLYRL

SEQ ID NO: 3416 - protein, 9 aa, Homo sapiens
RKPLDLYRL

SEQ ID NO: 3417 - protein, 8 aa, Homo sapiens
RKNPVCRE

SEQ ID NO: 3418 - protein, 8 aa, Homo sapiens
RKNPVCRE

SEQ ID NO: 3419 - protein, 14 aa, Homo sapiens
RGKGEITPAAIQKM

SEQ ID NO: 3420 - protein, 10 aa, Homo sapiens
KGKGVGSARK

SEQ ID NO: 3421 - protein, 13 aa, Homo sapiens
KLISKFDKLPVKI

SEQ ID NO: 3422 - protein, 13 aa, Homo sapiens
KLISKFDKLPVKI

SEQ ID NO: 3423 - protein, 13 aa, Homo sapiens
KLISKFDKLPVKI

SEQ ID NO: 3424 - protein, 13 aa, Homo sapiens
KLISKFDKLPVKI

SEQ ID NO: 3425 - protein, 13 aa, Homo sapiens
KLISKFDKLPVKI

SEQ ID NO: 3426 - protein, 13 aa, Homo sapiens
KLISKFDKLPVKI

SEQ ID NO: 3427 - protein, 13 aa, Homo sapiens
KLISKFDKLPVKI

SEQ ID NO: 3428 - protein, 13 aa, Homo sapiens
KLISKFDKLPVKI

SEQ ID NO: 3429 - protein, 15 aa, Homo sapiens
RLTMKDIGTPEAWRV

SEQ ID NO: 3430 - protein, 9 aa, Homo sapiens
RTDPLEKRG

SEQ ID NO: 3431 - protein, 9 aa, Homo sapiens
RTDPLEKRG

SEQ ID NO: 3432 - protein, 9 aa, Homo sapiens
RTDPLEKRG

SEQ ID NO: 3433 - protein, 19 aa, Homo sapiens
RDLKIITDVIGNPEEERRA

SEQ ID NO: 3434 - protein, 19 aa, Homo sapiens
RDLKIITDVIGNPEEERRA

SEQ ID NO: 3435 - protein, 19 aa, Homo sapiens
RDLKIITDVIGNPEEERRA

SEQ ID NO: 3436 - protein, 10 aa, Homo sapiens
RKLDQTIARK

SEQ ID NO: 3437 - protein, 10 aa, Homo sapiens
RKLDQTIARK

SEQ ID NO: 3438 - protein, 10 aa, Homo sapiens
RKLDQTIARK

SEQ ID NO: 3439 - protein, 11 aa, Homo sapiens
RKLDQTIARKR

SEQ ID NO: 3440 - protein, 10 aa, Homo sapiens
RKLDQTIARK

SEQ ID NO: 3441 - protein, 10 aa, Homo sapiens
RKLDQTIARK

SEQ ID NO: 3442 - protein, 11 aa, Homo sapiens
RKLDQTIARKR

SEQ ID NO: 3443 - protein, 10 aa, Homo sapiens
RKLDQTIARK

SEQ ID NO: 3444 - protein, 10 aa, Homo sapiens
RKLDQTIARK

SEQ ID NO: 3445 - protein, 10 aa, Homo sapiens
RKLDQTIARK

SEQ ID NO: 3446 - protein, 10 aa, Homo sapiens
RKLDQTIARK

SEQ ID NO: 3447 - protein, 10 aa, Homo sapiens
RKLDQTIARK

SEQ ID NO: 3448 - protein, 8 aa, Homo sapiens
RKNPVCRE

SEQ ID NO: 3449 - protein, 8 aa, Homo sapiens
RKNPVCRE

SEQ ID NO: 3450 - protein, 13 aa, Homo sapiens
RFLSDRKNPVCRE

SEQ ID NO: 3451 - protein, 8 aa, Homo sapiens
RKNPVCRE

SEQ ID NO: 3452 - protein, 8 aa, Homo sapiens
RKNPVCRE

SEQ ID NO: 3453 - protein, 8 aa, Homo sapiens
RKNPVCRE

SEQ ID NO: 3454 - protein, 8 aa, Homo sapiens
RKNPVCRE

SEQ ID NO: 3455 - protein, 8 aa, Homo sapiens
RKNPVCRE

SEQ ID NO: 3456 - protein, 8 aa, Homo sapiens
RKNPVCRE

SEQ ID NO: 3457 - protein, 8 aa, Homo sapiens
RKNPVCRE

SEQ ID NO: 3458 - protein, 8 aa, Homo sapiens
RKNPVCRE

SEQ ID NO: 3459 - protein, 8 aa, Homo sapiens
RKNPVCRE

SEQ ID NO: 3460 - protein, 8 aa, Homo sapiens
RKNPVCRE

SEQ ID NO: 3461 - protein, 8 aa, Homo sapiens
RKNPVCRE

SEQ ID NO: 3462 - protein, 8 aa, Homo sapiens
RKNPVCRE

SEQ ID NO: 3463 - protein, 8 aa, Homo sapiens
RKNPVCRE

SEQ ID NO: 3464 - protein, 13 aa, Homo sapiens
RFLSDRKNPVCRE

SEQ ID NO: 3465 - protein, 8 aa, Homo sapiens
RKNPVCRE

SEQ ID NO: 3466 - protein, 8 aa, Homo sapiens
RKNPVCRE

SEQ ID NO: 3467 - protein, 8 aa, Homo sapiens
RKNPVCRE

SEQ ID NO: 3468 - protein, 8 aa, Homo sapiens
RKNPVCRE

SEQ ID NO: 3469 - protein, 8 aa, Homo sapiens
RKNPVCRE

SEQ ID NO: 3470 - protein, 8 aa, Homo sapiens
RKNPVCRE

SEQ ID NO: 3471 - protein, 8 aa, Homo sapiens
RKNPVCRE

SEQ ID NO: 3472 - protein, 8 aa, Homo sapiens
RKNPVCRE

SEQ ID NO: 3473 - protein, 8 aa, Homo sapiens
RKNPVCRE

SEQ ID NO: 3474 - protein, 8 aa, Homo sapiens
RKNPVCRE

SEQ ID NO: 3475 - protein, 8 aa, Homo sapiens
RKNPVCRE

SEQ ID NO: 3476 - protein, 8 aa, Homo sapiens
RKNPVCRE

SEQ ID NO: 3477 - protein, 13 aa, Homo sapiens
RFLSDRKNPVCRE

SEQ ID NO: 3478 - protein, 8 aa, Homo sapiens
RKNPVCRE

SEQ ID NO: 3479 - protein, 8 aa, Homo sapiens
RKNPVCRE

SEQ ID NO: 3480 - protein, 8 aa, Homo sapiens
RKNPVCRE

SEQ ID NO: 3481 - protein, 8 aa, Homo sapiens
RKNPVCRE

SEQ ID NO: 3482 - protein, 8 aa, Homo sapiens
RKNPVCRE

SEQ ID NO: 3483 - protein, 8 aa, Homo sapiens
RKNPVCRE

SEQ ID NO: 3484 - protein, 8 aa, Homo sapiens
RKNPVCRE

SEQ ID NO: 3485 - protein, 8 aa, Homo sapiens
RKNPVCRE

SEQ ID NO: 3486 - protein, 10 aa, Homo sapiens
KKVMAAIEKV

SEQ ID NO: 3487 - protein, 8 aa, Homo sapiens
REQKAKRN

SEQ ID NO: 3488 - protein, 22 aa, Homo sapiens
KEITALAPSTMKIKIIAPPERK

SEQ ID NO: 3489 - protein, 22 aa, Homo sapiens
KEITALAPSTMKIKIIAPPERK

SEQ ID NO: 3490 - protein, 11 aa, Homo sapiens
RKEKLPQVTRS

SEQ ID NO: 3491 - protein, 11 aa, Homo sapiens
REGSPANWKRK

SEQ ID NO: 3492 - protein, 11 aa, Homo sapiens
REGSPANWKRK

SEQ ID NO: 3493 - protein, 11 aa, Homo sapiens
REGSPANWKRK

SEQ ID NO: 3494 - protein, 11 aa, Homo sapiens
REGSPANWKRK

SEQ ID NO: 3495 - protein, 11 aa, Homo sapiens
REGSPANWKRK

SEQ ID NO: 3496 - protein, 11 aa, Homo sapiens
REGSPANWKRK

SEQ ID NO: 3497 - protein, 13 aa, Homo sapiens
RIYKWVPVTEPKV

SEQ ID NO: 3498 - protein, 7 aa, Homo sapiens
KGKDEKC

SEQ ID NO: 3499 - protein, 9 aa, Homo sapiens
RAKDDIKRV

SEQ ID NO: 3500 - protein, 17 aa, Homo sapiens
RIFKWVPVVDPQEEERR

SEQ ID NO: 3501 - protein, 24 aa, Homo sapiens
RKDLYANTVLSGGSTMYPGIADRM

SEQ ID NO: 3502 - protein, 24 aa, Homo sapiens
RKDLYANTVLSGGSTMYPGIADRM

SEQ ID NO: 3503 - protein, 24 aa, Homo sapiens
RKDLYANTVLSGGSTMYPGIADRM

SEQ ID NO: 3504 - protein, 25 aa, Homo sapiens
RHQGVMVGMGQKDCYVGDEAQSKRG

SEQ ID NO: 3505 - protein, 25 aa, Homo sapiens
RHQGVMVGMGQKDCYVGDEAQSKRG

SEQ ID NO: 3506 - protein, 25 aa, Homo sapiens
RHQGVMVGMGQKDCYVGDEAQSKRG

SEQ ID NO: 3507 - protein, 25 aa, Homo sapiens
RHQGVMVGMGQKDCYVGDEAQSKRG

SEQ ID NO: 3508 - protein, 25 aa, Homo sapiens
RHQGVMVGMGQKDCYVGDEAQSKRG

SEQ ID NO: 3509 - protein, 24 aa, Homo sapiens
RGILTLKYPIEHGIVTNWDDMEKI

SEQ ID NO: 3510 - protein, 25 aa, Homo sapiens
RHQGVMVGMGQKDCYVGDEAQSKRG

SEQ ID NO: 3511 - protein, 24 aa, Homo sapiens
RGILTLKYPIEHGIVTNWDDMEKI

SEQ ID NO: 3512 - protein, 24 aa, Homo sapiens
RGILTLKYPIEHGIVTNWDDMEKI

SEQ ID NO: 3513 - protein, 25 aa, Homo sapiens
RHQGVMVGMGQKDCYVGDEAQSKRG

SEQ ID NO: 3514 - protein, 25 aa, Homo sapiens
RHQGVMVGMGQKDCYVGDEAQSKRG

SEQ ID NO: 3515 - protein, 25 aa, Homo sapiens
RHQGVMVGMGQKDCYVGDEAQSKRG

SEQ ID NO: 3516 - protein, 24 aa, Homo sapiens
RGILTLKYPIEHGIVTNWDDMEKI

SEQ ID NO: 3517 - protein, 25 aa, Homo sapiens
RHQGVMVGMGQKDCYVGDEAQSKRG

SEQ ID NO: 3518 - protein, 25 aa, Homo sapiens
RHQGVMVGMGQKDCYVGDEAQSKRG

SEQ ID NO: 3519 - protein, 24 aa, Homo sapiens
RGILTLKYPIEHGIVTNWDDMEKI

SEQ ID NO: 3520 - protein, 24 aa, Homo sapiens
RGILTLKYPIEHGIVTNWDDMEKI

SEQ ID NO: 3521 - protein, 24 aa, Homo sapiens
RGILTLKYPIEHGIVTNWDDMEKI

SEQ ID NO: 3522 - protein, 24 aa, Homo sapiens
RGILTLKYPIEHGIVTNWDDMEKI

SEQ ID NO: 3523 - protein, 24 aa, Homo sapiens
RGILTLKYPIEHGIVTNWDDMEKI

SEQ ID NO: 3524 - protein, 24 aa, Homo sapiens
RGILTLKYPIEHGIVTNWDDMEKI

SEQ ID NO: 3525 - protein, 25 aa, Homo sapiens
RHQGVMVGMGQKDCYVGDEAQSKRG

SEQ ID NO: 3526 - protein, 22 aa, Homo sapiens
RMKNHHCKLTQVLNTHYVAPRR

SEQ ID NO: 3527 - protein, 15 aa, Homo sapiens
RWKYMIVDEGHRMKN

SEQ ID NO: 3528 - protein, 15 aa, Homo sapiens
KEITALAPSTMKIKI

SEQ ID NO: 3529 - protein, 13 aa, Homo sapiens
RKELPEYYELIRK

SEQ ID NO: 3530 - protein, 10 aa, Homo sapiens
KQQKIEQERK

SEQ ID NO: 3531 - protein, 13 aa, Homo sapiens
RWKYMIVDEGHRM

SEQ ID NO: 3532 - protein, 13 aa, Homo sapiens
RWKYMIVDEGHRM

SEQ ID NO: 3533 - protein, 13 aa, Homo sapiens
RWKYMIVDEGHRM

SEQ ID NO: 3534 - protein, 13 aa, Homo sapiens
RWKYMIVDEGHRM

SEQ ID NO: 3535 - protein, 13 aa, Homo sapiens
RWKYMIVDEGHRM

SEQ ID NO: 3536 - protein, 13 aa, Homo sapiens
RWKYMIVDEGHRM

SEQ ID NO: 3537 - protein, 15 aa, Homo sapiens
KIRWKYMIVDEGHRM

SEQ ID NO: 3538 - protein, 13 aa, Homo sapiens
RWKYMIVDEGHRM

SEQ ID NO: 3539 - protein, 13 aa, Homo sapiens
RWKYMIVDEGHRM

SEQ ID NO: 3540 - protein, 13 aa, Homo sapiens
RWKYMIVDEGHRM

SEQ ID NO: 3541 - protein, 13 aa, Homo sapiens
RWKYMIVDEGHRM

SEQ ID NO: 3542 - protein, 11 aa, Homo sapiens
KIVASSHGKKT

SEQ ID NO: 3543 - protein, 8 aa, Homo sapiens
RGSLYKRY

SEQ ID NO: 3544 - protein, 13 aa, Homo sapiens
RDPKGYVQDLLRS

SEQ ID NO: 3545 - protein, 5 aa, Homo sapiens
KKIRD

SEQ ID NO: 3546 - protein, 5 aa, Homo sapiens
KKIRD

SEQ ID NO: 3547 - protein, 5 aa, Homo sapiens
KKIRD

SEQ ID NO: 3548 - protein, 5 aa, Homo sapiens
KKIRD

SEQ ID NO: 3549 - protein, 5 aa, Homo sapiens
KKIRD

SEQ ID NO: 3550 - protein, 9 aa, Homo sapiens
KKIRDQDRN

SEQ ID NO: 3551 - protein, 8 aa, Homo sapiens
RGSLYKRY

SEQ ID NO: 3552 - protein, 8 aa, Homo sapiens
RGSLYKRY

SEQ ID NO: 3553 - protein, 15 aa, Homo sapiens
KDDWNKVSEHVGSRT

SEQ ID NO: 3554 - protein, 15 aa, Homo sapiens
RLKLIANNTTVERRF

SEQ ID NO: 3555 - protein, 20 aa, Homo sapiens
KTPPSMRLKLIANNTTVERR

SEQ ID NO: 3556 - protein, 12 aa, Homo sapiens
KVSYKGSPAARR

SEQ ID NO: 3557 - protein, 12 aa, Homo sapiens
KVSYKGSPAARR

SEQ ID NO: 3558 - protein, 12 aa, Homo sapiens
KVSYKGSPAARR

SEQ ID NO: 3559 - protein, 28 aa, Homo sapiens
KAEDRGMLLKTFNEPGSEYFIFLLSTRA

SEQ ID NO: 3560 - protein, 16 aa, Homo sapiens
RLKIPEGLFDPSNVKG

SEQ ID NO: 3561 - protein, 13 aa, Homo sapiens
RELSQKTPPSMRL

SEQ ID NO: 3562 - protein, 13 aa, Homo sapiens
RELSQKTPPSMRL

SEQ ID NO: 3563 - protein, 13 aa, Homo sapiens
RELSQKTPPSMRL

SEQ ID NO: 3564 - protein, 13 aa, Homo sapiens
RELSQKTPPSMRL

SEQ ID NO: 3565 - protein, 13 aa, Homo sapiens
RELSQKTPPSMRL

SEQ ID NO: 3566 - protein, 13 aa, Homo sapiens
RELSQKTPPSMRL

SEQ ID NO: 3567 - protein, 16 aa, Homo sapiens
RLNRELSQKTPPSMRL

SEQ ID NO: 3568 - protein, 14 aa, Homo sapiens
RLKLIANNTTVERR

SEQ ID NO: 3569 - protein, 14 aa, Homo sapiens
RLKLIANNTTVERR

SEQ ID NO: 3570 - protein, 14 aa, Homo sapiens
RLKLIANNTTVERR

SEQ ID NO: 3571 - protein, 15 aa, Homo sapiens
RLKLIANNTTVERRF

SEQ ID NO: 3572 - protein, 14 aa, Homo sapiens
RLKLIANNTTVERR

SEQ ID NO: 3573 - protein, 15 aa, Homo sapiens
RLKLIANNTTVERRF

SEQ ID NO: 3574 - protein, 14 aa, Homo sapiens
RLKLIANNTTVERR

SEQ ID NO: 3575 - protein, 14 aa, Homo sapiens
RLKLIANNTTVERR

SEQ ID NO: 3576 - protein, 15 aa, Homo sapiens
RLKLIANNTTVERRF

SEQ ID NO: 3577 - protein, 14 aa, Homo sapiens
RLKLIANNTTVERR

SEQ ID NO: 3578 - protein, 14 aa, Homo sapiens
RLKLIANNTTVERR

SEQ ID NO: 3579 - protein, 15 aa, Homo sapiens
RLKLIANNTTVERRF

SEQ ID NO: 3580 - protein, 14 aa, Homo sapiens
RLKLIANNTTVERR

SEQ ID NO: 3581 - protein, 15 aa, Homo sapiens
RLKLIANNTTVERRF

SEQ ID NO: 3582 - protein, 14 aa, Homo sapiens
RLKLIANNTTVERR

SEQ ID NO: 3583 - protein, 14 aa, Homo sapiens
RLKLIANNTTVERR

SEQ ID NO: 3584 - protein, 14 aa, Homo sapiens
RLKLIANNTTVERR

SEQ ID NO: 3585 - protein, 15 aa, Homo sapiens
RLKLIANNTTVERRF

SEQ ID NO: 3586 - protein, 14 aa, Homo sapiens
RLKLIANNTTVERR

SEQ ID NO: 3587 - protein, 14 aa, Homo sapiens
RLKLIANNTTVERR

SEQ ID NO: 3588 - protein, 14 aa, Homo sapiens
RLKLIANNTTVERR

SEQ ID NO: 3589 - protein, 14 aa, Homo sapiens
RLKLIANNTTVERR

SEQ ID NO: 3590 - protein, 14 aa, Homo sapiens
RLKLIANNTTVERR

SEQ ID NO: 3591 - protein, 14 aa, Homo sapiens
RLKLIANNTTVERR

SEQ ID NO: 3592 - protein, 14 aa, Homo sapiens
RLKLIANNTTVERR

SEQ ID NO: 3593 - protein, 14 aa, Homo sapiens
RLKLIANNTTVERR

SEQ ID NO: 3594 - protein, 15 aa, Homo sapiens
RLKLIANNTTVERRF

SEQ ID NO: 3595 - protein, 14 aa, Homo sapiens
RLKLIANNTTVERR

SEQ ID NO: 3596 - protein, 14 aa, Homo sapiens
RLKLIANNTTVERR

SEQ ID NO: 3597 - protein, 14 aa, Homo sapiens
RLKLIANNTTVERR

SEQ ID NO: 3598 - protein, 14 aa, Homo sapiens
RLKLIANNTTVERR

SEQ ID NO: 3599 - protein, 15 aa, Homo sapiens
RLKLIANNTTVERRF

SEQ ID NO: 3600 - protein, 14 aa, Homo sapiens
RLKLIANNTTVERR

SEQ ID NO: 3601 - protein, 15 aa, Homo sapiens
RLKLIANNTTVERRF

SEQ ID NO: 3602 - protein, 14 aa, Homo sapiens
RLKLIANNTTVERR

SEQ ID NO: 3603 - protein, 14 aa, Homo sapiens
RLKLIANNTTVERR

SEQ ID NO: 3604 - protein, 14 aa, Homo sapiens
RLKLIANNTTVERR

SEQ ID NO: 3605 - protein, 14 aa, Homo sapiens
RLKLIANNTTVERR

SEQ ID NO: 3606 - protein, 14 aa, Homo sapiens
RLKLIANNTTVERR

SEQ ID NO: 3607 - protein, 15 aa, Homo sapiens
RLKLIANNTTVERRF

SEQ ID NO: 3608 - protein, 15 aa, Homo sapiens
RLKLIANNTTVERRF

SEQ ID NO: 3609 - protein, 15 aa, Homo sapiens
RLKLIANNTTVERRF

SEQ ID NO: 3610 - protein, 15 aa, Homo sapiens
RLKLIANNTTVERRF

SEQ ID NO: 3611 - protein, 15 aa, Homo sapiens
RLKLIANNTTVERRF

SEQ ID NO: 3612 - protein, 14 aa, Homo sapiens
RLKLIANNTTVERR

SEQ ID NO: 3613 - protein, 14 aa, Homo sapiens
RLKLIANNTTVERR

SEQ ID NO: 3614 - protein, 14 aa, Homo sapiens
RLKLIANNTTVERR

SEQ ID NO: 3615 - protein, 15 aa, Homo sapiens
RLKLIANNTTVERRF

SEQ ID NO: 3616 - protein, 14 aa, Homo sapiens
RLKLIANNTTVERR

SEQ ID NO: 3617 - protein, 14 aa, Homo sapiens
RLKLIANNTTVERR

SEQ ID NO: 3618 - protein, 15 aa, Homo sapiens
RLKLIANNTTVERRF

SEQ ID NO: 3619 - protein, 15 aa, Homo sapiens
RLKLIANNTTVERRF

SEQ ID NO: 3620 - protein, 15 aa, Homo sapiens
RLKLIANNTTVERRF

SEQ ID NO: 3621 - protein, 15 aa, Homo sapiens
RLKLIANNTTVERRF

SEQ ID NO: 3622 - protein, 14 aa, Homo sapiens
RLKLIANNTTVERR

SEQ ID NO: 3623 - protein, 14 aa, Homo sapiens
RLKLIANNTTVERR

SEQ ID NO: 3624 - protein, 14 aa, Homo sapiens
RLKLIANNTTVERR

SEQ ID NO: 3625 - protein, 14 aa, Homo sapiens
RLKLIANNTTVERR

SEQ ID NO: 3626 - protein, 15 aa, Homo sapiens
RLKLIANNTTVERRF

SEQ ID NO: 3627 - protein, 15 aa, Homo sapiens
RLKLIANNTTVERRF

SEQ ID NO: 3628 - protein, 15 aa, Homo sapiens
RLKLIANNTTVERRF

SEQ ID NO: 3629 - protein, 14 aa, Homo sapiens
RLKLIANNTTVERR

SEQ ID NO: 3630 - protein, 14 aa, Homo sapiens
RLKLIANNTTVERR

SEQ ID NO: 3631 - protein, 9 aa, Homo sapiens
KDFKEYHRS

SEQ ID NO: 3632 - protein, 9 aa, Homo sapiens
KDFKEYHRS

SEQ ID NO: 3633 - protein, 9 aa, Homo sapiens
KDFKEYHRS

SEQ ID NO: 3634 - protein, 9 aa, Homo sapiens
KDFKEYHRS

SEQ ID NO: 3635 - protein, 9 aa, Homo sapiens
KDFKEYHRS

SEQ ID NO: 3636 - protein, 9 aa, Homo sapiens
KDFKEYHRS

SEQ ID NO: 3637 - protein, 9 aa, Homo sapiens
KDFKEYHRS

SEQ ID NO: 3638 - protein, 9 aa, Homo sapiens
KDFKEYHRS

SEQ ID NO: 3639 - protein, 9 aa, Homo sapiens
KDFKEYHRS

SEQ ID NO: 3640 - protein, 9 aa, Homo sapiens
KDFKEYHRS

SEQ ID NO: 3641 - protein, 9 aa, Homo sapiens
KDFKEYHRS

SEQ ID NO: 3642 - protein, 9 aa, Homo sapiens
KDFKEYHRS

SEQ ID NO: 3643 - protein, 9 aa, Homo sapiens
KDFKEYHRS

SEQ ID NO: 3644 - protein, 14 aa, Homo sapiens
RLKLIANNTTVERR

SEQ ID NO: 3645 - protein, 9 aa, Homo sapiens
KDFKEYHRS

SEQ ID NO: 3646 - protein, 9 aa, Homo sapiens
KDFKEYHRS

SEQ ID NO: 3647 - protein, 14 aa, Homo sapiens
RLKLIANNTTVERR

SEQ ID NO: 3648 - protein, 14 aa, Homo sapiens
RLKLIANNTTVERR

SEQ ID NO: 3649 - protein, 9 aa, Homo sapiens
RIRNHKYRS

SEQ ID NO: 3650 - protein, 17 aa, Homo sapiens
KDKPASENSEEKLISKF

SEQ ID NO: 3651 - protein, 15 aa, Homo sapiens
KQEYEEGGKQCVERK

SEQ ID NO: 3652 - protein, 15 aa, Homo sapiens
KQEYEEGGKQCVERK

SEQ ID NO: 3653 - protein, 15 aa, Homo sapiens
KQEYEEGGKQCVERK

SEQ ID NO: 3654 - protein, 15 aa, Homo sapiens
KQEYEEGGKQCVERK

SEQ ID NO: 3655 - protein, 15 aa, Homo sapiens
KQEYEEGGKQCVERK

SEQ ID NO: 3656 - protein, 15 aa, Homo sapiens
KQEYEEGGKQCVERK

SEQ ID NO: 3657 - protein, 15 aa, Homo sapiens
KQEYEEGGKQCVERK

SEQ ID NO: 3658 - protein, 15 aa, Homo sapiens
KQEYEEGGKQCVERK

SEQ ID NO: 3659 - protein, 15 aa, Homo sapiens
KQEYEEGGKQCVERK

SEQ ID NO: 3660 - protein, 15 aa, Homo sapiens
KQEYEEGGKQCVERK

SEQ ID NO: 3661 - protein, 15 aa, Homo sapiens
KQEYEEGGKQCVERK

SEQ ID NO: 3662 - protein, 15 aa, Homo sapiens
KQEYEEGGKQCVERK

SEQ ID NO: 3663 - protein, 15 aa, Homo sapiens
KQEYEEGGKQCVERK

SEQ ID NO: 3664 - protein, 15 aa, Homo sapiens
KQEYEEGGKQCVERK

SEQ ID NO: 3665 - protein, 15 aa, Homo sapiens
KQEYEEGGKQCVERK

SEQ ID NO: 3666 - protein, 15 aa, Homo sapiens
KQEYEEGGKQCVERK

SEQ ID NO: 3667 - protein, 15 aa, Homo sapiens
KQEYEEGGKQCVERK

SEQ ID NO: 3668 - protein, 15 aa, Homo sapiens
KQEYEEGGKQCVERK

SEQ ID NO: 3669 - protein, 15 aa, Homo sapiens
KQEYEEGGKQCVERK

SEQ ID NO: 3670 - protein, 15 aa, Homo sapiens
KQEYEEGGKQCVERK

SEQ ID NO: 3671 - protein, 15 aa, Homo sapiens
KQEYEEGGKQCVERK

SEQ ID NO: 3672 - protein, 15 aa, Homo sapiens
KQEYEEGGKQCVERK

SEQ ID NO: 3673 - protein, 15 aa, Homo sapiens
KQEYEEGGKQCVERK

SEQ ID NO: 3674 - protein, 15 aa, Homo sapiens
KQEYEEGGKQCVERK

SEQ ID NO: 3675 - protein, 15 aa, Homo sapiens
KQEYEEGGKQCVERK

SEQ ID NO: 3676 - protein, 15 aa, Homo sapiens
KQEYEEGGKQCVERK

SEQ ID NO: 3677 - protein, 15 aa, Homo sapiens
KQEYEEGGKQCVERK

SEQ ID NO: 3678 - protein, 9 aa, Homo sapiens
RKPLDLYRL

SEQ ID NO: 3679 - protein, 13 aa, Homo sapiens
RELSQKTPPSMRL

SEQ ID NO: 3680 - protein, 13 aa, Homo sapiens
RELSQKTPPSMRL

SEQ ID NO: 3681 - protein, 13 aa, Homo sapiens
RELSQKTPPSMRL

SEQ ID NO: 3682 - protein, 13 aa, Homo sapiens
RELSQKTPPSMRL

SEQ ID NO: 3683 - protein, 13 aa, Homo sapiens
RELSQKTPPSMRL

SEQ ID NO: 3684 - protein, 14 aa, Homo sapiens
RLKLIANNTTVERR

SEQ ID NO: 3685 - protein, 15 aa, Homo sapiens
RLKLIANNTTVERRF

SEQ ID NO: 3686 - protein, 15 aa, Homo sapiens
RLKLIANNTTVERRF

SEQ ID NO: 3687 - protein, 14 aa, Homo sapiens
RLKLIANNTTVERR

SEQ ID NO: 3688 - protein, 14 aa, Homo sapiens
RLKLIANNTTVERR

SEQ ID NO: 3689 - protein, 15 aa, Homo sapiens
RLKLIANNTTVERRF

SEQ ID NO: 3690 - protein, 14 aa, Homo sapiens
RLKLIANNTTVERR

SEQ ID NO: 3691 - protein, 15 aa, Homo sapiens
RLKLIANNTTVERRF

SEQ ID NO: 3692 - protein, 14 aa, Homo sapiens
RLKLIANNTTVERR

SEQ ID NO: 3693 - protein, 15 aa, Homo sapiens
RLKLIANNTTVERRF

SEQ ID NO: 3694 - protein, 14 aa, Homo sapiens
RLKLIANNTTVERR

SEQ ID NO: 3695 - protein, 20 aa, Homo sapiens
KTPPSMRLKLIANNTTVERR

SEQ ID NO: 3696 - protein, 20 aa, Homo sapiens
KTPPSMRLKLIANNTTVERR

SEQ ID NO: 3697 - protein, 20 aa, Homo sapiens
KTPPSMRLKLIANNTTVERR

SEQ ID NO: 3698 - protein, 12 aa, Homo sapiens
REKEAAEQAERS

SEQ ID NO: 3699 - protein, 20 aa, Homo sapiens
KTPPSMRLKLIANNTTVERR

SEQ ID NO: 3700 - protein, 15 aa, Homo sapiens
KASNPDLKLWEIGKI

SEQ ID NO: 3701 - protein, 10 aa, Homo sapiens
KEKLPQVTRS

SEQ ID NO: 3702 - protein, 11 aa, Homo sapiens
RKEKLPQVTRS

SEQ ID NO: 3703 - protein, 11 aa, Homo sapiens
RKEKLPQVTRS

SEQ ID NO: 3704 - protein, 16 aa, Homo sapiens
RQAFHMEQLKYAEMRA

SEQ ID NO: 3705 - protein, 16 aa, Homo sapiens
RQAFHMEQLKYAEMRA

SEQ ID NO: 3706 - protein, 16 aa, Homo sapiens
RQAFHMEQLKYAEMRA

SEQ ID NO: 3707 - protein, 16 aa, Homo sapiens
RQAFHMEQLKYAEMRA

SEQ ID NO: 3708 - protein, 16 aa, Homo sapiens
RQAFHMEQLKYAEMRA

SEQ ID NO: 3709 - protein, 20 aa, Homo sapiens
KTPPSMRLKLIANNTTVERR

SEQ ID NO: 3710 - protein, 20 aa, Homo sapiens
KTPPSMRLKLIANNTTVERR

SEQ ID NO: 3711 - protein, 20 aa, Homo sapiens
KTPPSMRLKLIANNTTVERR

SEQ ID NO: 3712 - protein, 20 aa, Homo sapiens
KTPPSMRLKLIANNTTVERR

SEQ ID NO: 3713 - protein, 17 aa, Homo sapiens
KIKSLVALLVETQMKKL

SEQ ID NO: 3714 - protein, 12 aa, Homo sapiens
KTHKLQDPHERE

SEQ ID NO: 3715 - protein, 12 aa, Homo sapiens
KTHKLQDPHERE

SEQ ID NO: 3716 - protein, 12 aa, Homo sapiens
KTHKLQDPHERE

SEQ ID NO: 3717 - protein, 12 aa, Homo sapiens
KTHKLQDPHERE

SEQ ID NO: 3718 - protein, 12 aa, Homo sapiens
KTHKLQDPHERE

SEQ ID NO: 3719 - protein, 12 aa, Homo sapiens
KTHKLQDPHERE

SEQ ID NO: 3720 - protein, 12 aa, Homo sapiens
KTHKLQDPHERE

SEQ ID NO: 3721 - protein, 12 aa, Homo sapiens
KTHKLQDPHERE

SEQ ID NO: 3722 - protein, 12 aa, Homo sapiens
KTHKLQDPHERE

SEQ ID NO: 3723 - protein, 11 aa, Homo sapiens
RMKFSEIPQRL

SEQ ID NO: 3724 - protein, 12 aa, Homo sapiens
KTHKLQDPHERE

SEQ ID NO: 3725 - protein, 12 aa, Homo sapiens
KTHKLQDPHERE

SEQ ID NO: 3726 - protein, 12 aa, Homo sapiens
KTHKLQDPHERE

SEQ ID NO: 3727 - protein, 12 aa, Homo sapiens
KTHKLQDPHERE

SEQ ID NO: 3728 - protein, 12 aa, Homo sapiens
KTHKLQDPHERE

SEQ ID NO: 3729 - protein, 12 aa, Homo sapiens
KTHKLQDPHERE

SEQ ID NO: 3730 - protein, 12 aa, Homo sapiens
KTHKLQDPHERE

SEQ ID NO: 3731 - protein, 18 aa, Homo sapiens
RMSPSKSPFLPSMKMQKV

SEQ ID NO: 3732 - protein, 13 aa, Homo sapiens
RELSQKTPPSMRL

SEQ ID NO: 3733 - protein, 13 aa, Homo sapiens
RELSQKTPPSMRL

SEQ ID NO: 3734 - protein, 13 aa, Homo sapiens
RELSQKTPPSMRL

SEQ ID NO: 3735 - protein, 10 aa, Homo sapiens
KEKLPQVTRS

SEQ ID NO: 3736 - protein, 9 aa, Homo sapiens
RTDPLEKRG

SEQ ID NO: 3737 - protein, 9 aa, Homo sapiens
RTDPLEKRG

SEQ ID NO: 3738 - protein, 12 aa, Homo sapiens
KSKGKGVGSARK

SEQ ID NO: 3739 - protein, 14 aa, Homo sapiens
RLKLIANNTTVERR

SEQ ID NO: 3740 - protein, 8 aa, Homo sapiens
RGSLYKRY

SEQ ID NO: 3741 - protein, 8 aa, Homo sapiens
RGSLYKRY

SEQ ID NO: 3742 - protein, 8 aa, Homo sapiens
REQKAKRN

SEQ ID NO: 3743 - protein, 8 aa, Homo sapiens
REQKAKRN

SEQ ID NO: 3744 - protein, 18 aa, Homo sapiens
KGKQGGPTYYIDTNALRV

SEQ ID NO: 3745 - protein, 18 aa, Homo sapiens
KGKQGGPTYYIDTNALRV

SEQ ID NO: 3746 - protein, 8 aa, Homo sapiens
RGSLYKRY

SEQ ID NO: 3747 - protein, 8 aa, Homo sapiens
REQKAKRN

SEQ ID NO: 3748 - protein, 8 aa, Homo sapiens
REQKAKRN

SEQ ID NO: 3749 - protein, 11 aa, Homo sapiens
REGSPANWKRK

SEQ ID NO: 3750 - protein, 11 aa, Homo sapiens
REGSPANWKRK

SEQ ID NO: 3751 - protein, 16 aa, Homo sapiens
RQNFHMEQLKYAELRA

SEQ ID NO: 3752 - protein, 16 aa, Homo sapiens
RQNFHMEQLKYAELRA

SEQ ID NO: 3753 - protein, 16 aa, Homo sapiens
RQNFHMEQLKYAELRA

SEQ ID NO: 3754 - protein, 16 aa, Homo sapiens
RQNFHMEQLKYAELRA

SEQ ID NO: 3755 - protein, 16 aa, Homo sapiens
RQNFHMEQLKYAELRA

SEQ ID NO: 3756 - protein, 16 aa, Homo sapiens
RQNFHMEQLKYAELRA

SEQ ID NO: 3757 - protein, 16 aa, Homo sapiens
RQNFHMEQLKYAELRA

SEQ ID NO: 3758 - protein, 16 aa, Homo sapiens
RQNFHMEQLKYAELRA

SEQ ID NO: 3759 - protein, 16 aa, Homo sapiens
RQNFHMEQLKYAELRA

SEQ ID NO: 3760 - protein, 16 aa, Homo sapiens
RQNFHMEQLKYAELRA

SEQ ID NO: 3761 - protein, 16 aa, Homo sapiens
RQNFHMEQLKYAELRA

SEQ ID NO: 3762 - protein, 13 aa, Homo sapiens
RELSQKTPPSMRL

SEQ ID NO: 3763 - protein, 14 aa, Homo sapiens
RLKLIANNTTVERR

SEQ ID NO: 3764 - protein, 13 aa, Homo sapiens
RHQGTFTDEKSKA

SEQ ID NO: 3765 - protein, 11 aa, Homo sapiens
REKEALEQQRQ

SEQ ID NO: 3766 - protein, 9 aa, Homo sapiens
RKASANARK

SEQ ID NO: 3767 - protein, 9 aa, Homo sapiens
RKASANARK

SEQ ID NO: 3768 - protein, 7 aa, Homo sapiens
RLKGGRR

SEQ ID NO: 3769 - protein, 9 aa, Homo sapiens
KKVQEAARA

SEQ ID NO: 3770 - protein, 9 aa, Homo sapiens
RTDIYSKKT

SEQ ID NO: 3771 - protein, 9 aa, Homo sapiens
RTDIYSKKT

SEQ ID NO: 3772 - protein, 7 aa, Homo sapiens
KKTLAKS

SEQ ID NO: 3773 - protein, 7 aa, Homo sapiens
KKTLAKS

SEQ ID NO: 3774 - protein, 10 aa, Homo sapiens
KSKGASAGRE

SEQ ID NO: 3775 - protein, 10 aa, Homo sapiens
KSKGASAGRE

SEQ ID NO: 3776 - protein, 10 aa, Homo sapiens
KSKGASAGRE

SEQ ID NO: 3777 - protein, 9 aa, Homo sapiens
KKVQEAARA

SEQ ID NO: 3778 - protein, 6 aa, Homo sapiens
KKSSRK

SEQ ID NO: 3779 - protein, 11 aa, Homo sapiens
RDRKASANARK

SEQ ID NO: 3780 - protein, 12 aa, Homo sapiens
KVSYKGSPAARR

SEQ ID NO: 3781 - protein, 8 aa, Homo sapiens
KIQKLTKA

SEQ ID NO: 3782 - protein, 9 aa, Homo sapiens
RKASANARK

SEQ ID NO: 3783 - protein, 9 aa, Homo sapiens
KKVQEAARA

SEQ ID NO: 3784 - protein, 9 aa, Homo sapiens
RKASANARK

SEQ ID NO: 3785 - protein, 11 aa, Homo sapiens
KATIELKALRL

SEQ ID NO: 3786 - protein, 13 aa, Homo sapiens
RTKATIELKALRL

SEQ ID NO: 3787 - protein, 11 aa, Homo sapiens
KATIELKALRL

SEQ ID NO: 3788 - protein, 13 aa, Homo sapiens
RTKATIELKALRL

SEQ ID NO: 3789 - protein, 13 aa, Homo sapiens
RTKATIELKALRL

SEQ ID NO: 3790 - protein, 11 aa, Homo sapiens
KATIELKALRL

SEQ ID NO: 3791 - protein, 11 aa, Homo sapiens
KATIELKALRL

SEQ ID NO: 3792 - protein, 11 aa, Homo sapiens
KATIELKALRL

SEQ ID NO: 3793 - protein, 9 aa, Homo sapiens
RITEKLEKQ

SEQ ID NO: 3794 - protein, 9 aa, Homo sapiens
RITEKLEKQ

SEQ ID NO: 3795 - protein, 18 aa, Homo sapiens
RGQPLPDHLQMAVQGKRP

SEQ ID NO: 3796 - protein, 18 aa, Homo sapiens
RKRDSDAGSSTPTTSTRS

SEQ ID NO: 3797 - protein, 16 aa, Homo sapiens
RKLRIFISNTFNPAKS

SEQ ID NO: 3798 - protein, 12 aa, Homo sapiens
RYNQMKGMGMRS

SEQ ID NO: 3799 - protein, 12 aa, Homo sapiens
RYNQMKGMGMRS

SEQ ID NO: 3800 - protein, 7 aa, Homo sapiens
RKMADKV

SEQ ID NO: 3801 - protein, 7 aa, Homo sapiens
RKMADKV

SEQ ID NO: 3802 - protein, 8 aa, Homo sapiens
RNHNAKKK

SEQ ID NO: 3803 - protein, 8 aa, Homo sapiens
RNHNAKKK

SEQ ID NO: 3804 - protein, 8 aa, Homo sapiens
RNHNAKKK

SEQ ID NO: 3805 - protein, 8 aa, Homo sapiens
RNHNAKKK

SEQ ID NO: 3806 - protein, 8 aa, Homo sapiens
RNHNAKKK

SEQ ID NO: 3807 - protein, 10 aa, Homo sapiens
RITPIQKPRG

SEQ ID NO: 3808 - protein, 10 aa, Homo sapiens
RITPIQKPRG

SEQ ID NO: 3809 - protein, 10 aa, Homo sapiens
RITPIQKPRG

SEQ ID NO: 3810 - protein, 10 aa, Homo sapiens
RITPIQKPRG

SEQ ID NO: 3811 - protein, 11 aa, Homo sapiens
KATIELKALRL

SEQ ID NO: 3812 - protein, 13 aa, Homo sapiens
RTKATIELKALRL

SEQ ID NO: 3813 - protein, 13 aa, Homo sapiens
RTKATIELKALRL

SEQ ID NO: 3814 - protein, 13 aa, Homo sapiens
RTKATIELKALRL

SEQ ID NO: 3815 - protein, 6 aa, Homo sapiens
MAVRKK

SEQ ID NO: 3816 - protein, 9 aa, Homo sapiens
RTDMYTKKN

SEQ ID NO: 3817 - protein, 9 aa, Homo sapiens
RTDMYTKKN

SEQ ID NO: 3818 - protein, 11 aa, Homo sapiens
KSKAAASATRE

SEQ ID NO: 3819 - protein, 17 aa, Homo sapiens
KMKEEVPTALVEAHVRK

SEQ ID NO: 3820 - protein, 17 aa, Homo sapiens
KMKEEVPTALVEAHVRK

SEQ ID NO: 3821 - protein, 17 aa, Homo sapiens
KMKEEVPTALVEAHVRK

SEQ ID NO: 3822 - protein, 6 aa, Homo sapiens
MAVRKK

SEQ ID NO: 3823 - protein, 6 aa, Homo sapiens
MAVRKK

SEQ ID NO: 3824 - protein, 7 aa, Homo sapiens
RLKGGRR

SEQ ID NO: 3825 - protein, 9 aa, Homo sapiens
RITEKLEKQ

SEQ ID NO: 3826 - protein, 9 aa, Homo sapiens
RITEKLEKQ

SEQ ID NO: 3827 - protein, 12 aa, Homo sapiens
RITEKLEKQQKI

SEQ ID NO: 3828 - protein, 12 aa, Homo sapiens
RITEKLEKQQKI

SEQ ID NO: 3829 - protein, 12 aa, Homo sapiens
RITEKLEKQQKI

SEQ ID NO: 3830 - protein, 18 aa, Homo sapiens
RGQPLPDHLQMAVQGKRP

SEQ ID NO: 3831 - protein, 12 aa, Homo sapiens
RYNQMKGMGMRS

SEQ ID NO: 3832 - protein, 8 aa, Homo sapiens
REQKAKRN

SEQ ID NO: 3833 - protein, 8 aa, Homo sapiens
RQKKSSRK

SEQ ID NO: 3834 - protein, 9 aa, Homo sapiens
KKIRDQDRN

SEQ ID NO: 3835 - protein, 8 aa, Homo sapiens
KIQKLTKA

SEQ ID NO: 3836 - protein, 8 aa, Homo sapiens
KIQKLTKA

SEQ ID NO: 3837 - protein, 8 aa, Homo sapiens
REQKAKRN

SEQ ID NO: 3838 - protein, 8 aa, Homo sapiens
REQKAKRN

SEQ ID NO: 3839 - protein, 8 aa, Homo sapiens
REQKAKRN

SEQ ID NO: 3840 - protein, 8 aa, Homo sapiens
RRKMADKV

SEQ ID NO: 3841 - protein, 8 aa, Homo sapiens
RRKMADKV

SEQ ID NO: 3842 - protein, 8 aa, Homo sapiens
RRKMADKV

SEQ ID NO: 3843 - protein, 8 aa, Homo sapiens
RRKMADKV

SEQ ID NO: 3844 - protein, 8 aa, Homo sapiens
RRKMADKV

SEQ ID NO: 3845 - protein, 13 aa, Homo sapiens
RDPKGYVQDLLRS

SEQ ID NO: 3846 - protein, 12 aa, Homo sapiens
RYNQMKGMGMRS

SEQ ID NO: 3847 - protein, 12 aa, Homo sapiens
RYNQMKGMGMRS

SEQ ID NO: 3848 - protein, 11 aa, Homo sapiens
RKEKLPQVTRS

SEQ ID NO: 3849 - protein, 11 aa, Homo sapiens
RKEKLPQVTRS

SEQ ID NO: 3850 - protein, 11 aa, Homo sapiens
RKEKLPQVTRS

SEQ ID NO: 3851 - protein, 11 aa, Homo sapiens
RKEKLPQVTRS

SEQ ID NO: 3852 - protein, 11 aa, Homo sapiens
RKEKLPQVTRS

SEQ ID NO: 3853 - protein, 11 aa, Homo sapiens
RKEKLPQVTRS

SEQ ID NO: 3854 - protein, 10 aa, Homo sapiens
KEKLPQVTRS

SEQ ID NO: 3855 - protein, 10 aa, Homo sapiens
KEKLPQVTRS

SEQ ID NO: 3856 - protein, 11 aa, Homo sapiens
RKEKLPQVTRS

SEQ ID NO: 3857 - protein, 11 aa, Homo sapiens
RKEKLPQVTRS

SEQ ID NO: 3858 - protein, 10 aa, Homo sapiens
KEKLPQVTRS

SEQ ID NO: 3859 - protein, 11 aa, Homo sapiens
RKEKLPQVTRS

SEQ ID NO: 3860 - protein, 10 aa, Homo sapiens
KEKLPQVTRS

SEQ ID NO: 3861 - protein, 10 aa, Homo sapiens
KEKLPQVTRS

SEQ ID NO: 3862 - protein, 11 aa, Homo sapiens
RKEKLPQVTRS

SEQ ID NO: 3863 - protein, 11 aa, Homo sapiens
RKEKLPQVTRS

SEQ ID NO: 3864 - protein, 11 aa, Homo sapiens
RKEKLPQVTRS

SEQ ID NO: 3865 - protein, 10 aa, Homo sapiens
KEKLPQVTRS

SEQ ID NO: 3866 - protein, 10 aa, Homo sapiens
KEKLPQVTRS

SEQ ID NO: 3867 - protein, 11 aa, Homo sapiens
RKEKLPQVTRS

SEQ ID NO: 3868 - protein, 10 aa, Homo sapiens
KEKLPQVTRS

SEQ ID NO: 3869 - protein, 11 aa, Homo sapiens
RKEKLPQVTRS

SEQ ID NO: 3870 - protein, 11 aa, Homo sapiens
RKEKLPQVTRS

SEQ ID NO: 3871 - protein, 11 aa, Homo sapiens
RKEKLPQVTRS

SEQ ID NO: 3872 - protein, 11 aa, Homo sapiens
RKEKLPQVTRS

SEQ ID NO: 3873 - protein, 15 aa, Homo sapiens
RDLTDYLMKILTERG

SEQ ID NO: 3874 - protein, 9 aa, Homo sapiens
RAKDDIKRV

SEQ ID NO: 3875 - protein, 11 aa, Homo sapiens
KIKIIAPPERK

SEQ ID NO: 3876 - protein, 11 aa, Homo sapiens
KIKIIAPPERK

SEQ ID NO: 3877 - protein, 11 aa, Homo sapiens
KIKIIAPPERK

SEQ ID NO: 3878 - protein, 11 aa, Homo sapiens
KIKIIAPPERK

SEQ ID NO: 3879 - protein, 11 aa, Homo sapiens
KIKIIAPPERK

SEQ ID NO: 3880 - protein, 11 aa, Homo sapiens
KIKIIAPPERK

SEQ ID NO: 3881 - protein, 11 aa, Homo sapiens
KIKIIAPPERK

SEQ ID NO: 3882 - protein, 4 aa, Homo sapiens
RKCF

SEQ ID NO: 3883 - protein, 4 aa, Homo sapiens
RKCF

SEQ ID NO: 3884 - protein, 17 aa, Homo sapiens
KAVATYHANTEREQKKE

SEQ ID NO: 3885 - protein, 17 aa, Homo sapiens
KAVATYHANTEREQKKE

SEQ ID NO: 3886 - protein, 13 aa, Homo sapiens
RWKYMIVDEGHRM

SEQ ID NO: 3887 - protein, 11 aa, Homo sapiens
KIKIIAPPERK

SEQ ID NO: 3888 - protein, 11 aa, Homo sapiens
KIKIIAPPERK

SEQ ID NO: 3889 - protein, 7 aa, Homo sapiens
KKETERI

SEQ ID NO: 3890 - protein, 7 aa, Homo sapiens
KKETERI

SEQ ID NO: 3891 - protein, 7 aa, Homo sapiens
RIEKERM

SEQ ID NO: 3892 - protein, 7 aa, Homo sapiens
RIEKERM

SEQ ID NO: 3893 - protein, 7 aa, Homo sapiens
RIEKERM

SEQ ID NO: 3894 - protein, 11 aa, Homo sapiens
KIKIIAPPERK

SEQ ID NO: 3895 - protein, 7 aa, Homo sapiens
RIEKERM

SEQ ID NO: 3896 - protein, 8 aa, Homo sapiens
MAGRTVRA

SEQ ID NO: 3897 - protein, 10 aa, Homo sapiens
KKVMATIEKV

SEQ ID NO: 3898 - protein, 10 aa, Homo sapiens
KKVMATIEKV

SEQ ID NO: 3899 - protein, 10 aa, Homo sapiens
KKVMATIEKV

SEQ ID NO: 3900 - protein, 8 aa, Homo sapiens
REQKAKRN

SEQ ID NO: 3901 - protein, 8 aa, Homo sapiens
REQKAKRN

SEQ ID NO: 3902 - protein, 9 aa, Homo sapiens
RAKDDIKKV

SEQ ID NO: 3903 - protein, 8 aa, Homo sapiens
REQKAKRN

SEQ ID NO: 3904 - protein, 8 aa, Homo sapiens
REQKAKRN

SEQ ID NO: 3905 - protein, 8 aa, Homo sapiens
REQKAKRN

SEQ ID NO: 3906 - protein, 8 aa, Homo sapiens
REQKAKRN

SEQ ID NO: 3907 - protein, 12 aa, Homo sapiens
MAGRTVRAETRS

SEQ ID NO: 3908 - protein, 10 aa, Homo sapiens
RSRAKDDIKR

SEQ ID NO: 3909 - protein, 10 aa, Homo sapiens
RSRAKDDIKR

SEQ ID NO: 3910 - protein, 9 aa, Homo sapiens
RAKDDIKKV

SEQ ID NO: 3911 - protein, 8 aa, Homo sapiens
RAKDDIKR

SEQ ID NO: 3912 - protein, 10 aa, Homo sapiens
RSRAKDDIKR

SEQ ID NO: 3913 - protein, 9 aa, Homo sapiens
RAKDDIKKV

SEQ ID NO: 3914 - protein, 8 aa, Homo sapiens
KIQKLTKA

SEQ ID NO: 3915 - protein, 11 aa, Homo sapiens
KVMATIEKVRR

SEQ ID NO: 3916 - protein, 10 aa, Homo sapiens
RSRAKDDIKR

SEQ ID NO: 3917 - protein, 8 aa, Homo sapiens
KIQKLTKA

SEQ ID NO: 3918 - protein, 8 aa, Homo sapiens
KIQKLTKA

SEQ ID NO: 3919 - protein, 9 aa, Homo sapiens
RAKDDIKKV

SEQ ID NO: 3920 - protein, 9 aa, Homo sapiens
RAKDDIKKV

SEQ ID NO: 3921 - protein, 9 aa, Homo sapiens
RAKDDIKKV

SEQ ID NO: 3922 - protein, 9 aa, Homo sapiens
RAKDDIKKV

SEQ ID NO: 3923 - protein, 11 aa, Homo sapiens
RHIFAKVQQRR

SEQ ID NO: 3924 - protein, 11 aa, Homo sapiens
KATIELKALRL

SEQ ID NO: 3925 - protein, 11 aa, Homo sapiens
KATIELKALRL

SEQ ID NO: 3926 - protein, 11 aa, Homo sapiens
KATIELKALRL

SEQ ID NO: 3927 - protein, 11 aa, Homo sapiens
KATIELKALRL

SEQ ID NO: 3928 - protein, 13 aa, Homo sapiens
RTKATIELKALRL

SEQ ID NO: 3929 - protein, 11 aa, Homo sapiens
KATIELKALRL

SEQ ID NO: 3930 - protein, 13 aa, Homo sapiens
RTKATIELKALRL

SEQ ID NO: 3931 - protein, 11 aa, Homo sapiens
KATIELKALRL

SEQ ID NO: 3932 - protein, 11 aa, Homo sapiens
KATIELKALRL

SEQ ID NO: 3933 - protein, 7 aa, Homo sapiens
RLKGGRR

SEQ ID NO: 3934 - protein, 7 aa, Homo sapiens
RLKGGRR

SEQ ID NO: 3935 - protein, 9 aa, Homo sapiens
RTDPLEKRG

SEQ ID NO: 3936 - protein, 9 aa, Homo sapiens
RTDPLEKRG

SEQ ID NO: 3937 - protein, 9 aa, Homo sapiens
RTDPLEKRG

SEQ ID NO: 3938 - protein, 12 aa, Homo sapiens
KPYACDICGKRY

SEQ ID NO: 3939 - protein, 7 aa, Homo sapiens
RQKIAKE

SEQ ID NO: 3940 - protein, 7 aa, Homo sapiens
KIKLNKK

SEQ ID NO: 3941 - protein, 9 aa, Homo sapiens
KDFKEYHRS

SEQ ID NO: 3942 - protein, 7 aa, Homo sapiens
RQKIAKE

SEQ ID NO: 3943 - protein, 7 aa, Homo sapiens
RQKIAKE

SEQ ID NO: 3944 - protein, 7 aa, Homo sapiens
RQKIAKE

SEQ ID NO: 3945 - protein, 9 aa, Homo sapiens
RSEEQKSKK

SEQ ID NO: 3946 - protein, 7 aa, Homo sapiens
RQKIAKE

SEQ ID NO: 3947 - protein, 13 aa, Homo sapiens
RKELPEYYELIRK

SEQ ID NO: 3948 - protein, 13 aa, Homo sapiens
RKELPEYYELIRK

SEQ ID NO: 3949 - protein, 19 aa, Homo sapiens
KKEGLISQDGSSLEALLRT

SEQ ID NO: 3950 - protein, 12 aa, Homo sapiens
KVEEAAKVTGKA

SEQ ID NO: 3951 - protein, 9 aa, Homo sapiens
RTDPLEKRG

SEQ ID NO: 3952 - protein, 15 aa, Homo sapiens
RALPEFFNGKNKSKT

SEQ ID NO: 3953 - protein, 15 aa, Homo sapiens
RALPEFFNGKNKSKT

SEQ ID NO: 3954 - protein, 9 aa, Homo sapiens
KKGGNYKKR

SEQ ID NO: 3955 - protein, 10 aa, Homo sapiens
KGKGVGSARK

SEQ ID NO: 3956 - protein, 8 aa, Homo sapiens
KEPKEPRE

SEQ ID NO: 3957 - protein, 8 aa, Homo sapiens
KEPKEPRE

SEQ ID NO: 3958 - protein, 8 aa, Homo sapiens
KEPKEPRE

SEQ ID NO: 3959 - protein, 8 aa, Homo sapiens
KEPKEPRE

SEQ ID NO: 3960 - protein, 8 aa, Homo sapiens
KEPKEPRE

SEQ ID NO: 3961 - protein, 8 aa, Homo sapiens
KEPKEPRE

SEQ ID NO: 3962 - protein, 8 aa, Homo sapiens
KEPKEPRE

SEQ ID NO: 3963 - protein, 8 aa, Homo sapiens
KEPKEPRE

SEQ ID NO: 3964 - protein, 8 aa, Homo sapiens
KEPKEPRE

SEQ ID NO: 3965 - protein, 8 aa, Homo sapiens
KEPKEPRE

SEQ ID NO: 3966 - protein, 9 aa, Homo sapiens
RTDPLEKRG

SEQ ID NO: 3967 - protein, 9 aa, Homo sapiens
RTDPLEKRG

SEQ ID NO: 3968 - protein, 12 aa, Homo sapiens
KSKGKGVGSARK

SEQ ID NO: 3969 - protein, 11 aa, Homo sapiens
KMADKILPQRI

SEQ ID NO: 3970 - protein, 9 aa, Homo sapiens
RKVWDQVKA

SEQ ID NO: 3971 - protein, 9 aa, Homo sapiens
RKVWDQVKA

SEQ ID NO: 3972 - protein, 9 aa, Homo sapiens
RTDPLEKRG

SEQ ID NO: 3973 - protein, 22 aa, Homo sapiens
KVEVDMEKIAAEIAQAEEQARK

SEQ ID NO: 3974 - protein, 10 aa, Homo sapiens
KGKGVGSARK

SEQ ID NO: 3975 - protein, 10 aa, Homo sapiens
KGKGVGSARK

SEQ ID NO: 3976 - protein, 10 aa, Homo sapiens
KGKGVGSARK

SEQ ID NO: 3977 - protein, 12 aa, Homo sapiens
KSKGKGVGSARK

SEQ ID NO: 3978 - protein, 18 aa, Homo sapiens
KAGGALCHILGAAYKYKN

SEQ ID NO: 3979 - protein, 9 aa, Homo sapiens
RKASANARK

SEQ ID NO: 3980 - protein, 9 aa, Homo sapiens
RKASANARK

SEQ ID NO: 3981 - protein, 9 aa, Homo sapiens
RTDPLEKRG

SEQ ID NO: 3982 - protein, 9 aa, Homo sapiens
KKVQEAARA

SEQ ID NO: 3983 - protein, 8 aa, Homo sapiens
RKPVSFRQ

SEQ ID NO: 3984 - protein, 9 aa, Homo sapiens
RTDPLEKRG

SEQ ID NO: 3985 - protein, 9 aa, Homo sapiens
RTDPLEKRG

SEQ ID NO: 3986 - protein, 9 aa, Homo sapiens
RTDPLEKRG

SEQ ID NO: 3987 - protein, 9 aa, Homo sapiens
RTDPLEKRG

SEQ ID NO: 3988 - protein, 9 aa, Homo sapiens
RTDPLEKRG

SEQ ID NO: 3989 - protein, 9 aa, Homo sapiens
RTDPLEKRG

SEQ ID NO: 3990 - protein, 9 aa, Homo sapiens
KKIRDQDRN

SEQ ID NO: 3991 - protein, 19 aa, Homo sapiens
KKEGLISQDGSSLEALLRT

SEQ ID NO: 3992 - protein, 19 aa, Homo sapiens
KKEGLISQDGSSLEALLRT

SEQ ID NO: 3993 - protein, 18 aa, Homo sapiens
RDLKVMTDVAGNPEEERR

SEQ ID NO: 3994 - protein, 18 aa, Homo sapiens
RDLKVMTDVAGNPEEERR

SEQ ID NO: 3995 - protein, 18 aa, Homo sapiens
RDLKVMTDVAGNPEEERR

SEQ ID NO: 3996 - protein, 19 aa, Homo sapiens
RDLKVMTDVAGNPEEERRA

SEQ ID NO: 3997 - protein, 18 aa, Homo sapiens
RDLKVMTDVAGNPEEERR

SEQ ID NO: 3998 - protein, 19 aa, Homo sapiens
RDLKVMTDVAGNPEEERRA

SEQ ID NO: 3999 - protein, 19 aa, Homo sapiens
RDLKVMTDVAGNPEEERRA

SEQ ID NO: 4000 - protein, 19 aa, Homo sapiens
RDLKVMTDVAGNPEEERRA

SEQ ID NO: 4001 - protein, 18 aa, Homo sapiens
RDLKVMTDVAGNPEEERR

SEQ ID NO: 4002 - protein, 18 aa, Homo sapiens
RDLKVMTDVAGNPEEERR

SEQ ID NO: 4003 - protein, 12 aa, Homo sapiens
RAAKALLAMARV

SEQ ID NO: 4004 - protein, 12 aa, Homo sapiens
RAAKALLAMARV

SEQ ID NO: 4005 - protein, 8 aa, Homo sapiens
KLEKQQKI

SEQ ID NO: 4006 - protein, 12 aa, Homo sapiens
RAAKALLAMARV

SEQ ID NO: 4007 - protein, 12 aa, Homo sapiens
RAAKALLAMARV

SEQ ID NO: 4008 - protein, 12 aa, Homo sapiens
RAAKALLAMARV

SEQ ID NO: 4009 - protein, 12 aa, Homo sapiens
RAAKALLAMARV

SEQ ID NO: 4010 - protein, 12 aa, Homo sapiens
RAAKALLAMARV

SEQ ID NO: 4011 - protein, 12 aa, Homo sapiens
RAAKALLAMARV

SEQ ID NO: 4012 - protein, 12 aa, Homo sapiens
RAAKALLAMARV

SEQ ID NO: 4013 - protein, 8 aa, Homo sapiens
RRKITSKD

SEQ ID NO: 4014 - protein, 7 aa, Homo sapiens
RKITSKD

SEQ ID NO: 4015 - protein, 7 aa, Homo sapiens
RKITSKD

SEQ ID NO: 4016 - protein, 6 aa, Homo sapiens
KAYKRS

SEQ ID NO: 4017 - protein, 6 aa, Homo sapiens
KAYKRS

SEQ ID NO: 4018 - protein, 9 aa, Homo sapiens
KKPLDLFRL

SEQ ID NO: 4019 - protein, 12 aa, Homo sapiens
RAAKALLAMARV

SEQ ID NO: 4020 - protein, 12 aa, Homo sapiens
RAAKALLAMARV

SEQ ID NO: 4021 - protein, 12 aa, Homo sapiens
RAAKALLAMARV

SEQ ID NO: 4022 - protein, 12 aa, Homo sapiens
RAAKALLAMARV

SEQ ID NO: 4023 - protein, 12 aa, Homo sapiens
RAAKALLAMARV

SEQ ID NO: 4024 - protein, 12 aa, Homo sapiens
RAAKALLAMARV

SEQ ID NO: 4025 - protein, 12 aa, Homo sapiens
RAAKALLAMARV

SEQ ID NO: 4026 - protein, 12 aa, Homo sapiens
RAAKALLAMARV

SEQ ID NO: 4027 - protein, 17 aa, Homo sapiens
RRDTALETALNAKAYKR

SEQ ID NO: 4028 - protein, 17 aa, Homo sapiens
RDTALETALNAKAYKRS

SEQ ID NO: 4029 - protein, 16 aa, Homo sapiens
RDTALETALNAKAYKR

SEQ ID NO: 4030 - protein, 17 aa, Homo sapiens
RDTALETALNAKAYKRS

SEQ ID NO: 4031 - protein, 17 aa, Homo sapiens
RDTALETALNAKAYKRS

SEQ ID NO: 4032 - protein, 17 aa, Homo sapiens
RRDTALETALNAKAYKR

SEQ ID NO: 4033 - protein, 16 aa, Homo sapiens
RDTALETALNAKAYKR

SEQ ID NO: 4034 - protein, 14 aa, Homo sapiens
RHMDGMYGPPAKRH

SEQ ID NO: 4035 - protein, 12 aa, Homo sapiens
KVSYKGSPAARR

SEQ ID NO: 4036 - protein, 8 aa, Homo sapiens
RRKITSKD

SEQ ID NO: 4037 - protein, 7 aa, Homo sapiens
RKITSKD

SEQ ID NO: 4038 - protein, 7 aa, Homo sapiens
RKITSKD

SEQ ID NO: 4039 - protein, 8 aa, Homo sapiens
RRKITSKD

SEQ ID NO: 4040 - protein, 8 aa, Homo sapiens
RRKITSKD

SEQ ID NO: 4041 - protein, 8 aa, Homo sapiens
RRKITSKD

SEQ ID NO: 4042 - protein, 8 aa, Homo sapiens
RRKITSKD

SEQ ID NO: 4043 - protein, 8 aa, Homo sapiens
RRKITSKD

SEQ ID NO: 4044 - protein, 7 aa, Homo sapiens
RKITSKD

SEQ ID NO: 4045 - protein, 16 aa, Homo sapiens
RKITSKDIVTPEAWRV

SEQ ID NO: 4046 - protein, 16 aa, Homo sapiens
RKITSKDIVTPEAWRV

SEQ ID NO: 4047 - protein, 15 aa, Homo sapiens
KITSKDIVTPEAWRV

SEQ ID NO: 4048 - protein, 16 aa, Homo sapiens
RKITSKDIVTPEAWRV

SEQ ID NO: 4049 - protein, 16 aa, Homo sapiens
RKITSKDIVTPEAWRV

SEQ ID NO: 4050 - protein, 15 aa, Homo sapiens
KITSKDIVTPEAWRV

SEQ ID NO: 4051 - protein, 16 aa, Homo sapiens
RKITSKDIVTPEAWRV

SEQ ID NO: 4052 - protein, 12 aa, Homo sapiens
RAAKALLAMARV

SEQ ID NO: 4053 - protein, 12 aa, Homo sapiens
RAAKALLAMARV

SEQ ID NO: 4054 - protein, 12 aa, Homo sapiens
RAAKALLAMARV

SEQ ID NO: 4055 - protein, 14 aa, Homo sapiens
RHMDGMYGPPAKRH

SEQ ID NO: 4056 - protein, 16 aa, Homo sapiens
RKITSKDIVTPEAWRV

SEQ ID NO: 4057 - protein, 16 aa, Homo sapiens
RKITSKDIVTPEAWRV

SEQ ID NO: 4058 - protein, 16 aa, Homo sapiens
RKITSKDIVTPEAWRV

SEQ ID NO: 4059 - protein, 16 aa, Homo sapiens
RKITSKDIVTPEAWRV

SEQ ID NO: 4060 - protein, 21 aa, Homo sapiens
RKRPAPQQIQQVQQQAVQNRN

SEQ ID NO: 4061 - protein, 21 aa, Homo sapiens
RKRPAPQQIQQVQQQAVQNRN

SEQ ID NO: 4062 - protein, 21 aa, Homo sapiens
RKRPAPQQIQQVQQQAVQNRN

SEQ ID NO: 4063 - protein, 12 aa, Homo sapiens
KRLDIQEALKRP

SEQ ID NO: 4064 - protein, 9 aa, Homo sapiens
RNHNAKKKK

SEQ ID NO: 4065 - protein, 18 aa, Homo sapiens
RDLKTMTDVVGNPEEERR

SEQ ID NO: 4066 - protein, 19 aa, Homo sapiens
RDLKTMTDVVGNPEEERRA

SEQ ID NO: 4067 - protein, 19 aa, Homo sapiens
RDLKTMTDVVGNPEEERRA

SEQ ID NO: 4068 - protein, 19 aa, Homo sapiens
RDLKTMTDVVGNPEEERRA

SEQ ID NO: 4069 - protein, 19 aa, Homo sapiens
RDLKTMTDVVGNPEEERRA

SEQ ID NO: 4070 - protein, 18 aa, Homo sapiens
RDLKTMTDVVGNPEEERR

SEQ ID NO: 4071 - protein, 19 aa, Homo sapiens
RDLKTMTDVVGNPEEERRA

SEQ ID NO: 4072 - protein, 18 aa, Homo sapiens
RDLKTMTDVVGNPEEERR

SEQ ID NO: 4073 - protein, 18 aa, Homo sapiens
RDLKTMTDVVGNPEEERR

SEQ ID NO: 4074 - protein, 18 aa, Homo sapiens
RDLKTMTDVVGNPEEERR

SEQ ID NO: 4075 - protein, 19 aa, Homo sapiens
RDLKTMTDVVGNPEEERRA

SEQ ID NO: 4076 - protein, 14 aa, Homo sapiens
RLDIQEALKRPIKQ

SEQ ID NO: 4077 - protein, 10 aa, Homo sapiens
RKLDQTIMRK

SEQ ID NO: 4078 - protein, 10 aa, Homo sapiens
RKLDQTIMRK

SEQ ID NO: 4079 - protein, 10 aa, Homo sapiens
RKLDQTIMRK

SEQ ID NO: 4080 - protein, 10 aa, Homo sapiens
RKLDQTIMRK

SEQ ID NO: 4081 - protein, 11 aa, Homo sapiens
RKLDQTIMRKR

SEQ ID NO: 4082 - protein, 10 aa, Homo sapiens
RKLDQTIMRK

SEQ ID NO: 4083 - protein, 10 aa, Homo sapiens
RKLDQTIMRK

SEQ ID NO: 4084 - protein, 10 aa, Homo sapiens
RKLDQTIMRK

SEQ ID NO: 4085 - protein, 10 aa, Homo sapiens
RKLDQTIMRK

SEQ ID NO: 4086 - protein, 11 aa, Homo sapiens
RKLDQTIMRKR

SEQ ID NO: 4087 - protein, 11 aa, Homo sapiens
RKLDQTIMRKR

SEQ ID NO: 4088 - protein, 10 aa, Homo sapiens
RKLDQTIMRK

SEQ ID NO: 4089 - protein, 11 aa, Homo sapiens
RKLDQTIMRKR

SEQ ID NO: 4090 - protein, 11 aa, Homo sapiens
RKLDQTIMRKR

SEQ ID NO: 4091 - protein, 11 aa, Homo sapiens
RKLDQTIMRKR

SEQ ID NO: 4092 - protein, 10 aa, Homo sapiens
RKLDQTIMRK

SEQ ID NO: 4093 - protein, 10 aa, Homo sapiens
RKLDQTIMRK

SEQ ID NO: 4094 - protein, 10 aa, Homo sapiens
RKLDQTIMRK

SEQ ID NO: 4095 - protein, 21 aa, Homo sapiens
REITFPPGSVEASQPVLKQRR

SEQ ID NO: 4096 - protein, 21 aa, Homo sapiens
REITFPPGSVEASQPVLKQRR

SEQ ID NO: 4097 - protein, 21 aa, Homo sapiens
REITFPPGSVEASQPVLKQRR

SEQ ID NO: 4098 - protein, 21 aa, Homo sapiens
REITFPPGSVEASQPVLKQRR

SEQ ID NO: 4099 - protein, 16 aa, Homo sapiens
RKITSKDIVTPEAWRV

SEQ ID NO: 4100 - protein, 15 aa, Homo sapiens
KITSKDIVTPEAWRV

SEQ ID NO: 4101 - protein, 15 aa, Homo sapiens
KITSKDIVTPEAWRV

SEQ ID NO: 4102 - protein, 16 aa, Homo sapiens
RKITSKDIVTPEAWRV

SEQ ID NO: 4103 - protein, 15 aa, Homo sapiens
KITSKDIVTPEAWRV

SEQ ID NO: 4104 - protein, 15 aa, Homo sapiens
KITSKDIVTPEAWRV

SEQ ID NO: 4105 - protein, 15 aa, Homo sapiens
KDDWNKVSEHVGSRT

SEQ ID NO: 4106 - protein, 12 aa, Homo sapiens
KAKHLAAVEERK

SEQ ID NO: 4107 - protein, 12 aa, Homo sapiens
KAKHLAAVEERK

SEQ ID NO: 4108 - protein, 12 aa, Homo sapiens
KAKHLAAVEERK

SEQ ID NO: 4109 - protein, 12 aa, Homo sapiens
KAKHLAAVEERK

SEQ ID NO: 4110 - protein, 9 aa, Homo sapiens
RKKEQEGKG

SEQ ID NO: 4111 - protein, 9 aa, Homo sapiens
RKKEQEGKG

SEQ ID NO: 4112 - protein, 12 aa, Homo sapiens
RNIKLLEDEPRS

SEQ ID NO: 4113 - protein, 12 aa, Homo sapiens
RNIKLLEDEPRS

SEQ ID NO: 4114 - protein, 9 aa, Homo sapiens
RKKEQEGKG

SEQ ID NO: 4115 - protein, 11 aa, Homo sapiens
KSKAAASATRE

SEQ ID NO: 4116 - protein, 11 aa, Homo sapiens
KSKAAASATRE

SEQ ID NO: 4117 - protein, 11 aa, Homo sapiens
KSKAAASATRE

SEQ ID NO: 4118 - protein, 14 aa, Homo sapiens
RGKGEITPAAIQKM

SEQ ID NO: 4119 - protein, 11 aa, Homo sapiens
KMADKVLPQRI

SEQ ID NO: 4120 - protein, 19 aa, Homo sapiens
RDLKIITDVIGNPEEERRA

SEQ ID NO: 4121 - protein, 18 aa, Homo sapiens
RDLKIITDVIGNPEEERR

SEQ ID NO: 4122 - protein, 19 aa, Homo sapiens
RDLKIITDVIGNPEEERRA

SEQ ID NO: 4123 - protein, 19 aa, Homo sapiens
RDLKIITDVIGNPEEERRA

SEQ ID NO: 4124 - protein, 18 aa, Homo sapiens
RDLKIITDVIGNPEEERR

SEQ ID NO: 4125 - protein, 19 aa, Homo sapiens
RDLKIITDVIGNPEEERRA

SEQ ID NO: 4126 - protein, 19 aa, Homo sapiens
RDLKIITDVIGNPEEERRA

SEQ ID NO: 4127 - protein, 19 aa, Homo sapiens
RDLKIITDVIGNPEEERRA

SEQ ID NO: 4128 - protein, 19 aa, Homo sapiens
RDLKIITDVIGNPEEERRA

SEQ ID NO: 4129 - protein, 19 aa, Homo sapiens
RDLKIITDVIGNPEEERRA

SEQ ID NO: 4130 - protein, 18 aa, Homo sapiens
RDLKIITDVIGNPEEERR

SEQ ID NO: 4131 - protein, 19 aa, Homo sapiens
RDLKIITDVIGNPEEERRA

SEQ ID NO: 4132 - protein, 18 aa, Homo sapiens
RDLKIITDVIGNPEEERR

SEQ ID NO: 4133 - protein, 18 aa, Homo sapiens
RDLKIITDVIGNPEEERR

SEQ ID NO: 4134 - protein, 19 aa, Homo sapiens
RDLKIITDVIGNPEEERRA

SEQ ID NO: 4135 - protein, 19 aa, Homo sapiens
RDLKIITDVIGNPEEERRA

SEQ ID NO: 4136 - protein, 19 aa, Homo sapiens
RDLKIITDVIGNPEEERRA

SEQ ID NO: 4137 - protein, 19 aa, Homo sapiens
RDLKIITDVIGNPEEERRA

SEQ ID NO: 4138 - protein, 19 aa, Homo sapiens
RDLKIITDVIGNPEEERRA

SEQ ID NO: 4139 - protein, 19 aa, Homo sapiens
RDLKIITDVIGNPEEERRA

SEQ ID NO: 4140 - protein, 19 aa, Homo sapiens
RDLKIITDVIGNPEEERRA

SEQ ID NO: 4141 - protein, 19 aa, Homo sapiens
RDLKIITDVIGNPEEERRA

SEQ ID NO: 4142 - protein, 18 aa, Homo sapiens
RDLKIITDVIGNPEEERR

SEQ ID NO: 4143 - protein, 19 aa, Homo sapiens
RDLKIITDVIGNPEEERRA

SEQ ID NO: 4144 - protein, 19 aa, Homo sapiens
RDLKIITDVIGNPEEERRA

SEQ ID NO: 4145 - protein, 18 aa, Homo sapiens
RDLKIITDVIGNPEEERR

SEQ ID NO: 4146 - protein, 18 aa, Homo sapiens
RDLKIITDVIGNPEEERR

SEQ ID NO: 4147 - protein, 18 aa, Homo sapiens
RDLKIITDVIGNPEEERR

SEQ ID NO: 4148 - protein, 18 aa, Homo sapiens
RDLKIITDVIGNPEEERR

SEQ ID NO: 4149 - protein, 19 aa, Homo sapiens
RDLKIITDVIGNPEEERRA

SEQ ID NO: 4150 - protein, 19 aa, Homo sapiens
RDLKIITDVIGNPEEERRA

SEQ ID NO: 4151 - protein, 19 aa, Homo sapiens
RDLKIITDVIGNPEEERRA

SEQ ID NO: 4152 - protein, 18 aa, Homo sapiens
RDLKIITDVIGNPEEERR

SEQ ID NO: 4153 - protein, 18 aa, Homo sapiens
RDLKIITDVIGNPEEERR

SEQ ID NO: 4154 - protein, 18 aa, Homo sapiens
RDLKIITDVIGNPEEERR

SEQ ID NO: 4155 - protein, 18 aa, Homo sapiens
RDLKIITDVIGNPEEERR

SEQ ID NO: 4156 - protein, 19 aa, Homo sapiens
RRDLKIITDVIGNPEEERR

SEQ ID NO: 4157 - protein, 18 aa, Homo sapiens
RDLKIITDVIGNPEEERR

SEQ ID NO: 4158 - protein, 18 aa, Homo sapiens
RDLKIITDVIGNPEEERR

SEQ ID NO: 4159 - protein, 19 aa, Homo sapiens
RDLKIITDVIGNPEEERRA

SEQ ID NO: 4160 - protein, 19 aa, Homo sapiens
RDLKIITDVIGNPEEERRA

SEQ ID NO: 4161 - protein, 19 aa, Homo sapiens
RDLKIITDVIGNPEEERRA

SEQ ID NO: 4162 - protein, 18 aa, Homo sapiens
RDLKIITDVIGNPEEERR

SEQ ID NO: 4163 - protein, 19 aa, Homo sapiens
RRDLKIITDVIGNPEEERR

SEQ ID NO: 4164 - protein, 18 aa, Homo sapiens
RDLKIITDVIGNPEEERR

SEQ ID NO: 4165 - protein, 19 aa, Homo sapiens
RDLKIITDVIGNPEEERRA

SEQ ID NO: 4166 - protein, 18 aa, Homo sapiens
RDLKIITDVIGNPEEERR

SEQ ID NO: 4167 - protein, 18 aa, Homo sapiens
RDLKIITDVIGNPEEERR

SEQ ID NO: 4168 - protein, 19 aa, Homo sapiens
RDLKIITDVIGNPEEERRA

SEQ ID NO: 4169 - protein, 19 aa, Homo sapiens
RDLKIITDVIGNPEEERRA

SEQ ID NO: 4170 - protein, 19 aa, Homo sapiens
RDLKIITDVIGNPEEERRA

SEQ ID NO: 4171 - protein, 18 aa, Homo sapiens
RDLKIITDVIGNPEEERR

SEQ ID NO: 4172 - protein, 18 aa, Homo sapiens
RDLKIITDVIGNPEEERR

SEQ ID NO: 4173 - protein, 19 aa, Homo sapiens
RDLKIITDVIGNPEEERRA

SEQ ID NO: 4174 - protein, 19 aa, Homo sapiens
RDLKIITDVIGNPEEERRA

SEQ ID NO: 4175 - protein, 11 aa, Homo sapiens
RHIFAKVQQRR

SEQ ID NO: 4176 - protein, 13 aa, Homo sapiens
RYVGDRKNPVCRE

SEQ ID NO: 4177 - protein, 13 aa, Homo sapiens
RYVGDRKNPVCRE

SEQ ID NO: 4178 - protein, 10 aa, Homo sapiens
RKLDQTIARK

SEQ ID NO: 4179 - protein, 10 aa, Homo sapiens
RKLDQTIARK

SEQ ID NO: 4180 - protein, 10 aa, Homo sapiens
RKLDQTIARK

SEQ ID NO: 4181 - protein, 10 aa, Homo sapiens
RKLDQTIARK

SEQ ID NO: 4182 - protein, 10 aa, Homo sapiens
RKLDQTIARK

SEQ ID NO: 4183 - protein, 10 aa, Homo sapiens
RKLDQTIARK

SEQ ID NO: 4184 - protein, 10 aa, Homo sapiens
RKLDQTIARK

SEQ ID NO: 4185 - protein, 10 aa, Homo sapiens
RKLDQTIARK

SEQ ID NO: 4186 - protein, 10 aa, Homo sapiens
RKLDQTIARK

SEQ ID NO: 4187 - protein, 8 aa, Homo sapiens
REQKAKRN

SEQ ID NO: 4188 - protein, 12 aa, Homo sapiens
RVMAAIEKVRKW

SEQ ID NO: 4189 - protein, 12 aa, Homo sapiens
RVMAAIEKVRKW

SEQ ID NO: 4190 - protein, 9 aa, Homo sapiens
KKVQEAARA

SEQ ID NO: 4191 - protein, 9 aa, Homo sapiens
KKVQEAARA

SEQ ID NO: 4192 - protein, 9 aa, Homo sapiens
RTDIYSKKT

SEQ ID NO: 4193 - protein, 9 aa, Homo sapiens
RTDIYSKKT

SEQ ID NO: 4194 - protein, 8 aa, Homo sapiens
RSDKLGRV

SEQ ID NO: 4195 - protein, 8 aa, Homo sapiens
RSDKLGRV

SEQ ID NO: 4196 - protein, 8 aa, Homo sapiens
RSDKLGRV

SEQ ID NO: 4197 - protein, 14 aa, Homo sapiens
KEDEDPAKGDQSRS

SEQ ID NO: 4198 - protein, 14 aa, Homo sapiens
KEDEDPAKGDQSRS

SEQ ID NO: 4199 - protein, 14 aa, Homo sapiens
KEDEDPAKGDQSRS

SEQ ID NO: 4200 - protein, 8 aa, Homo sapiens
KKPLTQKR

SEQ ID NO: 4201 - protein, 9 aa, Homo sapiens
KKPLTQKRK

SEQ ID NO: 4202 - protein, 9 aa, Homo sapiens
KKPLTQKRK

SEQ ID NO: 4203 - protein, 9 aa, Homo sapiens
KKPLTQKRK

SEQ ID NO: 4204 - protein, 16 aa, Homo sapiens
RQNFHMEQLKYAELRA

SEQ ID NO: 4205 - protein, 16 aa, Homo sapiens
RQNFHMEQLKYAELRA

SEQ ID NO: 4206 - protein, 16 aa, Homo sapiens
RQNFHMEQLKYAELRA

SEQ ID NO: 4207 - protein, 16 aa, Homo sapiens
RQNFHMEQLKYAELRA

SEQ ID NO: 4208 - protein, 16 aa, Homo sapiens
RQNFHMEQLKYAELRA

SEQ ID NO: 4209 - protein, 16 aa, Homo sapiens
RQNFHMEQLKYAELRA

SEQ ID NO: 4210 - protein, 16 aa, Homo sapiens
RQNFHMEQLKYAELRA

SEQ ID NO: 4211 - protein, 16 aa, Homo sapiens
RQNFHMEQLKYAELRA

SEQ ID NO: 4212 - protein, 12 aa, Homo sapiens
KKGQASLYGKRR

SEQ ID NO: 4213 - protein, 9 aa, Homo sapiens
KKVQEAARA

SEQ ID NO: 4214 - protein, 9 aa, Homo sapiens
KKVQEAARA

SEQ ID NO: 4215 - protein, 13 aa, Homo sapiens
RDPKGYVQDLLRS

SEQ ID NO: 4216 - protein, 11 aa, Homo sapiens
RDRKASANARK

SEQ ID NO: 4217 - protein, 16 aa, Homo sapiens
RQNFHMEQLKYAELRA

SEQ ID NO: 4218 - protein, 16 aa, Homo sapiens
RQNFHMEQLKYAELRA

SEQ ID NO: 4219 - protein, 16 aa, Homo sapiens
RQNFHMEQLKYAELRA

SEQ ID NO: 4220 - protein, 16 aa, Homo sapiens
RQNFHMEQLKYAELRA

SEQ ID NO: 4221 - protein, 16 aa, Homo sapiens
RQNFHMEQLKYAELRA

SEQ ID NO: 4222 - protein, 16 aa, Homo sapiens
RQNFHMEQLKYAELRA

SEQ ID NO: 4223 - protein, 16 aa, Homo sapiens
RQNFHMEQLKYAELRA

SEQ ID NO: 4224 - protein, 16 aa, Homo sapiens
RQNFHMEQLKYAELRA

SEQ ID NO: 4225 - protein, 9 aa, Homo sapiens
KKVQEAARA

SEQ ID NO: 4226 - protein, 9 aa, Homo sapiens
KKVQEAARA

SEQ ID NO: 4227 - protein, 9 aa, Homo sapiens
KKVQEAARA

SEQ ID NO: 4228 - protein, 11 aa, Homo sapiens
RYFYSKVQQRR

SEQ ID NO: 4229 - protein, 11 aa, Homo sapiens
RYFYSKVQQRR

SEQ ID NO: 4230 - protein, 16 aa, Homo sapiens
RQNFHMEQLKYAELRA

SEQ ID NO: 4231 - protein, 16 aa, Homo sapiens
RQNFHMEQLKYAELRA

SEQ ID NO: 4232 - protein, 16 aa, Homo sapiens
RQNFHMEQLKYAELRA

SEQ ID NO: 4233 - protein, 16 aa, Homo sapiens
RQNFHMEQLKYAELRA

SEQ ID NO: 4234 - protein, 16 aa, Homo sapiens
RQNFHMEQLKYAELRA

SEQ ID NO: 4235 - protein, 16 aa, Homo sapiens
RQNFHMEQLKYAELRA

SEQ ID NO: 4236 - protein, 16 aa, Homo sapiens
RQNFHMEQLKYAELRA

SEQ ID NO: 4237 - protein, 16 aa, Homo sapiens
RQNFHMEQLKYAELRA

SEQ ID NO: 4238 - protein, 16 aa, Homo sapiens
RQNFHMEQLKYAELRA

SEQ ID NO: 4239 - protein, 16 aa, Homo sapiens
RQNFHMEQLKYAELRA

SEQ ID NO: 4240 - protein, 16 aa, Homo sapiens
RQNFHMEQLKYAELRA

SEQ ID NO: 4241 - protein, 16 aa, Homo sapiens
RQNFHMEQLKYAELRA

SEQ ID NO: 4242 - protein, 16 aa, Homo sapiens
RQNFHMEQLKYAELRA

SEQ ID NO: 4243 - protein, 16 aa, Homo sapiens
RQNFHMEQLKYAELRA

SEQ ID NO: 4244 - protein, 16 aa, Homo sapiens
RQNFHMEQLKYAELRA

SEQ ID NO: 4245 - protein, 16 aa, Homo sapiens
RQNFHMEQLKYAELRA

SEQ ID NO: 4246 - protein, 16 aa, Homo sapiens
RQNFHMEQLKYAELRA

SEQ ID NO: 4247 - protein, 16 aa, Homo sapiens
RQNFHMEQLKYAELRA

SEQ ID NO: 4248 - protein, 16 aa, Homo sapiens
RQNFHMEQLKYAELRA

SEQ ID NO: 4249 - protein, 16 aa, Homo sapiens
RQNFHMEQLKYAELRA

SEQ ID NO: 4250 - protein, 16 aa, Homo sapiens
RQNFHMEQLKYAELRA

SEQ ID NO: 4251 - protein, 16 aa, Homo sapiens
RQNFHMEQLKYAELRA

SEQ ID NO: 4252 - protein, 16 aa, Homo sapiens
RQNFHMEQLKYAELRA

SEQ ID NO: 4253 - protein, 16 aa, Homo sapiens
RQNFHMEQLKYAELRA

SEQ ID NO: 4254 - protein, 16 aa, Homo sapiens
RQNFHMEQLKYAELRA

SEQ ID NO: 4255 - protein, 16 aa, Homo sapiens
RQNFHMEQLKYAELRA

SEQ ID NO: 4256 - protein, 6 aa, Homo sapiens
KRKLRI

SEQ ID NO: 4257 - protein, 12 aa, Homo sapiens
KTHKLQDPHERE

SEQ ID NO: 4258 - protein, 12 aa, Homo sapiens
KTHKLQDPHERE

SEQ ID NO: 4259 - protein, 12 aa, Homo sapiens
KTHKLQDPHERE

SEQ ID NO: 4260 - protein, 12 aa, Homo sapiens
KTHKLQDPHERE

SEQ ID NO: 4261 - protein, 16 aa, Homo sapiens
RQNFHMEQLKYAELRA

SEQ ID NO: 4262 - protein, 12 aa, Homo sapiens
KTHKLQDPHERE

SEQ ID NO: 4263 - protein, 12 aa, Homo sapiens
KTHKLQDPHERE

SEQ ID NO: 4264 - protein, 12 aa, Homo sapiens
KTHKLQDPHERE

SEQ ID NO: 4265 - protein, 12 aa, Homo sapiens
KTHKLQDPHERE

SEQ ID NO: 4266 - protein, 12 aa, Homo sapiens
KTHKLQDPHERE

SEQ ID NO: 4267 - protein, 12 aa, Homo sapiens
KTHKLQDPHERE

SEQ ID NO: 4268 - protein, 16 aa, Homo sapiens
RQNFHMEQLKYAELRA

SEQ ID NO: 4269 - protein, 12 aa, Homo sapiens
KTHKLQDPHERE

SEQ ID NO: 4270 - protein, 16 aa, Homo sapiens
RQNFHMEQLKYAELRA

SEQ ID NO: 4271 - protein, 12 aa, Homo sapiens
KTHKLQDPHERE

SEQ ID NO: 4272 - protein, 12 aa, Homo sapiens
KTHKLQDPHERE

SEQ ID NO: 4273 - protein, 16 aa, Homo sapiens
RQNFHMEQLKYAELRA

SEQ ID NO: 4274 - protein, 16 aa, Homo sapiens
RQNFHMEQLKYAELRA

SEQ ID NO: 4275 - protein, 12 aa, Homo sapiens
KTHKLQDPHERE

SEQ ID NO: 4276 - protein, 12 aa, Homo sapiens
KTHKLQDPHERE

SEQ ID NO: 4277 - protein, 12 aa, Homo sapiens
KTHKLQDPHERE

SEQ ID NO: 4278 - protein, 12 aa, Homo sapiens
KTHKLQDPHERE

SEQ ID NO: 4279 - protein, 12 aa, Homo sapiens
KTHKLQDPHERE

SEQ ID NO: 4280 - protein, 12 aa, Homo sapiens
KTHKLQDPHERE

SEQ ID NO: 4281 - protein, 12 aa, Homo sapiens
KTHKLQDPHERE

SEQ ID NO: 4282 - protein, 12 aa, Homo sapiens
KTHKLQDPHERE

SEQ ID NO: 4283 - protein, 12 aa, Homo sapiens
KTHKLQDPHERE

SEQ ID NO: 4284 - protein, 12 aa, Homo sapiens
KTHKLQDPHERE

SEQ ID NO: 4285 - protein, 12 aa, Homo sapiens
KTHKLQDPHERE

SEQ ID NO: 4286 - protein, 9 aa, Homo sapiens
RKASANARK

SEQ ID NO: 4287 - protein, 9 aa, Homo sapiens
RKASANARK

SEQ ID NO: 4288 - protein, 11 aa, Homo sapiens
RMKFSEIPQRL

SEQ ID NO: 4289 - protein, 16 aa, Homo sapiens
KGKEKPTDMQNFGLRT

SEQ ID NO: 4290 - protein, 8 aa, Homo sapiens
KTVNTKKD

SEQ ID NO: 4291 - protein, 10 aa, Homo sapiens
KSKGASAGRE

SEQ ID NO: 4292 - protein, 9 aa, Homo sapiens
RESDTGKKK

SEQ ID NO: 4293 - protein, 17 aa, Homo sapiens
RVASAAAKSALEEFSKM

SEQ ID NO: 4294 - protein, 17 aa, Homo sapiens
RVASAAAKSALEEFSKM

SEQ ID NO: 4295 - protein, 17 aa, Homo sapiens
RVASAAAKSALEEFSKM

SEQ ID NO: 4296 - protein, 17 aa, Homo sapiens
RVASAAAKSALEEFSKM

SEQ ID NO: 4297 - protein, 17 aa, Homo sapiens
RVASAAAKSALEEFSKM

SEQ ID NO: 4298 - protein, 17 aa, Homo sapiens
RVASAAAKSALEEFSKM

SEQ ID NO: 4299 - protein, 17 aa, Homo sapiens
RVASAAAKSALEEFSKM

SEQ ID NO: 4300 - protein, 17 aa, Homo sapiens
RVASAAAKAALEEFSRV

SEQ ID NO: 4301 - protein, 17 aa, Homo sapiens
RVASAAAKAALEEFSRV

SEQ ID NO: 4302 - protein, 17 aa, Homo sapiens
RVASAAAKAALEEFSRV

SEQ ID NO: 4303 - protein, 17 aa, Homo sapiens
RVASAAAKAALEEFSRV

SEQ ID NO: 4304 - protein, 17 aa, Homo sapiens
RVASAAAKAALEEFSRV

SEQ ID NO: 4305 - protein, 17 aa, Homo sapiens
RVASAAAKAALEEFSRV

SEQ ID NO: 4306 - protein, 17 aa, Homo sapiens
RVASAAAKAALEEFSRV

SEQ ID NO: 4307 - protein, 17 aa, Homo sapiens
RVASAAAKAALEEFSRV

SEQ ID NO: 4308 - protein, 17 aa, Homo sapiens
RVASAAAKAALEEFSRV

SEQ ID NO: 4309 - protein, 17 aa, Homo sapiens
RVASAAAKAALEEFSRV

SEQ ID NO: 4310 - protein, 17 aa, Homo sapiens
RVASAAAKAALEEFSRV

SEQ ID NO: 4311 - protein, 17 aa, Homo sapiens
RVASAAAKAALEEFSRV

SEQ ID NO: 4312 - protein, 17 aa, Homo sapiens
RVASAAAKAALEEFSRV

SEQ ID NO: 4313 - protein, 7 aa, Homo sapiens
KTKVERD

SEQ ID NO: 4314 - protein, 9 aa, Homo sapiens
KKVQEAARA

SEQ ID NO: 4315 - protein, 8 aa, Homo sapiens
RKTKVERD

SEQ ID NO: 4316 - protein, 8 aa, Homo sapiens
RKTKVERD

SEQ ID NO: 4317 - protein, 9 aa, Homo sapiens
KKVQEAARA

SEQ ID NO: 4318 - protein, 9 aa, Homo sapiens
KKGGNYKKR

SEQ ID NO: 4319 - protein, 9 aa, Homo sapiens
RKASANARK

SEQ ID NO: 4320 - protein, 9 aa, Homo sapiens
RKASANARK

SEQ ID NO: 4321 - protein, 17 aa, Homo sapiens
RKFLESTDSFNNELKRL

SEQ ID NO: 4322 - protein, 17 aa, Homo sapiens
RKFLESTDSFNNELKRL

SEQ ID NO: 4323 - protein, 17 aa, Homo sapiens
RKFLESTDSFNNELKRL

SEQ ID NO: 4324 - protein, 11 aa, Homo sapiens
REKEALEQQRQ

SEQ ID NO: 4325 - protein, 17 aa, Homo sapiens
RKFLESTDSFNNELKRL

SEQ ID NO: 4326 - protein, 17 aa, Homo sapiens
RKFLESTDSFNNELKRL

SEQ ID NO: 4327 - protein, 17 aa, Homo sapiens
RKFLESTDSFNNELKRL

SEQ ID NO: 4328 - protein, 17 aa, Homo sapiens
RKFLESTDSFNNELKRL

SEQ ID NO: 4329 - protein, 17 aa, Homo sapiens
RKFLESTDSFNNELKRL

SEQ ID NO: 4330 - protein, 17 aa, Homo sapiens
RKFLESTDSFNNELKRL

SEQ ID NO: 4331 - protein, 16 aa, Homo sapiens
RKFLESTDSFNNELKR

SEQ ID NO: 4332 - protein, 17 aa, Homo sapiens
RKFLESTDSFNNELKRL

SEQ ID NO: 4333 - protein, 17 aa, Homo sapiens
RKFLESTDSFNNELKRL

SEQ ID NO: 4334 - protein, 11 aa, Homo sapiens
REKEALEQQRQ

SEQ ID NO: 4335 - protein, 17 aa, Homo sapiens
RKFLESTDSFNNELKRL

SEQ ID NO: 4336 - protein, 17 aa, Homo sapiens
RKFLESTDSFNNELKRL

SEQ ID NO: 4337 - protein, 17 aa, Homo sapiens
RKFLESTDSFNNELKRL

SEQ ID NO: 4338 - protein, 17 aa, Homo sapiens
RKFLESTDSFNNELKRL

SEQ ID NO: 4339 - protein, 17 aa, Homo sapiens
RKFLESTDSFNNELKRL

SEQ ID NO: 4340 - protein, 17 aa, Homo sapiens
RKFLESTDSFNNELKRL

SEQ ID NO: 4341 - protein, 17 aa, Homo sapiens
RKFLESTDSFNNELKRL

SEQ ID NO: 4342 - protein, 17 aa, Homo sapiens
RKFLESTDSFNNELKRL

SEQ ID NO: 4343 - protein, 16 aa, Homo sapiens
RQNFHMEQLKYAELRA

SEQ ID NO: 4344 - protein, 16 aa, Homo sapiens
RQNFHMEQLKYAELRA

SEQ ID NO: 4345 - protein, 16 aa, Homo sapiens
RQNFHMEQLKYAELRA

SEQ ID NO: 4346 - protein, 8 aa, Homo sapiens
RMQVLKRQ

SEQ ID NO: 4347 - protein, 8 aa, Homo sapiens
RMQVLKRQ

SEQ ID NO: 4348 - protein, 8 aa, Homo sapiens
RMQVLKRQ

SEQ ID NO: 4349 - protein, 8 aa, Homo sapiens
RMQVLKRQ

SEQ ID NO: 4350 - protein, 8 aa, Homo sapiens
RMQVLKRQ

SEQ ID NO: 4351 - protein, 12 aa, Homo sapiens
REKEAAEQAERS

SEQ ID NO: 4352 - protein, 8 aa, Homo sapiens
RMQVLKRQ

SEQ ID NO: 4353 - protein, 8 aa, Homo sapiens
RMQVLKRQ

SEQ ID NO: 4354 - protein, 8 aa, Homo sapiens
RMQVLKRQ

SEQ ID NO: 4355 - protein, 8 aa, Homo sapiens
RMQVLKRQ

SEQ ID NO: 4356 - protein, 8 aa, Homo sapiens
RMQVLKRQ

SEQ ID NO: 4357 - protein, 8 aa, Homo sapiens
RMQVLKRQ

SEQ ID NO: 4358 - protein, 8 aa, Homo sapiens
RMQVLKRQ

SEQ ID NO: 4359 - protein, 8 aa, Homo sapiens
RMQVLKRQ

SEQ ID NO: 4360 - protein, 8 aa, Homo sapiens
RMQVLKRQ

SEQ ID NO: 4361 - protein, 8 aa, Homo sapiens
RMQVLKRQ

SEQ ID NO: 4362 - protein, 13 aa, Homo sapiens
RIYKWVPVTEPKV

SEQ ID NO: 4363 - protein, 9 aa, Homo sapiens
RAKDDIKRV

SEQ ID NO: 4364 - protein, 9 aa, Homo sapiens
RAKDDIKRV

SEQ ID NO: 4365 - protein, 9 aa, Homo sapiens
RAKDDIKRV

SEQ ID NO: 4366 - protein, 9 aa, Homo sapiens
RAKDDIKRV

SEQ ID NO: 4367 - protein, 9 aa, Homo sapiens
RAKDDIKRV

SEQ ID NO: 4368 - protein, 9 aa, Homo sapiens
RAKDDIKRV

SEQ ID NO: 4369 - protein, 9 aa, Homo sapiens
RAKDDIKRV

SEQ ID NO: 4370 - protein, 8 aa, Homo sapiens
KIQKLTKA

SEQ ID NO: 4371 - protein, 8 aa, Homo sapiens
KIQKLTKA

SEQ ID NO: 4372 - protein, 9 aa, Homo sapiens
RAKDDIKRV

SEQ ID NO: 4373 - protein, 9 aa, Homo sapiens
RAKDDIKRV

SEQ ID NO: 4374 - protein, 9 aa, Homo sapiens
RAKDDIKRV

SEQ ID NO: 4375 - protein, 8 aa, Homo sapiens
KKGKDEKC

SEQ ID NO: 4376 - protein, 11 aa, Homo sapiens
RVMAAIEKVRK

SEQ ID NO: 4377 - protein, 7 aa, Homo sapiens
RLKGGRR

SEQ ID NO: 4378 - protein, 11 aa, Homo sapiens
RVMAAIEKVRK

SEQ ID NO: 4379 - protein, 8 aa, Homo sapiens
KKGKDEKC

SEQ ID NO: 4380 - protein, 7 aa, Homo sapiens
RKWEKKW

SEQ ID NO: 4381 - protein, 6 aa, Homo sapiens
RKWEKK

SEQ ID NO: 4382 - protein, 8 aa, Homo sapiens
KIQKLTKA

SEQ ID NO: 4383 - protein, 9 aa, Homo sapiens
RAKDDIKRV

SEQ ID NO: 4384 - protein, 10 aa, Homo sapiens
RSVAGKIQKL

SEQ ID NO: 4385 - protein, 10 aa, Homo sapiens
RSVAGKIQKL

SEQ ID NO: 4386 - protein, 9 aa, Homo sapiens
RAKDDIKRV

SEQ ID NO: 4387 - protein, 9 aa, Homo sapiens
RAKDDIKRV

SEQ ID NO: 4388 - protein, 9 aa, Homo sapiens
RAKDDIKRV

SEQ ID NO: 4389 - protein, 9 aa, Homo sapiens
RAKDDIKRV

SEQ ID NO: 4390 - protein, 9 aa, Homo sapiens
RAKDDIKRV

SEQ ID NO: 4391 - protein, 8 aa, Homo sapiens
KIQKLSKA

SEQ ID NO: 4392 - protein, 9 aa, Homo sapiens
RAKDDIKRV

SEQ ID NO: 4393 - protein, 9 aa, Homo sapiens
RAKDDIKRV

SEQ ID NO: 4394 - protein, 9 aa, Homo sapiens
RAKDDIKRV

SEQ ID NO: 4395 - protein, 9 aa, Homo sapiens
RAKDDIKRV

SEQ ID NO: 4396 - protein, 9 aa, Homo sapiens
RAKDDIKRV

SEQ ID NO: 4397 - protein, 9 aa, Homo sapiens
RAKDDIKRV

SEQ ID NO: 4398 - protein, 13 aa, Homo sapiens
KKWVTVGDTSLRI

SEQ ID NO: 4399 - protein, 13 aa, Homo sapiens
KKWVTVGDTSLRI

SEQ ID NO: 4400 - protein, 13 aa, Homo sapiens
KKWVTVGDTSLRI

SEQ ID NO: 4401 - protein, 13 aa, Homo sapiens
KKWVTVGDTSLRI

SEQ ID NO: 4402 - protein, 13 aa, Homo sapiens
KKWVTVGDTSLRI

SEQ ID NO: 4403 - protein, 13 aa, Homo sapiens
KKWVTVGDTSLRI

SEQ ID NO: 4404 - protein, 8 aa, Homo sapiens
REQKAKRN

SEQ ID NO: 4405 - protein, 7 aa, Homo sapiens
REQKAKR

SEQ ID NO: 4406 - protein, 8 aa, Homo sapiens
REQKAKRN

SEQ ID NO: 4407 - protein, 13 aa, Homo sapiens
KKWVTVGDTSLRI

SEQ ID NO: 4408 - protein, 9 aa, Homo sapiens
RAKDDIKRV

SEQ ID NO: 4409 - protein, 9 aa, Homo sapiens
RAKDDIKRV

SEQ ID NO: 4410 - protein, 6 aa, Homo sapiens
RKMADK

SEQ ID NO: 4411 - protein, 11 aa, Homo sapiens
MAADEVAGGAR

SEQ ID NO: 4412 - protein, 7 aa, Homo sapiens
KLIDQKK

SEQ ID NO: 4413 - protein, 6 aa, Homo sapiens
EQKAKR

SEQ ID NO: 4414 - protein, 6 aa, Homo sapiens
GSLYKR

SEQ ID NO: 4415 - protein, 6 aa, Homo sapiens
GSLYKR

SEQ ID NO: 4416 - protein, 6 aa, Homo sapiens
GSLYKR

SEQ ID NO: 4417 - protein, 6 aa, Homo sapiens
GSLYKR

SEQ ID NO: 4418 - protein, 6 aa, Homo sapiens
GSLYKR

SEQ ID NO: 4419 - protein, 6 aa, Homo sapiens
GSLYKR

SEQ ID NO: 4420 - protein, 6 aa, Homo sapiens
GSLYKR

SEQ ID NO: 4421 - protein, 6 aa, Homo sapiens
GSLYKR

SEQ ID NO: 4422 - protein, 6 aa, Homo sapiens
GSLYKR

SEQ ID NO: 4423 - protein, 11 aa, Homo sapiens
HQGTFTDEKSK

SEQ ID NO: 4424 - protein, 7 aa, Homo sapiens
KASANAR

SEQ ID NO: 4425 - protein, 6 aa, Homo sapiens
KPVDFK

SEQ ID NO: 4426 - protein, 5 aa, Homo sapiens
IEKER

SEQ ID NO: 4427 - protein, 5 aa, Homo sapiens
NHKYR

SEQ ID NO: 4428 - protein, 7 aa, Homo sapiens
IRNHKYR

SEQ ID NO: 4429 - protein, 7 aa, Homo sapiens
KASANAR

SEQ ID NO: 4430 - protein, 7 aa, Homo sapiens
IRNHKYR

SEQ ID NO: 4431 - protein, 5 aa, Homo sapiens
NHKYR

SEQ ID NO: 4432 - protein, 6 aa, Homo sapiens
LIDQKK

SEQ ID NO: 4433 - protein, 14 aa, Homo sapiens
GGAKTLMNTIMQLR

SEQ ID NO: 4434 - protein, 14 aa, Homo sapiens
GGAKTLMNTIMQLR

SEQ ID NO: 4435 - protein, 12 aa, Homo sapiens
EKPVDLQNFGLR

SEQ ID NO: 4436 - protein, 7 aa, Homo sapiens
KVQEAAR

SEQ ID NO: 4437 - protein, 7 aa, Homo sapiens
TDIYSKK

SEQ ID NO: 4438 - protein, 5 aa, Homo sapiens
KMADK

SEQ ID NO: 4439 - protein, 10 aa, Homo sapiens
ASGKFELLDR

SEQ ID NO: 4440 - protein, 4 aa, Homo sapiens
KNAK

SEQ ID NO: 4441 - protein, 8 aa, Homo sapiens
NVDKDPAK

SEQ ID NO: 4442 - protein, 8 aa, Homo sapiens
NVDKDPAK

SEQ ID NO: 4443 - protein, 8 aa, Homo sapiens
NVDKDPAK

SEQ ID NO: 4444 - protein, 8 aa, Homo sapiens
NVDKDPAK

SEQ ID NO: 4445 - protein, 14 aa, Homo sapiens
QAFHMEQLKYAEMR

SEQ ID NO: 4446 - protein, 14 aa, Homo sapiens
QAFHMEQLKYAEMR

SEQ ID NO: 4447 - protein, 14 aa, Homo sapiens
QAFHMEQLKYAEMR

SEQ ID NO: 4448 - protein, 9 aa, Homo sapiens
HIFAKVQQR

SEQ ID NO: 4449 - protein, 9 aa, Homo sapiens
HIFAKVQQR

SEQ ID NO: 4450 - protein, 9 aa, Homo sapiens
HIFAKVQQR

SEQ ID NO: 4451 - protein, 9 aa, Homo sapiens
HIFAKVQQR

SEQ ID NO: 4452 - protein, 9 aa, Homo sapiens
HIFAKVQQR

SEQ ID NO: 4453 - protein, 9 aa, Homo sapiens
HIFAKVQQR

SEQ ID NO: 4454 - protein, 8 aa, Homo sapiens
FKSDQGWR

SEQ ID NO: 4455 - protein, 10 aa, Homo sapiens
AKHLAAVEER

SEQ ID NO: 4456 - protein, 7 aa, Homo sapiens
KLEIKLR

SEQ ID NO: 4457 - protein, 6 aa, Homo sapiens
LEIKLR

SEQ ID NO: 4458 - protein, 6 aa, Homo sapiens
LEIKLR

SEQ ID NO: 4459 - protein, 7 aa, Homo sapiens
KLEIKLR

SEQ ID NO: 4460 - protein, 7 aa, Homo sapiens
KLEIKLR

SEQ ID NO: 4461 - protein, 6 aa, Homo sapiens
LEIKLR

SEQ ID NO: 4462 - protein, 9 aa, Homo sapiens
HIFAKVQQR

SEQ ID NO: 4463 - protein, 13 aa, Homo sapiens
SLVALLVETQMKK

SEQ ID NO: 4464 - protein, 13 aa, Homo sapiens
SLVALLVETQMKK

SEQ ID NO: 4465 - protein, 12 aa, Homo sapiens
KLEAELLQIEER

SEQ ID NO: 4466 - protein, 12 aa, Homo sapiens
KLEAELLQIEER

SEQ ID NO: 4467 - protein, 13 aa, Homo sapiens
SLVALLVETQMKK

SEQ ID NO: 4468 - protein, 12 aa, Homo sapiens
KLEAELLQIEER

SEQ ID NO: 4469 - protein, 12 aa, Homo sapiens
KLEAELLQIEER

SEQ ID NO: 4470 - protein, 13 aa, Homo sapiens
SLVALLVETQMKK

SEQ ID NO: 4471 - protein, 5 aa, Homo sapiens
KLEIK

SEQ ID NO: 4472 - protein, 5 aa, Homo sapiens
KLEIK

SEQ ID NO: 4473 - protein, 5 aa, Homo sapiens
KLEIK

SEQ ID NO: 4474 - protein, 5 aa, Homo sapiens
KLEIK

SEQ ID NO: 4475 - protein, 5 aa, Homo sapiens
KLEIK

SEQ ID NO: 4476 - protein, 5 aa, Homo sapiens
KLEIK

SEQ ID NO: 4477 - protein, 5 aa, Homo sapiens
KLEIK

SEQ ID NO: 4478 - protein, 5 aa, Homo sapiens
KLEIK

SEQ ID NO: 4479 - protein, 5 aa, Homo sapiens
KLEIK

SEQ ID NO: 4480 - protein, 5 aa, Homo sapiens
KLEIK

SEQ ID NO: 4481 - protein, 6 aa, Homo sapiens
MQVLKR

SEQ ID NO: 4482 - protein, 6 aa, Homo sapiens
MQVLKR

SEQ ID NO: 4483 - protein, 6 aa, Homo sapiens
MQVLKR

SEQ ID NO: 4484 - protein, 6 aa, Homo sapiens
MQVLKR

SEQ ID NO: 4485 - protein, 6 aa, Homo sapiens
MQVLKR

SEQ ID NO: 4486 - protein, 6 aa, Homo sapiens
MQVLKR

SEQ ID NO: 4487 - protein, 6 aa, Homo sapiens
MQVLKR

SEQ ID NO: 4488 - protein, 6 aa, Homo sapiens
MQVLKR

SEQ ID NO: 4489 - protein, 6 aa, Homo sapiens
KTKVER

SEQ ID NO: 4490 - protein, 6 aa, Homo sapiens
MQVLKR

SEQ ID NO: 4491 - protein, 6 aa, Homo sapiens
MQVLKR

SEQ ID NO: 4492 - protein, 6 aa, Homo sapiens
MQVLKR

SEQ ID NO: 4493 - protein, 6 aa, Homo sapiens
MQVLKR

SEQ ID NO: 4494 - protein, 6 aa, Homo sapiens
MQVLKR

SEQ ID NO: 4495 - protein, 6 aa, Homo sapiens
MQVLKR

SEQ ID NO: 4496 - protein, 6 aa, Homo sapiens
MQVLKR

SEQ ID NO: 4497 - protein, 6 aa, Homo sapiens
MQVLKR

SEQ ID NO: 4498 - protein, 6 aa, Homo sapiens
MQVLKR

SEQ ID NO: 4499 - protein, 6 aa, Homo sapiens
MQVLKR

SEQ ID NO: 4500 - protein, 5 aa, Homo sapiens
HQEKK

SEQ ID NO: 4501 - protein, 6 aa, Homo sapiens
HQEKKR

SEQ ID NO: 4502 - protein, 7 aa, Homo sapiens
KLEIKLR

SEQ ID NO: 4503 - protein, 6 aa, Homo sapiens
LEIKLR

SEQ ID NO: 4504 - protein, 6 aa, Homo sapiens
LEIKLR

SEQ ID NO: 4505 - protein, 7 aa, Homo sapiens
KLEIKLR

SEQ ID NO: 4506 - protein, 14 aa, Homo sapiens
NYKKYIQAEPPTNK

SEQ ID NO: 4507 - protein, 7 aa, Homo sapiens
KVEEAAK

SEQ ID NO: 4508 - protein, 8 aa, Homo sapiens
KLDQTIMR

SEQ ID NO: 4509 - protein, 8 aa, Homo sapiens
KLDQTIMR

SEQ ID NO: 4510 - protein, 13 aa, Homo sapiens
SLVALLVETQMKK

SEQ ID NO: 4511 - protein, 10 aa, Homo sapiens
THKLQDPHER

SEQ ID NO: 4512 - protein, 10 aa, Homo sapiens
THKLQDPHER

SEQ ID NO: 4513 - protein, 10 aa, Homo sapiens
THKLQDPHER

SEQ ID NO: 4514 - protein, 10 aa, Homo sapiens
THKLQDPHER

SEQ ID NO: 4515 - protein, 10 aa, Homo sapiens
THKLQDPHER

SEQ ID NO: 4516 - protein, 10 aa, Homo sapiens
THKLQDPHER

SEQ ID NO: 4517 - protein, 14 aa, Homo sapiens
QAFHMEQLKYAEMR

SEQ ID NO: 4518 - protein, 6 aa, Homo sapiens
LEIKLR

SEQ ID NO: 4519 - protein, 5 aa, Homo sapiens
HQEKK

SEQ ID NO: 4520 - protein, 5 aa, Homo sapiens
HQEKK

SEQ ID NO: 4521 - protein, 14 aa, Homo sapiens
LLEDSALSKYDATK

SEQ ID NO: 4522 - protein, 14 aa, Homo sapiens
LLEDSALSKYDATK

SEQ ID NO: 4523 - protein, 14 aa, Homo sapiens
LLEDSALSKYDATK

SEQ ID NO: 4524 - protein, 14 aa, Homo sapiens
LLEDSALSKYDATK

SEQ ID NO: 4525 - protein, 14 aa, Homo sapiens
LLEDSALSKYDATK

SEQ ID NO: 4526 - protein, 14 aa, Homo sapiens
LLEDSALSKYDATK

SEQ ID NO: 4527 - protein, 14 aa, Homo sapiens
LLEDSALSKYDATK

SEQ ID NO: 4528 - protein, 14 aa, Homo sapiens
LLEDSALSKYDATK

SEQ ID NO: 4529 - protein, 14 aa, Homo sapiens
LLEDSALSKYDATK

SEQ ID NO: 4530 - protein, 19 aa, Homo sapiens
KRPAPQQIQQVQQQAVQNR

SEQ ID NO: 4531 - protein, 19 aa, Homo sapiens
KRPAPQQIQQVQQQAVQNR

SEQ ID NO: 4532 - protein, 19 aa, Homo sapiens
KRPAPQQIQQVQQQAVQNR

SEQ ID NO: 4533 - protein, 19 aa, Homo sapiens
KRPAPQQIQQVQQQAVQNR

SEQ ID NO: 4534 - protein, 19 aa, Homo sapiens
KRPAPQQIQQVQQQAVQNR

SEQ ID NO: 4535 - protein, 19 aa, Homo sapiens
KRPAPQQIQQVQQQAVQNR

SEQ ID NO: 4536 - protein, 12 aa, Homo sapiens
KLEAELLQIEER

SEQ ID NO: 4537 - protein, 12 aa, Homo sapiens
KLEAELLQIEER

SEQ ID NO: 4538 - protein, 12 aa, Homo sapiens
KLEAELLQIEER

SEQ ID NO: 4539 - protein, 12 aa, Homo sapiens
KLEAELLQIEER

SEQ ID NO: 4540 - protein, 12 aa, Homo sapiens
KLEAELLQIEER

SEQ ID NO: 4541 - protein, 12 aa, Homo sapiens
KLEAELLQIEER

SEQ ID NO: 4542 - protein, 12 aa, Homo sapiens
KLEAELLQIEER

SEQ ID NO: 4543 - protein, 17 aa, Homo sapiens
AYHNSPAYLAYINAKSR

SEQ ID NO: 4544 - protein, 12 aa, Homo sapiens
GKGEITPAAIQK

SEQ ID NO: 4545 - protein, 12 aa, Homo sapiens
GKGEITPAAIQK

SEQ ID NO: 4546 - protein, 10 aa, Homo sapiens
SSEAIKESSK

SEQ ID NO: 4547 - protein, 10 aa, Homo sapiens
SSEAIKESSK

SEQ ID NO: 4548 - protein, 19 aa, Homo sapiens
FLESTDSFNNELKRLCGLK

SEQ ID NO: 4549 - protein, 14 aa, Homo sapiens
FLESTDSFNNELKR

SEQ ID NO: 4550 - protein, 10 aa, Homo sapiens
SSEAIKESSK

SEQ ID NO: 4551 - protein, 10 aa, Homo sapiens
SSEAIKESSK

SEQ ID NO: 4552 - protein, 17 aa, Homo sapiens
AYHNSPAYLAYINAKSR

SEQ ID NO: 4553 - protein, 6 aa, Homo sapiens
MQVLKR

SEQ ID NO: 4554 - protein, 6 aa, Homo sapiens
MQVLKR

SEQ ID NO: 4555 - protein, 13 aa, Homo sapiens
LTMKDIGTPEAWR

SEQ ID NO: 4556 - protein, 13 aa, Homo sapiens
LTMKDIGTPEAWR

SEQ ID NO: 4557 - protein, 13 aa, Homo sapiens
LTMKDIGTPEAWR

SEQ ID NO: 4558 - protein, 13 aa, Homo sapiens
LTMKDIGTPEAWR

SEQ ID NO: 4559 - protein, 13 aa, Homo sapiens
LTMKDIGTPEAWR

SEQ ID NO: 4560 - protein, 14 aa, Homo sapiens
RLTMKDIGTPEAWR

SEQ ID NO: 4561 - protein, 13 aa, Homo sapiens
LTMKDIGTPEAWR

SEQ ID NO: 4562 - protein, 13 aa, Homo sapiens
LTMKDIGTPEAWR

SEQ ID NO: 4563 - protein, 14 aa, Homo sapiens
RLTMKDIGTPEAWR

SEQ ID NO: 4564 - protein, 14 aa, Homo sapiens
RLTMKDIGTPEAWR

SEQ ID NO: 4565 - protein, 14 aa, Homo sapiens
RLTMKDIGTPEAWR

SEQ ID NO: 4566 - protein, 14 aa, Homo sapiens
RLTMKDIGTPEAWR

SEQ ID NO: 4567 - protein, 14 aa, Homo sapiens
RLTMKDIGTPEAWR

SEQ ID NO: 4568 - protein, 14 aa, Homo sapiens
RLTMKDIGTPEAWR

SEQ ID NO: 4569 - protein, 13 aa, Homo sapiens
LTMKDIGTPEAWR

SEQ ID NO: 4570 - protein, 14 aa, Homo sapiens
RLTMKDIGTPEAWR

SEQ ID NO: 4571 - protein, 13 aa, Homo sapiens
LTMKDIGTPEAWR

SEQ ID NO: 4572 - protein, 14 aa, Homo sapiens
RLTMKDIGTPEAWR

SEQ ID NO: 4573 - protein, 13 aa, Homo sapiens
LTMKDIGTPEAWR

SEQ ID NO: 4574 - protein, 14 aa, Homo sapiens
RLTMKDIGTPEAWR

SEQ ID NO: 4575 - protein, 14 aa, Homo sapiens
RLTMKDIGTPEAWR

SEQ ID NO: 4576 - protein, 14 aa, Homo sapiens
RLTMKDIGTPEAWR

SEQ ID NO: 4577 - protein, 13 aa, Homo sapiens
LTMKDIGTPEAWR

SEQ ID NO: 4578 - protein, 14 aa, Homo sapiens
RLTMKDIGTPEAWR

SEQ ID NO: 4579 - protein, 14 aa, Homo sapiens
RLTMKDIGTPEAWR

SEQ ID NO: 4580 - protein, 6 aa, Homo sapiens
MQVLKR

SEQ ID NO: 4581 - protein, 6 aa, Homo sapiens
MQVLKR

SEQ ID NO: 4582 - protein, 15 aa, Homo sapiens
KFLESTDSFNNELKR

SEQ ID NO: 4583 - protein, 6 aa, Homo sapiens
KNPVCR

SEQ ID NO: 4584 - protein, 6 aa, Homo sapiens
KNPVCR

SEQ ID NO: 4585 - protein, 6 aa, Homo sapiens
KNPVCR

SEQ ID NO: 4586 - protein, 6 aa, Homo sapiens
KNPVCR

SEQ ID NO: 4587 - protein, 6 aa, Homo sapiens
KNPVCR

SEQ ID NO: 4588 - protein, 8 aa, Homo sapiens
KLDQTIMR

SEQ ID NO: 4589 - protein, 8 aa, Homo sapiens
KLDQTIMR

SEQ ID NO: 4590 - protein, 8 aa, Homo sapiens
KLDQTIMR

SEQ ID NO: 4591 - protein, 8 aa, Homo sapiens
KLDQTIMR

SEQ ID NO: 4592 - protein, 8 aa, Homo sapiens
KLDQTIMR

SEQ ID NO: 4593 - protein, 14 aa, Homo sapiens
MSYEPNKDPYGSMR

SEQ ID NO: 4594 - protein, 14 aa, Homo sapiens
MSYEPNKDPYGSMR

SEQ ID NO: 4595 - protein, 14 aa, Homo sapiens
MSYEPNKDPYGSMR

SEQ ID NO: 4596 - protein, 20 aa, Homo sapiens
RDITFPPGSVEATQPVLKQR

SEQ ID NO: 4597 - protein, 20 aa, Homo sapiens
RDITFPPGSVEATQPVLKQR

SEQ ID NO: 4598 - protein, 20 aa, Homo sapiens
RDITFPPGSVEATQPVLKQR

SEQ ID NO: 4599 - protein, 20 aa, Homo sapiens
RDITFPPGSVEATQPVLKQR

SEQ ID NO: 4600 - protein, 19 aa, Homo sapiens
DITFPPGSVEATQPVLKQR

SEQ ID NO: 4601 - protein, 19 aa, Homo sapiens
DITFPPGSVEATQPVLKQR

SEQ ID NO: 4602 - protein, 8 aa, Homo sapiens
KLDQTIMR

SEQ ID NO: 4603 - protein, 8 aa, Homo sapiens
KLDQTIMR

SEQ ID NO: 4604 - protein, 8 aa, Homo sapiens
KLDQTIMR

SEQ ID NO: 4605 - protein, 8 aa, Homo sapiens
KLDQTIMR

SEQ ID NO: 4606 - protein, 8 aa, Homo sapiens
KLDQTIMR

SEQ ID NO: 4607 - protein, 8 aa, Homo sapiens
KLDQTIMR

SEQ ID NO: 4608 - protein, 8 aa, Homo sapiens
KLDQTIMR

SEQ ID NO: 4609 - protein, 9 aa, Homo sapiens
KLDQTIMRK

SEQ ID NO: 4610 - protein, 8 aa, Homo sapiens
KLDQTIMR

SEQ ID NO: 4611 - protein, 9 aa, Homo sapiens
KLDQTIMRK

SEQ ID NO: 4612 - protein, 8 aa, Homo sapiens
KLDQTIMR

SEQ ID NO: 4613 - protein, 9 aa, Homo sapiens
KLDQTIMRK

SEQ ID NO: 4614 - protein, 8 aa, Homo sapiens
KLDQTIMR

SEQ ID NO: 4615 - protein, 9 aa, Homo sapiens
KLDQTIMRK

SEQ ID NO: 4616 - protein, 9 aa, Homo sapiens
KLDQTIMRK

SEQ ID NO: 4617 - protein, 9 aa, Homo sapiens
KLDQTIMRK

SEQ ID NO: 4618 - protein, 19 aa, Homo sapiens
KRPAPQQIQQVQQQAVQNR

SEQ ID NO: 4619 - protein, 19 aa, Homo sapiens
KRPAPQQIQQVQQQAVQNR

SEQ ID NO: 4620 - protein, 13 aa, Homo sapiens
LTMKDIGTPEAWR

SEQ ID NO: 4621 - protein, 13 aa, Homo sapiens
LTMKDIGTPEAWR

SEQ ID NO: 4622 - protein, 14 aa, Homo sapiens
RLTMKDIGTPEAWR

SEQ ID NO: 4623 - protein, 13 aa, Homo sapiens
LTMKDIGTPEAWR

SEQ ID NO: 4624 - protein, 13 aa, Homo sapiens
LTMKDIGTPEAWR

SEQ ID NO: 4625 - protein, 13 aa, Homo sapiens
LTMKDIGTPEAWR

SEQ ID NO: 4626 - protein, 14 aa, Homo sapiens
RLTMKDIGTPEAWR

SEQ ID NO: 4627 - protein, 14 aa, Homo sapiens
RLTMKDIGTPEAWR

SEQ ID NO: 4628 - protein, 13 aa, Homo sapiens
LTMKDIGTPEAWR

SEQ ID NO: 4629 - protein, 13 aa, Homo sapiens
LTMKDIGTPEAWR

SEQ ID NO: 4630 - protein, 8 aa, Homo sapiens
KLDQTIMR

SEQ ID NO: 4631 - protein, 8 aa, Homo sapiens
KLDQTIMR

SEQ ID NO: 4632 - protein, 6 aa, Homo sapiens
KNPVCR

SEQ ID NO: 4633 - protein, 6 aa, Homo sapiens
KNPVCR

SEQ ID NO: 4634 - protein, 6 aa, Homo sapiens
KNPVCR

SEQ ID NO: 4635 - protein, 6 aa, Homo sapiens
KNPVCR

SEQ ID NO: 4636 - protein, 6 aa, Homo sapiens
KNPVCR

SEQ ID NO: 4637 - protein, 6 aa, Homo sapiens
KNPVCR

SEQ ID NO: 4638 - protein, 6 aa, Homo sapiens
KNPVCR

SEQ ID NO: 4639 - protein, 6 aa, Homo sapiens
KNPVCR

SEQ ID NO: 4640 - protein, 6 aa, Homo sapiens
KNPVCR

SEQ ID NO: 4641 - protein, 6 aa, Homo sapiens
KNPVCR

SEQ ID NO: 4642 - protein, 6 aa, Homo sapiens
KNPVCR

SEQ ID NO: 4643 - protein, 6 aa, Homo sapiens
KNPVCR

SEQ ID NO: 4644 - protein, 6 aa, Homo sapiens
KNPVCR

SEQ ID NO: 4645 - protein, 6 aa, Homo sapiens
KNPVCR

SEQ ID NO: 4646 - protein, 6 aa, Homo sapiens
KNPVCR

SEQ ID NO: 4647 - protein, 6 aa, Homo sapiens
KNPVCR

SEQ ID NO: 4648 - protein, 6 aa, Homo sapiens
KNPVCR

SEQ ID NO: 4649 - protein, 6 aa, Homo sapiens
KNPVCR

SEQ ID NO: 4650 - protein, 6 aa, Homo sapiens
KNPVCR

SEQ ID NO: 4651 - protein, 6 aa, Homo sapiens
NHNAKK

SEQ ID NO: 4652 - protein, 6 aa, Homo sapiens
NHNAKK

SEQ ID NO: 4653 - protein, 6 aa, Homo sapiens
KNPVCR

SEQ ID NO: 4654 - protein, 6 aa, Homo sapiens
NHNAKK

SEQ ID NO: 4655 - protein, 6 aa, Homo sapiens
KNPVCR

SEQ ID NO: 4656 - protein, 6 aa, Homo sapiens
NHNAKK

SEQ ID NO: 4657 - protein, 11 aa, Homo sapiens
FLSDRKNPVCR

SEQ ID NO: 4658 - protein, 6 aa, Homo sapiens
KNPVCR

SEQ ID NO: 4659 - protein, 6 aa, Homo sapiens
KNPVCR

SEQ ID NO: 4660 - protein, 6 aa, Homo sapiens
KNPVCR

SEQ ID NO: 4661 - protein, 6 aa, Homo sapiens
KNPVCR

SEQ ID NO: 4662 - protein, 6 aa, Homo sapiens
KNPVCR

SEQ ID NO: 4663 - protein, 6 aa, Homo sapiens
KNPVCR

SEQ ID NO: 4664 - protein, 19 aa, Homo sapiens
KRPAPQQIQQVQQQAVQNR

SEQ ID NO: 4665 - protein, 10 aa, Homo sapiens
SSEAIKESSK

SEQ ID NO: 4666 - protein, 10 aa, Homo sapiens
AKHLAAVEER

SEQ ID NO: 4667 - protein, 6 aa, Homo sapiens
KNPVCR

SEQ ID NO: 4668 - protein, 6 aa, Homo sapiens
KNPVCR

SEQ ID NO: 4669 - protein, 6 aa, Homo sapiens
KNPVCR

SEQ ID NO: 4670 - protein, 6 aa, Homo sapiens
KNPVCR

SEQ ID NO: 4671 - protein, 6 aa, Homo sapiens
KNPVCR

SEQ ID NO: 4672 - protein, 23 aa, Homo sapiens
SALEEFSKMKEEVPTALVEAHVR

SEQ ID NO: 4673 - protein, 15 aa, Homo sapiens
VASAAAKSALEEFSK

SEQ ID NO: 4674 - protein, 15 aa, Homo sapiens
VASAAAKSALEEFSK

SEQ ID NO: 4675 - protein, 15 aa, Homo sapiens
VASAAAKSALEEFSK

SEQ ID NO: 4676 - protein, 9 aa, Homo sapiens
SKAAASATR

SEQ ID NO: 4677 - protein, 9 aa, Homo sapiens
SKAAASATR

SEQ ID NO: 4678 - protein, 9 aa, Homo sapiens
SKAAASATR

SEQ ID NO: 4679 - protein, 7 aa, Homo sapiens
KVEEAAK

SEQ ID NO: 4680 - protein, 7 aa, Homo sapiens
KVEEAAK

SEQ ID NO: 4681 - protein, 7 aa, Homo sapiens
KVEEAAK

SEQ ID NO: 4682 - protein, 7 aa, Homo sapiens
KVEEAAK

SEQ ID NO: 4683 - protein, 7 aa, Homo sapiens
KVEEAAK

SEQ ID NO: 4684 - protein, 7 aa, Homo sapiens
KVEEAAK

SEQ ID NO: 4685 - protein, 7 aa, Homo sapiens
KVEEAAK

SEQ ID NO: 4686 - protein, 7 aa, Homo sapiens
TDMYTKK

SEQ ID NO: 4687 - protein, 7 aa, Homo sapiens
TDMYTKK

SEQ ID NO: 4688 - protein, 10 aa, Homo sapiens
AKHLAAVEER

SEQ ID NO: 4689 - protein, 10 aa, Homo sapiens
AKHLAAVEER

SEQ ID NO: 4690 - protein, 10 aa, Homo sapiens
AKHLAAVEER

SEQ ID NO: 4691 - protein, 10 aa, Homo sapiens
AKHLAAVEER

SEQ ID NO: 4692 - protein, 10 aa, Homo sapiens
AKHLAAVEER

SEQ ID NO: 4693 - protein, 10 aa, Homo sapiens
AKHLAAVEER

SEQ ID NO: 4694 - protein, 10 aa, Homo sapiens
AKHLAAVEER

SEQ ID NO: 4695 - protein, 10 aa, Homo sapiens
AKHLAAVEER

SEQ ID NO: 4696 - protein, 10 aa, Homo sapiens
AKHLAAVEER

SEQ ID NO: 4697 - protein, 10 aa, Homo sapiens
AKHLAAVEER

SEQ ID NO: 4698 - protein, 10 aa, Homo sapiens
AKHLAAVEER

SEQ ID NO: 4699 - protein, 10 aa, Homo sapiens
AKHLAAVEER

SEQ ID NO: 4700 - protein, 10 aa, Homo sapiens
AKHLAAVEER

SEQ ID NO: 4701 - protein, 10 aa, Homo sapiens
AKHLAAVEER

SEQ ID NO: 4702 - protein, 10 aa, Homo sapiens
AKHLAAVEER

SEQ ID NO: 4703 - protein, 10 aa, Homo sapiens
AKHLAAVEER

SEQ ID NO: 4704 - protein, 10 aa, Homo sapiens
AKHLAAVEER

SEQ ID NO: 4705 - protein, 10 aa, Homo sapiens
AKHLAAVEER

SEQ ID NO: 4706 - protein, 10 aa, Homo sapiens
AKHLAAVEER

SEQ ID NO: 4707 - protein, 10 aa, Homo sapiens
AKHLAAVEER

SEQ ID NO: 4708 - protein, 10 aa, Homo sapiens
AKHLAAVEER

SEQ ID NO: 4709 - protein, 10 aa, Homo sapiens
AKHLAAVEER

SEQ ID NO: 4710 - protein, 10 aa, Homo sapiens
AKHLAAVEER

SEQ ID NO: 4711 - protein, 7 aa, Homo sapiens
KVEEAAK

SEQ ID NO: 4712 - protein, 7 aa, Homo sapiens
KVEEAAK

SEQ ID NO: 4713 - protein, 10 aa, Homo sapiens
AKHLAAVEER

SEQ ID NO: 4714 - protein, 10 aa, Homo sapiens
AKHLAAVEER

SEQ ID NO: 4715 - protein, 10 aa, Homo sapiens
AKHLAAVEER

SEQ ID NO: 4716 - protein, 10 aa, Homo sapiens
AKHLAAVEER

SEQ ID NO: 4717 - protein, 10 aa, Homo sapiens
AKHLAAVEER

SEQ ID NO: 4718 - protein, 9 aa, Homo sapiens
EKTSEAPKK

SEQ ID NO: 4719 - protein, 9 aa, Homo sapiens
SKAAASATR

SEQ ID NO: 4720 - protein, 9 aa, Homo sapiens
SKAAASATR

SEQ ID NO: 4721 - protein, 12 aa, Homo sapiens
TDMYTKKNVPSK

SEQ ID NO: 4722 - protein, 6 aa, Homo sapiens
KNVPSK

SEQ ID NO: 4723 - protein, 7 aa, Homo sapiens
TDMYTKK

SEQ ID NO: 4724 - protein, 7 aa, Homo sapiens
TDMYTKK

SEQ ID NO: 4725 - protein, 7 aa, Homo sapiens
TDMYTKK

SEQ ID NO: 4726 - protein, 12 aa, Homo sapiens
TDMYTKKNVPSK

SEQ ID NO: 4727 - protein, 7 aa, Homo sapiens
TDMYTKK

SEQ ID NO: 4728 - protein, 7 aa, Homo sapiens
TDMYTKK

SEQ ID NO: 4729 - protein, 9 aa, Homo sapiens
SKAAASATR

SEQ ID NO: 4730 - protein, 6 aa, Homo sapiens
RKMADK

SEQ ID NO: 4731 - protein, 6 aa, Homo sapiens
KNPVCR

SEQ ID NO: 4732 - protein, 6 aa, Homo sapiens
KNPVCR

SEQ ID NO: 4733 - protein, 6 aa, Homo sapiens
KNPVCR

SEQ ID NO: 4734 - protein, 6 aa, Homo sapiens
KNPVCR

SEQ ID NO: 4735 - protein, 6 aa, Homo sapiens
KNPVCR

SEQ ID NO: 4736 - protein, 6 aa, Homo sapiens
KNPVCR

SEQ ID NO: 4737 - protein, 6 aa, Homo sapiens
KNPVCR

SEQ ID NO: 4738 - protein, 6 aa, Homo sapiens
KNPVCR

SEQ ID NO: 4739 - protein, 6 aa, Homo sapiens
KNPVCR

SEQ ID NO: 4740 - protein, 6 aa, Homo sapiens
KNPVCR

SEQ ID NO: 4741 - protein, 11 aa, Homo sapiens
DPKGYVQDLLR

SEQ ID NO: 4742 - protein, 8 aa, Homo sapiens
QQKIEQER

SEQ ID NO: 4743 - protein, 11 aa, Homo sapiens
WKYMIVDEGHR

SEQ ID NO: 4744 - protein, 6 aa, Homo sapiens
KNPVCR

SEQ ID NO: 4745 - protein, 6 aa, Homo sapiens
KNPVCR

SEQ ID NO: 4746 - protein, 7 aa, Homo sapiens
KPLDLYR

SEQ ID NO: 4747 - protein, 7 aa, Homo sapiens
KPLDLYR

SEQ ID NO: 4748 - protein, 7 aa, Homo sapiens
KPLDLYR

SEQ ID NO: 4749 - protein, 6 aa, Homo sapiens
KNPVCR

SEQ ID NO: 4750 - protein, 6 aa, Homo sapiens
KNPVCR

SEQ ID NO: 4751 - protein, 6 aa, Homo sapiens
KNPVCR

SEQ ID NO: 4752 - protein, 6 aa, Homo sapiens
KNPVCR

SEQ ID NO: 4753 - protein, 6 aa, Homo sapiens
KNPVCR

SEQ ID NO: 4754 - protein, 8 aa, Homo sapiens
TFGQKPVK

SEQ ID NO: 4755 - protein, 8 aa, Homo sapiens
TFGQKPVK

SEQ ID NO: 4756 - protein, 8 aa, Homo sapiens
TFGQKPVK

SEQ ID NO: 4757 - protein, 6 aa, Homo sapiens
GSLYKR

SEQ ID NO: 4758 - protein, 8 aa, Homo sapiens
TFGQKPVK

SEQ ID NO: 4759 - protein, 8 aa, Homo sapiens
SKGASAGR

SEQ ID NO: 4760 - protein, 8 aa, Homo sapiens
SKGASAGR

SEQ ID NO: 4761 - protein, 8 aa, Homo sapiens
SKGASAGR

SEQ ID NO: 4762 - protein, 7 aa, Homo sapiens
KVQEAAR

SEQ ID NO: 4763 - protein, 7 aa, Homo sapiens
KVQEAAR

SEQ ID NO: 4764 - protein, 7 aa, Homo sapiens
KVQEAAR

SEQ ID NO: 4765 - protein, 7 aa, Homo sapiens
KVQEAAR

SEQ ID NO: 4766 - protein, 7 aa, Homo sapiens
KVQEAAR

SEQ ID NO: 4767 - protein, 7 aa, Homo sapiens
KVQEAAR

SEQ ID NO: 4768 - protein, 7 aa, Homo sapiens
KVQEAAR

SEQ ID NO: 4769 - protein, 7 aa, Homo sapiens
KVQEAAR

SEQ ID NO: 4770 - protein, 7 aa, Homo sapiens
KVQEAAR

SEQ ID NO: 4771 - protein, 7 aa, Homo sapiens
KVQEAAR

SEQ ID NO: 4772 - protein, 7 aa, Homo sapiens
KVQEAAR

SEQ ID NO: 4773 - protein, 15 aa, Homo sapiens
VASAAAKAALEEFSR

SEQ ID NO: 4774 - protein, 15 aa, Homo sapiens
VASAAAKAALEEFSR

SEQ ID NO: 4775 - protein, 15 aa, Homo sapiens
VASAAAKAALEEFSR

SEQ ID NO: 4776 - protein, 15 aa, Homo sapiens
VASAAAKAALEEFSR

SEQ ID NO: 4777 - protein, 15 aa, Homo sapiens
VASAAAKAALEEFSR

SEQ ID NO: 4778 - protein, 15 aa, Homo sapiens
VASAAAKAALEEFSR

SEQ ID NO: 4779 - protein, 15 aa, Homo sapiens
VASAAAKAALEEFSR

SEQ ID NO: 4780 - protein, 15 aa, Homo sapiens
VASAAAKAALEEFSR

SEQ ID NO: 4781 - protein, 15 aa, Homo sapiens
VASAAAKAALEEFSR

SEQ ID NO: 4782 - protein, 15 aa, Homo sapiens
VASAAAKAALEEFSR

SEQ ID NO: 4783 - protein, 11 aa, Homo sapiens
KYVHADAPTNK

SEQ ID NO: 4784 - protein, 6 aa, Homo sapiens
KNPVCR

SEQ ID NO: 4785 - protein, 7 aa, Homo sapiens
KASANAR

SEQ ID NO: 4786 - protein, 5 aa, Homo sapiens
KTLAK

SEQ ID NO: 4787 - protein, 5 aa, Homo sapiens
KTLAK

SEQ ID NO: 4788 - protein, 5 aa, Homo sapiens
KTLAK

SEQ ID NO: 4789 - protein, 5 aa, Homo sapiens
KTLAK

SEQ ID NO: 4790 - protein, 8 aa, Homo sapiens
SKGASAGR

SEQ ID NO: 4791 - protein, 8 aa, Homo sapiens
SKGASAGR

SEQ ID NO: 4792 - protein, 8 aa, Homo sapiens
SKGASAGR

SEQ ID NO: 4793 - protein, 8 aa, Homo sapiens
SKGASAGR

SEQ ID NO: 4794 - protein, 7 aa, Homo sapiens
TDIYSKK

SEQ ID NO: 4795 - protein, 7 aa, Homo sapiens
TDIYSKK

SEQ ID NO: 4796 - protein, 11 aa, Homo sapiens
TDIYSKKTLAK

SEQ ID NO: 4797 - protein, 11 aa, Homo sapiens
TDIYSKKTLAK

SEQ ID NO: 4798 - protein, 7 aa, Homo sapiens
TDIYSKK

SEQ ID NO: 4799 - protein, 11 aa, Homo sapiens
TDIYSKKTLAK

SEQ ID NO: 4800 - protein, 11 aa, Homo sapiens
TDIYSKKTLAK

SEQ ID NO: 4801 - protein, 7 aa, Homo sapiens
TDIYSKK

SEQ ID NO: 4802 - protein, 7 aa, Homo sapiens
KVQEAAR

SEQ ID NO: 4803 - protein, 7 aa, Homo sapiens
KPLDLYR

SEQ ID NO: 4804 - protein, 7 aa, Homo sapiens
KPLDLYR

SEQ ID NO: 4805 - protein, 6 aa, Homo sapiens
KNPVCR

SEQ ID NO: 4806 - protein, 6 aa, Homo sapiens
KNPVCR

SEQ ID NO: 4807 - protein, 12 aa, Homo sapiens
GKGEITPAAIQK

SEQ ID NO: 4808 - protein, 8 aa, Homo sapiens
GKGVGSAR

SEQ ID NO: 4809 - protein, 11 aa, Homo sapiens
LISKFDKLPVK

SEQ ID NO: 4810 - protein, 11 aa, Homo sapiens
LISKFDKLPVK

SEQ ID NO: 4811 - protein, 11 aa, Homo sapiens
LISKFDKLPVK

SEQ ID NO: 4812 - protein, 11 aa, Homo sapiens
LISKFDKLPVK

SEQ ID NO: 4813 - protein, 11 aa, Homo sapiens
LISKFDKLPVK

SEQ ID NO: 4814 - protein, 11 aa, Homo sapiens
LISKFDKLPVK

SEQ ID NO: 4815 - protein, 11 aa, Homo sapiens
LISKFDKLPVK

SEQ ID NO: 4816 - protein, 11 aa, Homo sapiens
LISKFDKLPVK

SEQ ID NO: 4817 - protein, 13 aa, Homo sapiens
LTMKDIGTPEAWR

SEQ ID NO: 4818 - protein, 7 aa, Homo sapiens
TDPLEKR

SEQ ID NO: 4819 - protein, 7 aa, Homo sapiens
TDPLEKR

SEQ ID NO: 4820 - protein, 7 aa, Homo sapiens
TDPLEKR

SEQ ID NO: 4821 - protein, 17 aa, Homo sapiens
DLKIITDVIGNPEEERR

SEQ ID NO: 4822 - protein, 17 aa, Homo sapiens
DLKIITDVIGNPEEERR

SEQ ID NO: 4823 - protein, 17 aa, Homo sapiens
DLKIITDVIGNPEEERR

SEQ ID NO: 4824 - protein, 8 aa, Homo sapiens
KLDQTIAR

SEQ ID NO: 4825 - protein, 8 aa, Homo sapiens
KLDQTIAR

SEQ ID NO: 4826 - protein, 8 aa, Homo sapiens
KLDQTIAR

SEQ ID NO: 4827 - protein, 9 aa, Homo sapiens
KLDQTIARK

SEQ ID NO: 4828 - protein, 8 aa, Homo sapiens
KLDQTIAR

SEQ ID NO: 4829 - protein, 8 aa, Homo sapiens
KLDQTIAR

SEQ ID NO: 4830 - protein, 9 aa, Homo sapiens
KLDQTIARK

SEQ ID NO: 4831 - protein, 8 aa, Homo sapiens
KLDQTIAR

SEQ ID NO: 4832 - protein, 8 aa, Homo sapiens
KLDQTIAR

SEQ ID NO: 4833 - protein, 8 aa, Homo sapiens
KLDQTIAR

SEQ ID NO: 4834 - protein, 8 aa, Homo sapiens
KLDQTIAR

SEQ ID NO: 4835 - protein, 8 aa, Homo sapiens
KLDQTIAR

SEQ ID NO: 4836 - protein, 6 aa, Homo sapiens
KNPVCR

SEQ ID NO: 4837 - protein, 6 aa, Homo sapiens
KNPVCR

SEQ ID NO: 4838 - protein, 11 aa, Homo sapiens
FLSDRKNPVCR

SEQ ID NO: 4839 - protein, 6 aa, Homo sapiens
KNPVCR

SEQ ID NO: 4840 - protein, 6 aa, Homo sapiens
KNPVCR

SEQ ID NO: 4841 - protein, 6 aa, Homo sapiens
KNPVCR

SEQ ID NO: 4842 - protein, 6 aa, Homo sapiens
KNPVCR

SEQ ID NO: 4843 - protein, 6 aa, Homo sapiens
KNPVCR

SEQ ID NO: 4844 - protein, 6 aa, Homo sapiens
KNPVCR

SEQ ID NO: 4845 - protein, 6 aa, Homo sapiens
KNPVCR

SEQ ID NO: 4846 - protein, 6 aa, Homo sapiens
KNPVCR

SEQ ID NO: 4847 - protein, 6 aa, Homo sapiens
KNPVCR

SEQ ID NO: 4848 - protein, 6 aa, Homo sapiens
KNPVCR

SEQ ID NO: 4849 - protein, 6 aa, Homo sapiens
KNPVCR

SEQ ID NO: 4850 - protein, 6 aa, Homo sapiens
KNPVCR

SEQ ID NO: 4851 - protein, 6 aa, Homo sapiens
KNPVCR

SEQ ID NO: 4852 - protein, 11 aa, Homo sapiens
FLSDRKNPVCR

SEQ ID NO: 4853 - protein, 6 aa, Homo sapiens
KNPVCR

SEQ ID NO: 4854 - protein, 6 aa, Homo sapiens
KNPVCR

SEQ ID NO: 4855 - protein, 6 aa, Homo sapiens
KNPVCR

SEQ ID NO: 4856 - protein, 6 aa, Homo sapiens
KNPVCR

SEQ ID NO: 4857 - protein, 6 aa, Homo sapiens
KNPVCR

SEQ ID NO: 4858 - protein, 6 aa, Homo sapiens
KNPVCR

SEQ ID NO: 4859 - protein, 6 aa, Homo sapiens
KNPVCR

SEQ ID NO: 4860 - protein, 6 aa, Homo sapiens
KNPVCR

SEQ ID NO: 4861 - protein, 6 aa, Homo sapiens
KNPVCR

SEQ ID NO: 4862 - protein, 6 aa, Homo sapiens
KNPVCR

SEQ ID NO: 4863 - protein, 6 aa, Homo sapiens
KNPVCR

SEQ ID NO: 4864 - protein, 6 aa, Homo sapiens
KNPVCR

SEQ ID NO: 4865 - protein, 11 aa, Homo sapiens
FLSDRKNPVCR

SEQ ID NO: 4866 - protein, 6 aa, Homo sapiens
KNPVCR

SEQ ID NO: 4867 - protein, 6 aa, Homo sapiens
KNPVCR

SEQ ID NO: 4868 - protein, 6 aa, Homo sapiens
KNPVCR

SEQ ID NO: 4869 - protein, 6 aa, Homo sapiens
KNPVCR

SEQ ID NO: 4870 - protein, 6 aa, Homo sapiens
KNPVCR

SEQ ID NO: 4871 - protein, 6 aa, Homo sapiens
KNPVCR

SEQ ID NO: 4872 - protein, 6 aa, Homo sapiens
KNPVCR

SEQ ID NO: 4873 - protein, 6 aa, Homo sapiens
KNPVCR

SEQ ID NO: 4874 - protein, 8 aa, Homo sapiens
KVMAAIEK

SEQ ID NO: 4875 - protein, 6 aa, Homo sapiens
EQKAKR

SEQ ID NO: 4876 - protein, 20 aa, Homo sapiens
EITALAPSTMKIKIIAPPER

SEQ ID NO: 4877 - protein, 20 aa, Homo sapiens
EITALAPSTMKIKIIAPPER

SEQ ID NO: 4878 - protein, 9 aa, Homo sapiens
KEKLPQVTR

SEQ ID NO: 4879 - protein, 9 aa, Homo sapiens
EGSPANWKR

SEQ ID NO: 4880 - protein, 9 aa, Homo sapiens
EGSPANWKR

SEQ ID NO: 4881 - protein, 9 aa, Homo sapiens
EGSPANWKR

SEQ ID NO: 4882 - protein, 9 aa, Homo sapiens
EGSPANWKR

SEQ ID NO: 4883 - protein, 9 aa, Homo sapiens
EGSPANWKR

SEQ ID NO: 4884 - protein, 9 aa, Homo sapiens
EGSPANWKR

SEQ ID NO: 4885 - protein, 11 aa, Homo sapiens
IYKWVPVTEPK

SEQ ID NO: 4886 - protein, 5 aa, Homo sapiens
GKDEK

SEQ ID NO: 4887 - protein, 7 aa, Homo sapiens
AKDDIKR

SEQ ID NO: 4888 - protein, 15 aa, Homo sapiens
IFKWVPVVDPQEEER

SEQ ID NO: 4889 - protein, 22 aa, Homo sapiens
KDLYANTVLSGGSTMYPGIADR

SEQ ID NO: 4890 - protein, 22 aa, Homo sapiens
KDLYANTVLSGGSTMYPGIADR

SEQ ID NO: 4891 - protein, 22 aa, Homo sapiens
KDLYANTVLSGGSTMYPGIADR

SEQ ID NO: 4892 - protein, 23 aa, Homo sapiens
HQGVMVGMGQKDCYVGDEAQSKR

SEQ ID NO: 4893 - protein, 23 aa, Homo sapiens
HQGVMVGMGQKDCYVGDEAQSKR

SEQ ID NO: 4894 - protein, 23 aa, Homo sapiens
HQGVMVGMGQKDCYVGDEAQSKR

SEQ ID NO: 4895 - protein, 23 aa, Homo sapiens
HQGVMVGMGQKDCYVGDEAQSKR

SEQ ID NO: 4896 - protein, 23 aa, Homo sapiens
HQGVMVGMGQKDCYVGDEAQSKR

SEQ ID NO: 4897 - protein, 22 aa, Homo sapiens
GILTLKYPIEHGIVTNWDDMEK

SEQ ID NO: 4898 - protein, 23 aa, Homo sapiens
HQGVMVGMGQKDCYVGDEAQSKR

SEQ ID NO: 4899 - protein, 22 aa, Homo sapiens
GILTLKYPIEHGIVTNWDDMEK

SEQ ID NO: 4900 - protein, 22 aa, Homo sapiens
GILTLKYPIEHGIVTNWDDMEK

SEQ ID NO: 4901 - protein, 23 aa, Homo sapiens
HQGVMVGMGQKDCYVGDEAQSKR

SEQ ID NO: 4902 - protein, 23 aa, Homo sapiens
HQGVMVGMGQKDCYVGDEAQSKR

SEQ ID NO: 4903 - protein, 23 aa, Homo sapiens
HQGVMVGMGQKDCYVGDEAQSKR

SEQ ID NO: 4904 - protein, 22 aa, Homo sapiens
GILTLKYPIEHGIVTNWDDMEK

SEQ ID NO: 4905 - protein, 23 aa, Homo sapiens
HQGVMVGMGQKDCYVGDEAQSKR

SEQ ID NO: 4906 - protein, 23 aa, Homo sapiens
HQGVMVGMGQKDCYVGDEAQSKR

SEQ ID NO: 4907 - protein, 22 aa, Homo sapiens
GILTLKYPIEHGIVTNWDDMEK

SEQ ID NO: 4908 - protein, 22 aa, Homo sapiens
GILTLKYPIEHGIVTNWDDMEK

SEQ ID NO: 4909 - protein, 22 aa, Homo sapiens
GILTLKYPIEHGIVTNWDDMEK

SEQ ID NO: 4910 - protein, 22 aa, Homo sapiens
GILTLKYPIEHGIVTNWDDMEK

SEQ ID NO: 4911 - protein, 22 aa, Homo sapiens
GILTLKYPIEHGIVTNWDDMEK

SEQ ID NO: 4912 - protein, 22 aa, Homo sapiens
GILTLKYPIEHGIVTNWDDMEK

SEQ ID NO: 4913 - protein, 23 aa, Homo sapiens
HQGVMVGMGQKDCYVGDEAQSKR

SEQ ID NO: 4914 - protein, 20 aa, Homo sapiens
MKNHHCKLTQVLNTHYVAPR

SEQ ID NO: 4915 - protein, 13 aa, Homo sapiens
WKYMIVDEGHRMK

SEQ ID NO: 4916 - protein, 13 aa, Homo sapiens
EITALAPSTMKIK

SEQ ID NO: 4917 - protein, 11 aa, Homo sapiens
KELPEYYELIR

SEQ ID NO: 4918 - protein, 8 aa, Homo sapiens
QQKIEQER

SEQ ID NO: 4919 - protein, 11 aa, Homo sapiens
WKYMIVDEGHR

SEQ ID NO: 4920 - protein, 11 aa, Homo sapiens
WKYMIVDEGHR

SEQ ID NO: 4921 - protein, 11 aa, Homo sapiens
WKYMIVDEGHR

SEQ ID NO: 4922 - protein, 11 aa, Homo sapiens
WKYMIVDEGHR

SEQ ID NO: 4923 - protein, 11 aa, Homo sapiens
WKYMIVDEGHR

SEQ ID NO: 4924 - protein, 11 aa, Homo sapiens
WKYMIVDEGHR

SEQ ID NO: 4925 - protein, 13 aa, Homo sapiens
IRWKYMIVDEGHR

SEQ ID NO: 4926 - protein, 11 aa, Homo sapiens
WKYMIVDEGHR

SEQ ID NO: 4927 - protein, 11 aa, Homo sapiens
WKYMIVDEGHR

SEQ ID NO: 4928 - protein, 11 aa, Homo sapiens
WKYMIVDEGHR

SEQ ID NO: 4929 - protein, 11 aa, Homo sapiens
WKYMIVDEGHR

SEQ ID NO: 4930 - protein, 9 aa, Homo sapiens
IVASSHGKK

SEQ ID NO: 4931 - protein, 6 aa, Homo sapiens
GSLYKR

SEQ ID NO: 4932 - protein, 11 aa, Homo sapiens
DPKGYVQDLLR

SEQ ID NO: 4933 - protein, 3 aa, Homo sapiens
KIR

SEQ ID NO: 4934 - protein, 3 aa, Homo sapiens
KIR

SEQ ID NO: 4935 - protein, 3 aa, Homo sapiens
KIR

SEQ ID NO: 4936 - protein, 3 aa, Homo sapiens
KIR

SEQ ID NO: 4937 - protein, 3 aa, Homo sapiens
KIR

SEQ ID NO: 4938 - protein, 7 aa, Homo sapiens
KIRDQDR

SEQ ID NO: 4939 - protein, 6 aa, Homo sapiens
GSLYKR

SEQ ID NO: 4940 - protein, 6 aa, Homo sapiens
GSLYKR

SEQ ID NO: 4941 - protein, 13 aa, Homo sapiens
DDWNKVSEHVGSR

SEQ ID NO: 4942 - protein, 13 aa, Homo sapiens
LKLIANNTTVERR

SEQ ID NO: 4943 - protein, 18 aa, Homo sapiens
TPPSMRLKLIANNTTVER

SEQ ID NO: 4944 - protein, 10 aa, Homo sapiens
VSYKGSPAAR

SEQ ID NO: 4945 - protein, 10 aa, Homo sapiens
VSYKGSPAAR

SEQ ID NO: 4946 - protein, 10 aa, Homo sapiens
VSYKGSPAAR

SEQ ID NO: 4947 - protein, 26 aa, Homo sapiens
AEDRGMLLKTFNEPGSEYFIFLLSTR

SEQ ID NO: 4948 - protein, 14 aa, Homo sapiens
LKIPEGLFDPSNVK

SEQ ID NO: 4949 - protein, 11 aa, Homo sapiens
ELSQKTPPSMR

SEQ ID NO: 4950 - protein, 11 aa, Homo sapiens
ELSQKTPPSMR

SEQ ID NO: 4951 - protein, 11 aa, Homo sapiens
ELSQKTPPSMR

SEQ ID NO: 4952 - protein, 11 aa, Homo sapiens
ELSQKTPPSMR

SEQ ID NO: 4953 - protein, 11 aa, Homo sapiens
ELSQKTPPSMR

SEQ ID NO: 4954 - protein, 11 aa, Homo sapiens
ELSQKTPPSMR

SEQ ID NO: 4955 - protein, 14 aa, Homo sapiens
LNRELSQKTPPSMR

SEQ ID NO: 4956 - protein, 12 aa, Homo sapiens
LKLIANNTTVER

SEQ ID NO: 4957 - protein, 12 aa, Homo sapiens
LKLIANNTTVER

SEQ ID NO: 4958 - protein, 12 aa, Homo sapiens
LKLIANNTTVER

SEQ ID NO: 4959 - protein, 13 aa, Homo sapiens
LKLIANNTTVERR

SEQ ID NO: 4960 - protein, 12 aa, Homo sapiens
LKLIANNTTVER

SEQ ID NO: 4961 - protein, 13 aa, Homo sapiens
LKLIANNTTVERR

SEQ ID NO: 4962 - protein, 12 aa, Homo sapiens
LKLIANNTTVER

SEQ ID NO: 4963 - protein, 12 aa, Homo sapiens
LKLIANNTTVER

SEQ ID NO: 4964 - protein, 13 aa, Homo sapiens
LKLIANNTTVERR

SEQ ID NO: 4965 - protein, 12 aa, Homo sapiens
LKLIANNTTVER

SEQ ID NO: 4966 - protein, 12 aa, Homo sapiens
LKLIANNTTVER

SEQ ID NO: 4967 - protein, 13 aa, Homo sapiens
LKLIANNTTVERR

SEQ ID NO: 4968 - protein, 12 aa, Homo sapiens
LKLIANNTTVER

SEQ ID NO: 4969 - protein, 13 aa, Homo sapiens
LKLIANNTTVERR

SEQ ID NO: 4970 - protein, 12 aa, Homo sapiens
LKLIANNTTVER

SEQ ID NO: 4971 - protein, 12 aa, Homo sapiens
LKLIANNTTVER

SEQ ID NO: 4972 - protein, 12 aa, Homo sapiens
LKLIANNTTVER

SEQ ID NO: 4973 - protein, 13 aa, Homo sapiens
LKLIANNTTVERR

SEQ ID NO: 4974 - protein, 12 aa, Homo sapiens
LKLIANNTTVER

SEQ ID NO: 4975 - protein, 12 aa, Homo sapiens
LKLIANNTTVER

SEQ ID NO: 4976 - protein, 12 aa, Homo sapiens
LKLIANNTTVER

SEQ ID NO: 4977 - protein, 12 aa, Homo sapiens
LKLIANNTTVER

SEQ ID NO: 4978 - protein, 12 aa, Homo sapiens
LKLIANNTTVER

SEQ ID NO: 4979 - protein, 12 aa, Homo sapiens
LKLIANNTTVER

SEQ ID NO: 4980 - protein, 12 aa, Homo sapiens
LKLIANNTTVER

SEQ ID NO: 4981 - protein, 12 aa, Homo sapiens
LKLIANNTTVER

SEQ ID NO: 4982 - protein, 13 aa, Homo sapiens
LKLIANNTTVERR

SEQ ID NO: 4983 - protein, 12 aa, Homo sapiens
LKLIANNTTVER

SEQ ID NO: 4984 - protein, 12 aa, Homo sapiens
LKLIANNTTVER

SEQ ID NO: 4985 - protein, 12 aa, Homo sapiens
LKLIANNTTVER

SEQ ID NO: 4986 - protein, 12 aa, Homo sapiens
LKLIANNTTVER

SEQ ID NO: 4987 - protein, 13 aa, Homo sapiens
LKLIANNTTVERR

SEQ ID NO: 4988 - protein, 12 aa, Homo sapiens
LKLIANNTTVER

SEQ ID NO: 4989 - protein, 13 aa, Homo sapiens
LKLIANNTTVERR

SEQ ID NO: 4990 - protein, 12 aa, Homo sapiens
LKLIANNTTVER

SEQ ID NO: 4991 - protein, 12 aa, Homo sapiens
LKLIANNTTVER

SEQ ID NO: 4992 - protein, 12 aa, Homo sapiens
LKLIANNTTVER

SEQ ID NO: 4993 - protein, 12 aa, Homo sapiens
LKLIANNTTVER

SEQ ID NO: 4994 - protein, 12 aa, Homo sapiens
LKLIANNTTVER

SEQ ID NO: 4995 - protein, 13 aa, Homo sapiens
LKLIANNTTVERR

SEQ ID NO: 4996 - protein, 13 aa, Homo sapiens
LKLIANNTTVERR

SEQ ID NO: 4997 - protein, 13 aa, Homo sapiens
LKLIANNTTVERR

SEQ ID NO: 4998 - protein, 13 aa, Homo sapiens
LKLIANNTTVERR

SEQ ID NO: 4999 - protein, 13 aa, Homo sapiens
LKLIANNTTVERR

SEQ ID NO: 5000 - protein, 12 aa, Homo sapiens
LKLIANNTTVER

SEQ ID NO: 5001 - protein, 12 aa, Homo sapiens
LKLIANNTTVER

SEQ ID NO: 5002 - protein, 12 aa, Homo sapiens
LKLIANNTTVER

SEQ ID NO: 5003 - protein, 13 aa, Homo sapiens
LKLIANNTTVERR

SEQ ID NO: 5004 - protein, 12 aa, Homo sapiens
LKLIANNTTVER

SEQ ID NO: 5005 - protein, 12 aa, Homo sapiens
LKLIANNTTVER

SEQ ID NO: 5006 - protein, 13 aa, Homo sapiens
LKLIANNTTVERR

SEQ ID NO: 5007 - protein, 13 aa, Homo sapiens
LKLIANNTTVERR

SEQ ID NO: 5008 - protein, 13 aa, Homo sapiens
LKLIANNTTVERR

SEQ ID NO: 5009 - protein, 13 aa, Homo sapiens
LKLIANNTTVERR

SEQ ID NO: 5010 - protein, 12 aa, Homo sapiens
LKLIANNTTVER

SEQ ID NO: 5011 - protein, 12 aa, Homo sapiens
LKLIANNTTVER

SEQ ID NO: 5012 - protein, 12 aa, Homo sapiens
LKLIANNTTVER

SEQ ID NO: 5013 - protein, 12 aa, Homo sapiens
LKLIANNTTVER

SEQ ID NO: 5014 - protein, 13 aa, Homo sapiens
LKLIANNTTVERR

SEQ ID NO: 5015 - protein, 13 aa, Homo sapiens
LKLIANNTTVERR

SEQ ID NO: 5016 - protein, 13 aa, Homo sapiens
LKLIANNTTVERR

SEQ ID NO: 5017 - protein, 12 aa, Homo sapiens
LKLIANNTTVER

SEQ ID NO: 5018 - protein, 12 aa, Homo sapiens
LKLIANNTTVER

SEQ ID NO: 5019 - protein, 7 aa, Homo sapiens
DFKEYHR

SEQ ID NO: 5020 - protein, 7 aa, Homo sapiens
DFKEYHR

SEQ ID NO: 5021 - protein, 7 aa, Homo sapiens
DFKEYHR

SEQ ID NO: 5022 - protein, 7 aa, Homo sapiens
DFKEYHR

SEQ ID NO: 5023 - protein, 7 aa, Homo sapiens
DFKEYHR

SEQ ID NO: 5024 - protein, 7 aa, Homo sapiens
DFKEYHR

SEQ ID NO: 5025 - protein, 7 aa, Homo sapiens
DFKEYHR

SEQ ID NO: 5026 - protein, 7 aa, Homo sapiens
DFKEYHR

SEQ ID NO: 5027 - protein, 7 aa, Homo sapiens
DFKEYHR

SEQ ID NO: 5028 - protein, 7 aa, Homo sapiens
DFKEYHR

SEQ ID NO: 5029 - protein, 7 aa, Homo sapiens
DFKEYHR

SEQ ID NO: 5030 - protein, 7 aa, Homo sapiens
DFKEYHR

SEQ ID NO: 5031 - protein, 7 aa, Homo sapiens
DFKEYHR

SEQ ID NO: 5032 - protein, 12 aa, Homo sapiens
LKLIANNTTVER

SEQ ID NO: 5033 - protein, 7 aa, Homo sapiens
DFKEYHR

SEQ ID NO: 5034 - protein, 7 aa, Homo sapiens
DFKEYHR

SEQ ID NO: 5035 - protein, 12 aa, Homo sapiens
LKLIANNTTVER

SEQ ID NO: 5036 - protein, 12 aa, Homo sapiens
LKLIANNTTVER

SEQ ID NO: 5037 - protein, 7 aa, Homo sapiens
IRNHKYR

SEQ ID NO: 5038 - protein, 15 aa, Homo sapiens
DKPASENSEEKLISK

SEQ ID NO: 5039 - protein, 13 aa, Homo sapiens
QEYEEGGKQCVER

SEQ ID NO: 5040 - protein, 13 aa, Homo sapiens
QEYEEGGKQCVER

SEQ ID NO: 5041 - protein, 13 aa, Homo sapiens
QEYEEGGKQCVER

SEQ ID NO: 5042 - protein, 13 aa, Homo sapiens
QEYEEGGKQCVER

SEQ ID NO: 5043 - protein, 13 aa, Homo sapiens
QEYEEGGKQCVER

SEQ ID NO: 5044 - protein, 13 aa, Homo sapiens
QEYEEGGKQCVER

SEQ ID NO: 5045 - protein, 13 aa, Homo sapiens
QEYEEGGKQCVER

SEQ ID NO: 5046 - protein, 13 aa, Homo sapiens
QEYEEGGKQCVER

SEQ ID NO: 5047 - protein, 13 aa, Homo sapiens
QEYEEGGKQCVER

SEQ ID NO: 5048 - protein, 13 aa, Homo sapiens
QEYEEGGKQCVER

SEQ ID NO: 5049 - protein, 13 aa, Homo sapiens
QEYEEGGKQCVER

SEQ ID NO: 5050 - protein, 13 aa, Homo sapiens
QEYEEGGKQCVER

SEQ ID NO: 5051 - protein, 13 aa, Homo sapiens
QEYEEGGKQCVER

SEQ ID NO: 5052 - protein, 13 aa, Homo sapiens
QEYEEGGKQCVER

SEQ ID NO: 5053 - protein, 13 aa, Homo sapiens
QEYEEGGKQCVER

SEQ ID NO: 5054 - protein, 13 aa, Homo sapiens
QEYEEGGKQCVER

SEQ ID NO: 5055 - protein, 13 aa, Homo sapiens
QEYEEGGKQCVER

SEQ ID NO: 5056 - protein, 13 aa, Homo sapiens
QEYEEGGKQCVER

SEQ ID NO: 5057 - protein, 13 aa, Homo sapiens
QEYEEGGKQCVER

SEQ ID NO: 5058 - protein, 13 aa, Homo sapiens
QEYEEGGKQCVER

SEQ ID NO: 5059 - protein, 13 aa, Homo sapiens
QEYEEGGKQCVER

SEQ ID NO: 5060 - protein, 13 aa, Homo sapiens
QEYEEGGKQCVER

SEQ ID NO: 5061 - protein, 13 aa, Homo sapiens
QEYEEGGKQCVER

SEQ ID NO: 5062 - protein, 13 aa, Homo sapiens
QEYEEGGKQCVER

SEQ ID NO: 5063 - protein, 13 aa, Homo sapiens
QEYEEGGKQCVER

SEQ ID NO: 5064 - protein, 13 aa, Homo sapiens
QEYEEGGKQCVER

SEQ ID NO: 5065 - protein, 13 aa, Homo sapiens
QEYEEGGKQCVER

SEQ ID NO: 5066 - protein, 7 aa, Homo sapiens
KPLDLYR

SEQ ID NO: 5067 - protein, 11 aa, Homo sapiens
ELSQKTPPSMR

SEQ ID NO: 5068 - protein, 11 aa, Homo sapiens
ELSQKTPPSMR

SEQ ID NO: 5069 - protein, 11 aa, Homo sapiens
ELSQKTPPSMR

SEQ ID NO: 5070 - protein, 11 aa, Homo sapiens
ELSQKTPPSMR

SEQ ID NO: 5071 - protein, 11 aa, Homo sapiens
ELSQKTPPSMR

SEQ ID NO: 5072 - protein, 12 aa, Homo sapiens
LKLIANNTTVER

SEQ ID NO: 5073 - protein, 13 aa, Homo sapiens
LKLIANNTTVERR

SEQ ID NO: 5074 - protein, 13 aa, Homo sapiens
LKLIANNTTVERR

SEQ ID NO: 5075 - protein, 12 aa, Homo sapiens
LKLIANNTTVER

SEQ ID NO: 5076 - protein, 12 aa, Homo sapiens
LKLIANNTTVER

SEQ ID NO: 5077 - protein, 13 aa, Homo sapiens
LKLIANNTTVERR

SEQ ID NO: 5078 - protein, 12 aa, Homo sapiens
LKLIANNTTVER

SEQ ID NO: 5079 - protein, 13 aa, Homo sapiens
LKLIANNTTVERR

SEQ ID NO: 5080 - protein, 12 aa, Homo sapiens
LKLIANNTTVER

SEQ ID NO: 5081 - protein, 13 aa, Homo sapiens
LKLIANNTTVERR

SEQ ID NO: 5082 - protein, 12 aa, Homo sapiens
LKLIANNTTVER

SEQ ID NO: 5083 - protein, 18 aa, Homo sapiens
TPPSMRLKLIANNTTVER

SEQ ID NO: 5084 - protein, 18 aa, Homo sapiens
TPPSMRLKLIANNTTVER

SEQ ID NO: 5085 - protein, 18 aa, Homo sapiens
TPPSMRLKLIANNTTVER

SEQ ID NO: 5086 - protein, 10 aa, Homo sapiens
EKEAAEQAER

SEQ ID NO: 5087 - protein, 18 aa, Homo sapiens
TPPSMRLKLIANNTTVER

SEQ ID NO: 5088 - protein, 13 aa, Homo sapiens
ASNPDLKLWEIGK

SEQ ID NO: 5089 - protein, 8 aa, Homo sapiens
EKLPQVTR

SEQ ID NO: 5090 - protein, 9 aa, Homo sapiens
KEKLPQVTR

SEQ ID NO: 5091 - protein, 9 aa, Homo sapiens
KEKLPQVTR

SEQ ID NO: 5092 - protein, 14 aa, Homo sapiens
QAFHMEQLKYAEMR

SEQ ID NO: 5093 - protein, 14 aa, Homo sapiens
QAFHMEQLKYAEMR

SEQ ID NO: 5094 - protein, 14 aa, Homo sapiens
QAFHMEQLKYAEMR

SEQ ID NO: 5095 - protein, 14 aa, Homo sapiens
QAFHMEQLKYAEMR

SEQ ID NO: 5096 - protein, 14 aa, Homo sapiens
QAFHMEQLKYAEMR

SEQ ID NO: 5097 - protein, 18 aa, Homo sapiens
TPPSMRLKLIANNTTVER

SEQ ID NO: 5098 - protein, 18 aa, Homo sapiens
TPPSMRLKLIANNTTVER

SEQ ID NO: 5099 - protein, 18 aa, Homo sapiens
TPPSMRLKLIANNTTVER

SEQ ID NO: 5100 - protein, 18 aa, Homo sapiens
TPPSMRLKLIANNTTVER

SEQ ID NO: 5101 - protein, 15 aa, Homo sapiens
IKSLVALLVETQMKK

SEQ ID NO: 5102 - protein, 10 aa, Homo sapiens
THKLQDPHER

SEQ ID NO: 5103 - protein, 10 aa, Homo sapiens
THKLQDPHER

SEQ ID NO: 5104 - protein, 10 aa, Homo sapiens
THKLQDPHER

SEQ ID NO: 5105 - protein, 10 aa, Homo sapiens
THKLQDPHER

SEQ ID NO: 5106 - protein, 10 aa, Homo sapiens
THKLQDPHER

SEQ ID NO: 5107 - protein, 10 aa, Homo sapiens
THKLQDPHER

SEQ ID NO: 5108 - protein, 10 aa, Homo sapiens
THKLQDPHER

SEQ ID NO: 5109 - protein, 10 aa, Homo sapiens
THKLQDPHER

SEQ ID NO: 5110 - protein, 10 aa, Homo sapiens
THKLQDPHER

SEQ ID NO: 5111 - protein, 9 aa, Homo sapiens
MKFSEIPQR

SEQ ID NO: 5112 - protein, 10 aa, Homo sapiens
THKLQDPHER

SEQ ID NO: 5113 - protein, 10 aa, Homo sapiens
THKLQDPHER

SEQ ID NO: 5114 - protein, 10 aa, Homo sapiens
THKLQDPHER

SEQ ID NO: 5115 - protein, 10 aa, Homo sapiens
THKLQDPHER

SEQ ID NO: 5116 - protein, 10 aa, Homo sapiens
THKLQDPHER

SEQ ID NO: 5117 - protein, 10 aa, Homo sapiens
THKLQDPHER

SEQ ID NO: 5118 - protein, 10 aa, Homo sapiens
THKLQDPHER

SEQ ID NO: 5119 - protein, 16 aa, Homo sapiens
MSPSKSPFLPSMKMQK

SEQ ID NO: 5120 - protein, 11 aa, Homo sapiens
ELSQKTPPSMR

SEQ ID NO: 5121 - protein, 11 aa, Homo sapiens
ELSQKTPPSMR

SEQ ID NO: 5122 - protein, 11 aa, Homo sapiens
ELSQKTPPSMR

SEQ ID NO: 5123 - protein, 8 aa, Homo sapiens
EKLPQVTR

SEQ ID NO: 5124 - protein, 7 aa, Homo sapiens
TDPLEKR

SEQ ID NO: 5125 - protein, 7 aa, Homo sapiens
TDPLEKR

SEQ ID NO: 5126 - protein, 10 aa, Homo sapiens
SKGKGVGSAR

SEQ ID NO: 5127 - protein, 12 aa, Homo sapiens
LKLIANNTTVER

SEQ ID NO: 5128 - protein, 6 aa, Homo sapiens
GSLYKR

SEQ ID NO: 5129 - protein, 6 aa, Homo sapiens
GSLYKR

SEQ ID NO: 5130 - protein, 6 aa, Homo sapiens
EQKAKR

SEQ ID NO: 5131 - protein, 6 aa, Homo sapiens
EQKAKR

SEQ ID NO: 5132 - protein, 16 aa, Homo sapiens
GKQGGPTYYIDTNALR

SEQ ID NO: 5133 - protein, 16 aa, Homo sapiens
GKQGGPTYYIDTNALR

SEQ ID NO: 5134 - protein, 6 aa, Homo sapiens
GSLYKR

SEQ ID NO: 5135 - protein, 6 aa, Homo sapiens
EQKAKR

SEQ ID NO: 5136 - protein, 6 aa, Homo sapiens
EQKAKR

SEQ ID NO: 5137 - protein, 9 aa, Homo sapiens
EGSPANWKR

SEQ ID NO: 5138 - protein, 9 aa, Homo sapiens
EGSPANWKR

SEQ ID NO: 5139 - protein, 14 aa, Homo sapiens
QNFHMEQLKYAELR

SEQ ID NO: 5140 - protein, 14 aa, Homo sapiens
QNFHMEQLKYAELR

SEQ ID NO: 5141 - protein, 14 aa, Homo sapiens
QNFHMEQLKYAELR

SEQ ID NO: 5142 - protein, 14 aa, Homo sapiens
QNFHMEQLKYAELR

SEQ ID NO: 5143 - protein, 14 aa, Homo sapiens
QNFHMEQLKYAELR

SEQ ID NO: 5144 - protein, 14 aa, Homo sapiens
QNFHMEQLKYAELR

SEQ ID NO: 5145 - protein, 14 aa, Homo sapiens
QNFHMEQLKYAELR

SEQ ID NO: 5146 - protein, 14 aa, Homo sapiens
QNFHMEQLKYAELR

SEQ ID NO: 5147 - protein, 14 aa, Homo sapiens
QNFHMEQLKYAELR

SEQ ID NO: 5148 - protein, 14 aa, Homo sapiens
QNFHMEQLKYAELR

SEQ ID NO: 5149 - protein, 14 aa, Homo sapiens
QNFHMEQLKYAELR

SEQ ID NO: 5150 - protein, 11 aa, Homo sapiens
ELSQKTPPSMR

SEQ ID NO: 5151 - protein, 12 aa, Homo sapiens
LKLIANNTTVER

SEQ ID NO: 5152 - protein, 11 aa, Homo sapiens
HQGTFTDEKSK

SEQ ID NO: 5153 - protein, 9 aa, Homo sapiens
EKEALEQQR

SEQ ID NO: 5154 - protein, 7 aa, Homo sapiens
KASANAR

SEQ ID NO: 5155 - protein, 7 aa, Homo sapiens
KASANAR

SEQ ID NO: 5156 - protein, 5 aa, Homo sapiens
LKGGR

SEQ ID NO: 5157 - protein, 7 aa, Homo sapiens
KVQEAAR

SEQ ID NO: 5158 - protein, 7 aa, Homo sapiens
TDIYSKK

SEQ ID NO: 5159 - protein, 7 aa, Homo sapiens
TDIYSKK

SEQ ID NO: 5160 - protein, 5 aa, Homo sapiens
KTLAK

SEQ ID NO: 5161 - protein, 5 aa, Homo sapiens
KTLAK

SEQ ID NO: 5162 - protein, 8 aa, Homo sapiens
SKGASAGR

SEQ ID NO: 5163 - protein, 8 aa, Homo sapiens
SKGASAGR

SEQ ID NO: 5164 - protein, 8 aa, Homo sapiens
SKGASAGR

SEQ ID NO: 5165 - protein, 7 aa, Homo sapiens
KVQEAAR

SEQ ID NO: 5166 - protein, 4 aa, Homo sapiens
KSSR

SEQ ID NO: 5167 - protein, 9 aa, Homo sapiens
DRKASANAR

SEQ ID NO: 5168 - protein, 10 aa, Homo sapiens
VSYKGSPAAR

SEQ ID NO: 5169 - protein, 6 aa, Homo sapiens
IQKLTK

SEQ ID NO: 5170 - protein, 7 aa, Homo sapiens
KASANAR

SEQ ID NO: 5171 - protein, 7 aa, Homo sapiens
KVQEAAR

SEQ ID NO: 5172 - protein, 7 aa, Homo sapiens
KASANAR

SEQ ID NO: 5173 - protein, 9 aa, Homo sapiens
ATIELKALR

SEQ ID NO: 5174 - protein, 11 aa, Homo sapiens
TKATIELKALR

SEQ ID NO: 5175 - protein, 9 aa, Homo sapiens
ATIELKALR

SEQ ID NO: 5176 - protein, 11 aa, Homo sapiens
TKATIELKALR

SEQ ID NO: 5177 - protein, 11 aa, Homo sapiens
TKATIELKALR

SEQ ID NO: 5178 - protein, 9 aa, Homo sapiens
ATIELKALR

SEQ ID NO: 5179 - protein, 9 aa, Homo sapiens
ATIELKALR

SEQ ID NO: 5180 - protein, 9 aa, Homo sapiens
ATIELKALR

SEQ ID NO: 5181 - protein, 7 aa, Homo sapiens
ITEKLEK

SEQ ID NO: 5182 - protein, 7 aa, Homo sapiens
ITEKLEK

SEQ ID NO: 5183 - protein, 16 aa, Homo sapiens
GQPLPDHLQMAVQGKR

SEQ ID NO: 5184 - protein, 16 aa, Homo sapiens
KRDSDAGSSTPTTSTR

SEQ ID NO: 5185 - protein, 14 aa, Homo sapiens
KLRIFISNTFNPAK

SEQ ID NO: 5186 - protein, 10 aa, Homo sapiens
YNQMKGMGMR

SEQ ID NO: 5187 - protein, 10 aa, Homo sapiens
YNQMKGMGMR

SEQ ID NO: 5188 - protein, 5 aa, Homo sapiens
KMADK

SEQ ID NO: 5189 - protein, 5 aa, Homo sapiens
KMADK

SEQ ID NO: 5190 - protein, 6 aa, Homo sapiens
NHNAKK

SEQ ID NO: 5191 - protein, 6 aa, Homo sapiens
NHNAKK

SEQ ID NO: 5192 - protein, 6 aa, Homo sapiens
NHNAKK

SEQ ID NO: 5193 - protein, 6 aa, Homo sapiens
NHNAKK

SEQ ID NO: 5194 - protein, 6 aa, Homo sapiens
NHNAKK

SEQ ID NO: 5195 - protein, 8 aa, Homo sapiens
ITPIQKPR

SEQ ID NO: 5196 - protein, 8 aa, Homo sapiens
ITPIQKPR

SEQ ID NO: 5197 - protein, 8 aa, Homo sapiens
ITPIQKPR

SEQ ID NO: 5198 - protein, 8 aa, Homo sapiens
ITPIQKPR

SEQ ID NO: 5199 - protein, 9 aa, Homo sapiens
ATIELKALR

SEQ ID NO: 5200 - protein, 11 aa, Homo sapiens
TKATIELKALR

SEQ ID NO: 5201 - protein, 11 aa, Homo sapiens
TKATIELKALR

SEQ ID NO: 5202 - protein, 11 aa, Homo sapiens
TKATIELKALR

SEQ ID NO: 5203 - protein, 4 aa, Homo sapiens
AVRK

SEQ ID NO: 5204 - protein, 7 aa, Homo sapiens
TDMYTKK

SEQ ID NO: 5205 - protein, 7 aa, Homo sapiens
TDMYTKK

SEQ ID NO: 5206 - protein, 9 aa, Homo sapiens
SKAAASATR

SEQ ID NO: 5207 - protein, 15 aa, Homo sapiens
MKEEVPTALVEAHVR

SEQ ID NO: 5208 - protein, 15 aa, Homo sapiens
MKEEVPTALVEAHVR

SEQ ID NO: 5209 - protein, 15 aa, Homo sapiens
MKEEVPTALVEAHVR

SEQ ID NO: 5210 - protein, 4 aa, Homo sapiens
AVRK

SEQ ID NO: 5211 - protein, 4 aa, Homo sapiens
AVRK

SEQ ID NO: 5212 - protein, 5 aa, Homo sapiens
LKGGR

SEQ ID NO: 5213 - protein, 7 aa, Homo sapiens
ITEKLEK

SEQ ID NO: 5214 - protein, 7 aa, Homo sapiens
ITEKLEK

SEQ ID NO: 5215 - protein, 10 aa, Homo sapiens
ITEKLEKQQK

SEQ ID NO: 5216 - protein, 10 aa, Homo sapiens
ITEKLEKQQK

SEQ ID NO: 5217 - protein, 10 aa, Homo sapiens
ITEKLEKQQK

SEQ ID NO: 5218 - protein, 16 aa, Homo sapiens
GQPLPDHLQMAVQGKR

SEQ ID NO: 5219 - protein, 10 aa, Homo sapiens
YNQMKGMGMR

SEQ ID NO: 5220 - protein, 6 aa, Homo sapiens
EQKAKR

SEQ ID NO: 5221 - protein, 6 aa, Homo sapiens
QKKSSR

SEQ ID NO: 5222 - protein, 7 aa, Homo sapiens
KIRDQDR

SEQ ID NO: 5223 - protein, 6 aa, Homo sapiens
IQKLTK

SEQ ID NO: 5224 - protein, 6 aa, Homo sapiens
IQKLTK

SEQ ID NO: 5225 - protein, 6 aa, Homo sapiens
EQKAKR

SEQ ID NO: 5226 - protein, 6 aa, Homo sapiens
EQKAKR

SEQ ID NO: 5227 - protein, 6 aa, Homo sapiens
EQKAKR

SEQ ID NO: 5228 - protein, 6 aa, Homo sapiens
RKMADK

SEQ ID NO: 5229 - protein, 6 aa, Homo sapiens
RKMADK

SEQ ID NO: 5230 - protein, 6 aa, Homo sapiens
RKMADK

SEQ ID NO: 5231 - protein, 6 aa, Homo sapiens
RKMADK

SEQ ID NO: 5232 - protein, 6 aa, Homo sapiens
RKMADK

SEQ ID NO: 5233 - protein, 11 aa, Homo sapiens
DPKGYVQDLLR

SEQ ID NO: 5234 - protein, 10 aa, Homo sapiens
YNQMKGMGMR

SEQ ID NO: 5235 - protein, 10 aa, Homo sapiens
YNQMKGMGMR

SEQ ID NO: 5236 - protein, 9 aa, Homo sapiens
KEKLPQVTR

SEQ ID NO: 5237 - protein, 9 aa, Homo sapiens
KEKLPQVTR

SEQ ID NO: 5238 - protein, 9 aa, Homo sapiens
KEKLPQVTR

SEQ ID NO: 5239 - protein, 9 aa, Homo sapiens
KEKLPQVTR

SEQ ID NO: 5240 - protein, 9 aa, Homo sapiens
KEKLPQVTR

SEQ ID NO: 5241 - protein, 9 aa, Homo sapiens
KEKLPQVTR

SEQ ID NO: 5242 - protein, 8 aa, Homo sapiens
EKLPQVTR

SEQ ID NO: 5243 - protein, 8 aa, Homo sapiens
EKLPQVTR

SEQ ID NO: 5244 - protein, 9 aa, Homo sapiens
KEKLPQVTR

SEQ ID NO: 5245 - protein, 9 aa, Homo sapiens
KEKLPQVTR

SEQ ID NO: 5246 - protein, 8 aa, Homo sapiens
EKLPQVTR

SEQ ID NO: 5247 - protein, 9 aa, Homo sapiens
KEKLPQVTR

SEQ ID NO: 5248 - protein, 8 aa, Homo sapiens
EKLPQVTR

SEQ ID NO: 5249 - protein, 8 aa, Homo sapiens
EKLPQVTR

SEQ ID NO: 5250 - protein, 9 aa, Homo sapiens
KEKLPQVTR

SEQ ID NO: 5251 - protein, 9 aa, Homo sapiens
KEKLPQVTR

SEQ ID NO: 5252 - protein, 9 aa, Homo sapiens
KEKLPQVTR

SEQ ID NO: 5253 - protein, 8 aa, Homo sapiens
EKLPQVTR

SEQ ID NO: 5254 - protein, 8 aa, Homo sapiens
EKLPQVTR

SEQ ID NO: 5255 - protein, 9 aa, Homo sapiens
KEKLPQVTR

SEQ ID NO: 5256 - protein, 8 aa, Homo sapiens
EKLPQVTR

SEQ ID NO: 5257 - protein, 9 aa, Homo sapiens
KEKLPQVTR

SEQ ID NO: 5258 - protein, 9 aa, Homo sapiens
KEKLPQVTR

SEQ ID NO: 5259 - protein, 9 aa, Homo sapiens
KEKLPQVTR

SEQ ID NO: 5260 - protein, 9 aa, Homo sapiens
KEKLPQVTR

SEQ ID NO: 5261 - protein, 13 aa, Homo sapiens
DLTDYLMKILTER

SEQ ID NO: 5262 - protein, 7 aa, Homo sapiens
AKDDIKR

SEQ ID NO: 5263 - protein, 9 aa, Homo sapiens
IKIIAPPER

SEQ ID NO: 5264 - protein, 9 aa, Homo sapiens
IKIIAPPER

SEQ ID NO: 5265 - protein, 9 aa, Homo sapiens
IKIIAPPER

SEQ ID NO: 5266 - protein, 9 aa, Homo sapiens
IKIIAPPER

SEQ ID NO: 5267 - protein, 9 aa, Homo sapiens
IKIIAPPER

SEQ ID NO: 5268 - protein, 9 aa, Homo sapiens
IKIIAPPER

SEQ ID NO: 5269 - protein, 9 aa, Homo sapiens
IKIIAPPER

SEQ ID NO: 5270 - protein, 3 aa, Homo sapiens
KCF

SEQ ID NO: 5271 - protein, 3 aa, Homo sapiens
KCF

SEQ ID NO: 5272 - protein, 15 aa, Homo sapiens
AVATYHANTEREQKK

SEQ ID NO: 5273 - protein, 15 aa, Homo sapiens
AVATYHANTEREQKK

SEQ ID NO: 5274 - protein, 11 aa, Homo sapiens
WKYMIVDEGHR

SEQ ID NO: 5275 - protein, 9 aa, Homo sapiens
IKIIAPPER

SEQ ID NO: 5276 - protein, 9 aa, Homo sapiens
IKIIAPPER

SEQ ID NO: 5277 - protein, 5 aa, Homo sapiens
KETER

SEQ ID NO: 5278 - protein, 5 aa, Homo sapiens
KETER

SEQ ID NO: 5279 - protein, 5 aa, Homo sapiens
IEKER

SEQ ID NO: 5280 - protein, 5 aa, Homo sapiens
IEKER

SEQ ID NO: 5281 - protein, 5 aa, Homo sapiens
IEKER

SEQ ID NO: 5282 - protein, 9 aa, Homo sapiens
IKIIAPPER

SEQ ID NO: 5283 - protein, 5 aa, Homo sapiens
IEKER

SEQ ID NO: 5284 - protein, 7 aa, Homo sapiens
MAGRTVR

SEQ ID NO: 5285 - protein, 8 aa, Homo sapiens
KVMATIEK

SEQ ID NO: 5286 - protein, 8 aa, Homo sapiens
KVMATIEK

SEQ ID NO: 5287 - protein, 8 aa, Homo sapiens
KVMATIEK

SEQ ID NO: 5288 - protein, 6 aa, Homo sapiens
EQKAKR

SEQ ID NO: 5289 - protein, 6 aa, Homo sapiens
EQKAKR

SEQ ID NO: 5290 - protein, 7 aa, Homo sapiens
AKDDIKK

SEQ ID NO: 5291 - protein, 6 aa, Homo sapiens
EQKAKR

SEQ ID NO: 5292 - protein, 6 aa, Homo sapiens
EQKAKR

SEQ ID NO: 5293 - protein, 6 aa, Homo sapiens
EQKAKR

SEQ ID NO: 5294 - protein, 6 aa, Homo sapiens
EQKAKR

SEQ ID NO: 5295 - protein, 10 aa, Homo sapiens
AGRTVRAETR

SEQ ID NO: 5296 - protein, 8 aa, Homo sapiens
SRAKDDIK

SEQ ID NO: 5297 - protein, 8 aa, Homo sapiens
SRAKDDIK

SEQ ID NO: 5298 - protein, 7 aa, Homo sapiens
AKDDIKK

SEQ ID NO: 5299 - protein, 6 aa, Homo sapiens
AKDDIK

SEQ ID NO: 5300 - protein, 8 aa, Homo sapiens
SRAKDDIK

SEQ ID NO: 5301 - protein, 7 aa, Homo sapiens
AKDDIKK

SEQ ID NO: 5302 - protein, 6 aa, Homo sapiens
IQKLTK

SEQ ID NO: 5303 - protein, 9 aa, Homo sapiens
VMATIEKVR

SEQ ID NO: 5304 - protein, 8 aa, Homo sapiens
SRAKDDIK

SEQ ID NO: 5305 - protein, 6 aa, Homo sapiens
IQKLTK

SEQ ID NO: 5306 - protein, 6 aa, Homo sapiens
IQKLTK

SEQ ID NO: 5307 - protein, 7 aa, Homo sapiens
AKDDIKK

SEQ ID NO: 5308 - protein, 7 aa, Homo sapiens
AKDDIKK

SEQ ID NO: 5309 - protein, 7 aa, Homo sapiens
AKDDIKK

SEQ ID NO: 5310 - protein, 7 aa, Homo sapiens
AKDDIKK

SEQ ID NO: 5311 - protein, 9 aa, Homo sapiens
HIFAKVQQR

SEQ ID NO: 5312 - protein, 9 aa, Homo sapiens
ATIELKALR

SEQ ID NO: 5313 - protein, 9 aa, Homo sapiens
ATIELKALR

SEQ ID NO: 5314 - protein, 9 aa, Homo sapiens
ATIELKALR

SEQ ID NO: 5315 - protein, 9 aa, Homo sapiens
ATIELKALR

SEQ ID NO: 5316 - protein, 11 aa, Homo sapiens
TKATIELKALR

SEQ ID NO: 5317 - protein, 9 aa, Homo sapiens
ATIELKALR

SEQ ID NO: 5318 - protein, 11 aa, Homo sapiens
TKATIELKALR

SEQ ID NO: 5319 - protein, 9 aa, Homo sapiens
ATIELKALR

SEQ ID NO: 5320 - protein, 9 aa, Homo sapiens
ATIELKALR

SEQ ID NO: 5321 - protein, 5 aa, Homo sapiens
LKGGR

SEQ ID NO: 5322 - protein, 5 aa, Homo sapiens
LKGGR

SEQ ID NO: 5323 - protein, 7 aa, Homo sapiens
TDPLEKR

SEQ ID NO: 5324 - protein, 7 aa, Homo sapiens
TDPLEKR

SEQ ID NO: 5325 - protein, 7 aa, Homo sapiens
TDPLEKR

SEQ ID NO: 5326 - protein, 10 aa, Homo sapiens
PYACDICGKR

SEQ ID NO: 5327 - protein, 5 aa, Homo sapiens
QKIAK

SEQ ID NO: 5328 - protein, 5 aa, Homo sapiens
IKLNK

SEQ ID NO: 5329 - protein, 7 aa, Homo sapiens
DFKEYHR

SEQ ID NO: 5330 - protein, 5 aa, Homo sapiens
QKIAK

SEQ ID NO: 5331 - protein, 5 aa, Homo sapiens
QKIAK

SEQ ID NO: 5332 - protein, 5 aa, Homo sapiens
QKIAK

SEQ ID NO: 5333 - protein, 7 aa, Homo sapiens
SEEQKSK

SEQ ID NO: 5334 - protein, 5 aa, Homo sapiens
QKIAK

SEQ ID NO: 5335 - protein, 11 aa, Homo sapiens
KELPEYYELIR

SEQ ID NO: 5336 - protein, 11 aa, Homo sapiens
KELPEYYELIR

SEQ ID NO: 5337 - protein, 17 aa, Homo sapiens
KEGLISQDGSSLEALLR

SEQ ID NO: 5338 - protein, 10 aa, Homo sapiens
VEEAAKVTGK

SEQ ID NO: 5339 - protein, 7 aa, Homo sapiens
TDPLEKR

SEQ ID NO: 5340 - protein, 13 aa, Homo sapiens
ALPEFFNGKNKSK

SEQ ID NO: 5341 - protein, 13 aa, Homo sapiens
ALPEFFNGKNKSK

SEQ ID NO: 5342 - protein, 7 aa, Homo sapiens
KGGNYKK

SEQ ID NO: 5343 - protein, 8 aa, Homo sapiens
GKGVGSAR

SEQ ID NO: 5344 - protein, 6 aa, Homo sapiens
EPKEPR

SEQ ID NO: 5345 - protein, 6 aa, Homo sapiens
EPKEPR

SEQ ID NO: 5346 - protein, 6 aa, Homo sapiens
EPKEPR

SEQ ID NO: 5347 - protein, 6 aa, Homo sapiens
EPKEPR

SEQ ID NO: 5348 - protein, 6 aa, Homo sapiens
EPKEPR

SEQ ID NO: 5349 - protein, 6 aa, Homo sapiens
EPKEPR

SEQ ID NO: 5350 - protein, 6 aa, Homo sapiens
EPKEPR

SEQ ID NO: 5351 - protein, 6 aa, Homo sapiens
EPKEPR

SEQ ID NO: 5352 - protein, 6 aa, Homo sapiens
EPKEPR

SEQ ID NO: 5353 - protein, 6 aa, Homo sapiens
EPKEPR

SEQ ID NO: 5354 - protein, 7 aa, Homo sapiens
TDPLEKR

SEQ ID NO: 5355 - protein, 7 aa, Homo sapiens
TDPLEKR

SEQ ID NO: 5356 - protein, 10 aa, Homo sapiens
SKGKGVGSAR

SEQ ID NO: 5357 - protein, 9 aa, Homo sapiens
MADKILPQR

SEQ ID NO: 5358 - protein, 7 aa, Homo sapiens
KVWDQVK

SEQ ID NO: 5359 - protein, 7 aa, Homo sapiens
KVWDQVK

SEQ ID NO: 5360 - protein, 7 aa, Homo sapiens
TDPLEKR

SEQ ID NO: 5361 - protein, 20 aa, Homo sapiens
VEVDMEKIAAEIAQAEEQAR

SEQ ID NO: 5362 - protein, 8 aa, Homo sapiens
GKGVGSAR

SEQ ID NO: 5363 - protein, 8 aa, Homo sapiens
GKGVGSAR

SEQ ID NO: 5364 - protein, 8 aa, Homo sapiens
GKGVGSAR

SEQ ID NO: 5365 - protein, 10 aa, Homo sapiens
SKGKGVGSAR

SEQ ID NO: 5366 - protein, 16 aa, Homo sapiens
AGGALCHILGAAYKYK

SEQ ID NO: 5367 - protein, 7 aa, Homo sapiens
KASANAR

SEQ ID NO: 5368 - protein, 7 aa, Homo sapiens
KASANAR

SEQ ID NO: 5369 - protein, 7 aa, Homo sapiens
TDPLEKR

SEQ ID NO: 5370 - protein, 7 aa, Homo sapiens
KVQEAAR

SEQ ID NO: 5371 - protein, 6 aa, Homo sapiens
KPVSFR

SEQ ID NO: 5372 - protein, 7 aa, Homo sapiens
TDPLEKR

SEQ ID NO: 5373 - protein, 7 aa, Homo sapiens
TDPLEKR

SEQ ID NO: 5374 - protein, 7 aa, Homo sapiens
TDPLEKR

SEQ ID NO: 5375 - protein, 7 aa, Homo sapiens
TDPLEKR

SEQ ID NO: 5376 - protein, 7 aa, Homo sapiens
TDPLEKR

SEQ ID NO: 5377 - protein, 7 aa, Homo sapiens
TDPLEKR

SEQ ID NO: 5378 - protein, 7 aa, Homo sapiens
KIRDQDR

SEQ ID NO: 5379 - protein, 17 aa, Homo sapiens
KEGLISQDGSSLEALLR

SEQ ID NO: 5380 - protein, 17 aa, Homo sapiens
KEGLISQDGSSLEALLR

SEQ ID NO: 5381 - protein, 16 aa, Homo sapiens
DLKVMTDVAGNPEEER

SEQ ID NO: 5382 - protein, 16 aa, Homo sapiens
DLKVMTDVAGNPEEER

SEQ ID NO: 5383 - protein, 16 aa, Homo sapiens
DLKVMTDVAGNPEEER

SEQ ID NO: 5384 - protein, 17 aa, Homo sapiens
DLKVMTDVAGNPEEERR

SEQ ID NO: 5385 - protein, 16 aa, Homo sapiens
DLKVMTDVAGNPEEER

SEQ ID NO: 5386 - protein, 17 aa, Homo sapiens
DLKVMTDVAGNPEEERR

SEQ ID NO: 5387 - protein, 17 aa, Homo sapiens
DLKVMTDVAGNPEEERR

SEQ ID NO: 5388 - protein, 17 aa, Homo sapiens
DLKVMTDVAGNPEEERR

SEQ ID NO: 5389 - protein, 16 aa, Homo sapiens
DLKVMTDVAGNPEEER

SEQ ID NO: 5390 - protein, 16 aa, Homo sapiens
DLKVMTDVAGNPEEER

SEQ ID NO: 5391 - protein, 10 aa, Homo sapiens
AAKALLAMAR

SEQ ID NO: 5392 - protein, 10 aa, Homo sapiens
AAKALLAMAR

SEQ ID NO: 5393 - protein, 6 aa, Homo sapiens
LEKQQK

SEQ ID NO: 5394 - protein, 10 aa, Homo sapiens
AAKALLAMAR

SEQ ID NO: 5395 - protein, 10 aa, Homo sapiens
AAKALLAMAR

SEQ ID NO: 5396 - protein, 10 aa, Homo sapiens
AAKALLAMAR

SEQ ID NO: 5397 - protein, 10 aa, Homo sapiens
AAKALLAMAR

SEQ ID NO: 5398 - protein, 10 aa, Homo sapiens
AAKALLAMAR

SEQ ID NO: 5399 - protein, 10 aa, Homo sapiens
AAKALLAMAR

SEQ ID NO: 5400 - protein, 10 aa, Homo sapiens
AAKALLAMAR

SEQ ID NO: 5401 - protein, 6 aa, Homo sapiens
RKITSK

SEQ ID NO: 5402 - protein, 5 aa, Homo sapiens
KITSK

SEQ ID NO: 5403 - protein, 5 aa, Homo sapiens
KITSK

SEQ ID NO: 5404 - protein, 4 aa, Homo sapiens
AYKR

SEQ ID NO: 5405 - protein, 4 aa, Homo sapiens
AYKR

SEQ ID NO: 5406 - protein, 7 aa, Homo sapiens
KPLDLFR

SEQ ID NO: 5407 - protein, 10 aa, Homo sapiens
AAKALLAMAR

SEQ ID NO: 5408 - protein, 10 aa, Homo sapiens
AAKALLAMAR

SEQ ID NO: 5409 - protein, 10 aa, Homo sapiens
AAKALLAMAR

SEQ ID NO: 5410 - protein, 10 aa, Homo sapiens
AAKALLAMAR

SEQ ID NO: 5411 - protein, 10 aa, Homo sapiens
AAKALLAMAR

SEQ ID NO: 5412 - protein, 10 aa, Homo sapiens
AAKALLAMAR

SEQ ID NO: 5413 - protein, 10 aa, Homo sapiens
AAKALLAMAR

SEQ ID NO: 5414 - protein, 10 aa, Homo sapiens
AAKALLAMAR

SEQ ID NO: 5415 - protein, 15 aa, Homo sapiens
RDTALETALNAKAYK

SEQ ID NO: 5416 - protein, 15 aa, Homo sapiens
DTALETALNAKAYKR

SEQ ID NO: 5417 - protein, 14 aa, Homo sapiens
DTALETALNAKAYK

SEQ ID NO: 5418 - protein, 15 aa, Homo sapiens
DTALETALNAKAYKR

SEQ ID NO: 5419 - protein, 15 aa, Homo sapiens
DTALETALNAKAYKR

SEQ ID NO: 5420 - protein, 15 aa, Homo sapiens
RDTALETALNAKAYK

SEQ ID NO: 5421 - protein, 14 aa, Homo sapiens
DTALETALNAKAYK

SEQ ID NO: 5422 - protein, 12 aa, Homo sapiens
HMDGMYGPPAKR

SEQ ID NO: 5423 - protein, 10 aa, Homo sapiens
VSYKGSPAAR

SEQ ID NO: 5424 - protein, 6 aa, Homo sapiens
RKITSK

SEQ ID NO: 5425 - protein, 5 aa, Homo sapiens
KITSK

SEQ ID NO: 5426 - protein, 5 aa, Homo sapiens
KITSK

SEQ ID NO: 5427 - protein, 6 aa, Homo sapiens
RKITSK

SEQ ID NO: 5428 - protein, 6 aa, Homo sapiens
RKITSK

SEQ ID NO: 5429 - protein, 6 aa, Homo sapiens
RKITSK

SEQ ID NO: 5430 - protein, 6 aa, Homo sapiens
RKITSK

SEQ ID NO: 5431 - protein, 6 aa, Homo sapiens
RKITSK

SEQ ID NO: 5432 - protein, 5 aa, Homo sapiens
KITSK

SEQ ID NO: 5433 - protein, 14 aa, Homo sapiens
KITSKDIVTPEAWR

SEQ ID NO: 5434 - protein, 14 aa, Homo sapiens
KITSKDIVTPEAWR

SEQ ID NO: 5435 - protein, 13 aa, Homo sapiens
ITSKDIVTPEAWR

SEQ ID NO: 5436 - protein, 14 aa, Homo sapiens
KITSKDIVTPEAWR

SEQ ID NO: 5437 - protein, 14 aa, Homo sapiens
KITSKDIVTPEAWR

SEQ ID NO: 5438 - protein, 13 aa, Homo sapiens
ITSKDIVTPEAWR

SEQ ID NO: 5439 - protein, 14 aa, Homo sapiens
KITSKDIVTPEAWR

SEQ ID NO: 5440 - protein, 10 aa, Homo sapiens
AAKALLAMAR

SEQ ID NO: 5441 - protein, 10 aa, Homo sapiens
AAKALLAMAR

SEQ ID NO: 5442 - protein, 10 aa, Homo sapiens
AAKALLAMAR

SEQ ID NO: 5443 - protein, 12 aa, Homo sapiens
HMDGMYGPPAKR

SEQ ID NO: 5444 - protein, 14 aa, Homo sapiens
KITSKDIVTPEAWR

SEQ ID NO: 5445 - protein, 14 aa, Homo sapiens
KITSKDIVTPEAWR

SEQ ID NO: 5446 - protein, 14 aa, Homo sapiens
KITSKDIVTPEAWR

SEQ ID NO: 5447 - protein, 14 aa, Homo sapiens
KITSKDIVTPEAWR

SEQ ID NO: 5448 - protein, 19 aa, Homo sapiens
KRPAPQQIQQVQQQAVQNR

SEQ ID NO: 5449 - protein, 19 aa, Homo sapiens
KRPAPQQIQQVQQQAVQNR

SEQ ID NO: 5450 - protein, 19 aa, Homo sapiens
KRPAPQQIQQVQQQAVQNR

SEQ ID NO: 5451 - protein, 10 aa, Homo sapiens
RLDIQEALKR

SEQ ID NO: 5452 - protein, 7 aa, Homo sapiens
NHNAKKK

SEQ ID NO: 5453 - protein, 16 aa, Homo sapiens
DLKTMTDVVGNPEEER

SEQ ID NO: 5454 - protein, 17 aa, Homo sapiens
DLKTMTDVVGNPEEERR

SEQ ID NO: 5455 - protein, 17 aa, Homo sapiens
DLKTMTDVVGNPEEERR

SEQ ID NO: 5456 - protein, 17 aa, Homo sapiens
DLKTMTDVVGNPEEERR

SEQ ID NO: 5457 - protein, 17 aa, Homo sapiens
DLKTMTDVVGNPEEERR

SEQ ID NO: 5458 - protein, 16 aa, Homo sapiens
DLKTMTDVVGNPEEER

SEQ ID NO: 5459 - protein, 17 aa, Homo sapiens
DLKTMTDVVGNPEEERR

SEQ ID NO: 5460 - protein, 16 aa, Homo sapiens
DLKTMTDVVGNPEEER

SEQ ID NO: 5461 - protein, 16 aa, Homo sapiens
DLKTMTDVVGNPEEER

SEQ ID NO: 5462 - protein, 16 aa, Homo sapiens
DLKTMTDVVGNPEEER

SEQ ID NO: 5463 - protein, 17 aa, Homo sapiens
DLKTMTDVVGNPEEERR

SEQ ID NO: 5464 - protein, 12 aa, Homo sapiens
LDIQEALKRPIK

SEQ ID NO: 5465 - protein, 8 aa, Homo sapiens
KLDQTIMR

SEQ ID NO: 5466 - protein, 8 aa, Homo sapiens
KLDQTIMR

SEQ ID NO: 5467 - protein, 8 aa, Homo sapiens
KLDQTIMR

SEQ ID NO: 5468 - protein, 8 aa, Homo sapiens
KLDQTIMR

SEQ ID NO: 5469 - protein, 9 aa, Homo sapiens
KLDQTIMRK

SEQ ID NO: 5470 - protein, 8 aa, Homo sapiens
KLDQTIMR

SEQ ID NO: 5471 - protein, 8 aa, Homo sapiens
KLDQTIMR

SEQ ID NO: 5472 - protein, 8 aa, Homo sapiens
KLDQTIMR

SEQ ID NO: 5473 - protein, 8 aa, Homo sapiens
KLDQTIMR

SEQ ID NO: 5474 - protein, 9 aa, Homo sapiens
KLDQTIMRK

SEQ ID NO: 5475 - protein, 9 aa, Homo sapiens
KLDQTIMRK

SEQ ID NO: 5476 - protein, 8 aa, Homo sapiens
KLDQTIMR

SEQ ID NO: 5477 - protein, 9 aa, Homo sapiens
KLDQTIMRK

SEQ ID NO: 5478 - protein, 9 aa, Homo sapiens
KLDQTIMRK

SEQ ID NO: 5479 - protein, 9 aa, Homo sapiens
KLDQTIMRK

SEQ ID NO: 5480 - protein, 8 aa, Homo sapiens
KLDQTIMR

SEQ ID NO: 5481 - protein, 8 aa, Homo sapiens
KLDQTIMR

SEQ ID NO: 5482 - protein, 8 aa, Homo sapiens
KLDQTIMR

SEQ ID NO: 5483 - protein, 19 aa, Homo sapiens
EITFPPGSVEASQPVLKQR

SEQ ID NO: 5484 - protein, 19 aa, Homo sapiens
EITFPPGSVEASQPVLKQR

SEQ ID NO: 5485 - protein, 19 aa, Homo sapiens
EITFPPGSVEASQPVLKQR

SEQ ID NO: 5486 - protein, 19 aa, Homo sapiens
EITFPPGSVEASQPVLKQR

SEQ ID NO: 5487 - protein, 14 aa, Homo sapiens
KITSKDIVTPEAWR

SEQ ID NO: 5488 - protein, 13 aa, Homo sapiens
ITSKDIVTPEAWR

SEQ ID NO: 5489 - protein, 13 aa, Homo sapiens
ITSKDIVTPEAWR

SEQ ID NO: 5490 - protein, 14 aa, Homo sapiens
KITSKDIVTPEAWR

SEQ ID NO: 5491 - protein, 13 aa, Homo sapiens
ITSKDIVTPEAWR

SEQ ID NO: 5492 - protein, 13 aa, Homo sapiens
ITSKDIVTPEAWR

SEQ ID NO: 5493 - protein, 13 aa, Homo sapiens
DDWNKVSEHVGSR

SEQ ID NO: 5494 - protein, 10 aa, Homo sapiens
AKHLAAVEER

SEQ ID NO: 5495 - protein, 10 aa, Homo sapiens
AKHLAAVEER

SEQ ID NO: 5496 - protein, 10 aa, Homo sapiens
AKHLAAVEER

SEQ ID NO: 5497 - protein, 10 aa, Homo sapiens
AKHLAAVEER

SEQ ID NO: 5498 - protein, 7 aa, Homo sapiens
KKEQEGK

SEQ ID NO: 5499 - protein, 7 aa, Homo sapiens
KKEQEGK

SEQ ID NO: 5500 - protein, 10 aa, Homo sapiens
NIKLLEDEPR

SEQ ID NO: 5501 - protein, 10 aa, Homo sapiens
NIKLLEDEPR

SEQ ID NO: 5502 - protein, 7 aa, Homo sapiens
KKEQEGK

SEQ ID NO: 5503 - protein, 9 aa, Homo sapiens
SKAAASATR

SEQ ID NO: 5504 - protein, 9 aa, Homo sapiens
SKAAASATR

SEQ ID NO: 5505 - protein, 9 aa, Homo sapiens
SKAAASATR

SEQ ID NO: 5506 - protein, 12 aa, Homo sapiens
GKGEITPAAIQK

SEQ ID NO: 5507 - protein, 9 aa, Homo sapiens
MADKVLPQR

SEQ ID NO: 5508 - protein, 17 aa, Homo sapiens
DLKIITDVIGNPEEERR

SEQ ID NO: 5509 - protein, 16 aa, Homo sapiens
DLKIITDVIGNPEEER

SEQ ID NO: 5510 - protein, 17 aa, Homo sapiens
DLKIITDVIGNPEEERR

SEQ ID NO: 5511 - protein, 17 aa, Homo sapiens
DLKIITDVIGNPEEERR

SEQ ID NO: 5512 - protein, 16 aa, Homo sapiens
DLKIITDVIGNPEEER

SEQ ID NO: 5513 - protein, 17 aa, Homo sapiens
DLKIITDVIGNPEEERR

SEQ ID NO: 5514 - protein, 17 aa, Homo sapiens
DLKIITDVIGNPEEERR

SEQ ID NO: 5515 - protein, 17 aa, Homo sapiens
DLKIITDVIGNPEEERR

SEQ ID NO: 5516 - protein, 17 aa, Homo sapiens
DLKIITDVIGNPEEERR

SEQ ID NO: 5517 - protein, 17 aa, Homo sapiens
DLKIITDVIGNPEEERR

SEQ ID NO: 5518 - protein, 16 aa, Homo sapiens
DLKIITDVIGNPEEER

SEQ ID NO: 5519 - protein, 17 aa, Homo sapiens
DLKIITDVIGNPEEERR

SEQ ID NO: 5520 - protein, 16 aa, Homo sapiens
DLKIITDVIGNPEEER

SEQ ID NO: 5521 - protein, 16 aa, Homo sapiens
DLKIITDVIGNPEEER

SEQ ID NO: 5522 - protein, 17 aa, Homo sapiens
DLKIITDVIGNPEEERR

SEQ ID NO: 5523 - protein, 17 aa, Homo sapiens
DLKIITDVIGNPEEERR

SEQ ID NO: 5524 - protein, 17 aa, Homo sapiens
DLKIITDVIGNPEEERR

SEQ ID NO: 5525 - protein, 17 aa, Homo sapiens
DLKIITDVIGNPEEERR

SEQ ID NO: 5526 - protein, 17 aa, Homo sapiens
DLKIITDVIGNPEEERR

SEQ ID NO: 5527 - protein, 17 aa, Homo sapiens
DLKIITDVIGNPEEERR

SEQ ID NO: 5528 - protein, 17 aa, Homo sapiens
DLKIITDVIGNPEEERR

SEQ ID NO: 5529 - protein, 17 aa, Homo sapiens
DLKIITDVIGNPEEERR

SEQ ID NO: 5530 - protein, 16 aa, Homo sapiens
DLKIITDVIGNPEEER

SEQ ID NO: 5531 - protein, 17 aa, Homo sapiens
DLKIITDVIGNPEEERR

SEQ ID NO: 5532 - protein, 17 aa, Homo sapiens
DLKIITDVIGNPEEERR

SEQ ID NO: 5533 - protein, 16 aa, Homo sapiens
DLKIITDVIGNPEEER

SEQ ID NO: 5534 - protein, 16 aa, Homo sapiens
DLKIITDVIGNPEEER

SEQ ID NO: 5535 - protein, 16 aa, Homo sapiens
DLKIITDVIGNPEEER

SEQ ID NO: 5536 - protein, 16 aa, Homo sapiens
DLKIITDVIGNPEEER

SEQ ID NO: 5537 - protein, 17 aa, Homo sapiens
DLKIITDVIGNPEEERR

SEQ ID NO: 5538 - protein, 17 aa, Homo sapiens
DLKIITDVIGNPEEERR

SEQ ID NO: 5539 - protein, 17 aa, Homo sapiens
DLKIITDVIGNPEEERR

SEQ ID NO: 5540 - protein, 16 aa, Homo sapiens
DLKIITDVIGNPEEER

SEQ ID NO: 5541 - protein, 16 aa, Homo sapiens
DLKIITDVIGNPEEER

SEQ ID NO: 5542 - protein, 16 aa, Homo sapiens
DLKIITDVIGNPEEER

SEQ ID NO: 5543 - protein, 16 aa, Homo sapiens
DLKIITDVIGNPEEER

SEQ ID NO: 5544 - protein, 17 aa, Homo sapiens
RDLKIITDVIGNPEEER

SEQ ID NO: 5545 - protein, 16 aa, Homo sapiens
DLKIITDVIGNPEEER

SEQ ID NO: 5546 - protein, 16 aa, Homo sapiens
DLKIITDVIGNPEEER

SEQ ID NO: 5547 - protein, 17 aa, Homo sapiens
DLKIITDVIGNPEEERR

SEQ ID NO: 5548 - protein, 17 aa, Homo sapiens
DLKIITDVIGNPEEERR

SEQ ID NO: 5549 - protein, 17 aa, Homo sapiens
DLKIITDVIGNPEEERR

SEQ ID NO: 5550 - protein, 16 aa, Homo sapiens
DLKIITDVIGNPEEER

SEQ ID NO: 5551 - protein, 17 aa, Homo sapiens
RDLKIITDVIGNPEEER

SEQ ID NO: 5552 - protein, 16 aa, Homo sapiens
DLKIITDVIGNPEEER

SEQ ID NO: 5553 - protein, 17 aa, Homo sapiens
DLKIITDVIGNPEEERR

SEQ ID NO: 5554 - protein, 16 aa, Homo sapiens
DLKIITDVIGNPEEER

SEQ ID NO: 5555 - protein, 16 aa, Homo sapiens
DLKIITDVIGNPEEER

SEQ ID NO: 5556 - protein, 17 aa, Homo sapiens
DLKIITDVIGNPEEERR

SEQ ID NO: 5557 - protein, 17 aa, Homo sapiens
DLKIITDVIGNPEEERR

SEQ ID NO: 5558 - protein, 17 aa, Homo sapiens
DLKIITDVIGNPEEERR

SEQ ID NO: 5559 - protein, 16 aa, Homo sapiens
DLKIITDVIGNPEEER

SEQ ID NO: 5560 - protein, 16 aa, Homo sapiens
DLKIITDVIGNPEEER

SEQ ID NO: 5561 - protein, 17 aa, Homo sapiens
DLKIITDVIGNPEEERR

SEQ ID NO: 5562 - protein, 17 aa, Homo sapiens
DLKIITDVIGNPEEERR

SEQ ID NO: 5563 - protein, 9 aa, Homo sapiens
HIFAKVQQR

SEQ ID NO: 5564 - protein, 11 aa, Homo sapiens
YVGDRKNPVCR

SEQ ID NO: 5565 - protein, 11 aa, Homo sapiens
YVGDRKNPVCR

SEQ ID NO: 5566 - protein, 8 aa, Homo sapiens
KLDQTIAR

SEQ ID NO: 5567 - protein, 8 aa, Homo sapiens
KLDQTIAR

SEQ ID NO: 5568 - protein, 8 aa, Homo sapiens
KLDQTIAR

SEQ ID NO: 5569 - protein, 8 aa, Homo sapiens
KLDQTIAR

SEQ ID NO: 5570 - protein, 8 aa, Homo sapiens
KLDQTIAR

SEQ ID NO: 5571 - protein, 8 aa, Homo sapiens
KLDQTIAR

SEQ ID NO: 5572 - protein, 8 aa, Homo sapiens
KLDQTIAR

SEQ ID NO: 5573 - protein, 8 aa, Homo sapiens
KLDQTIAR

SEQ ID NO: 5574 - protein, 8 aa, Homo sapiens
KLDQTIAR

SEQ ID NO: 5575 - protein, 6 aa, Homo sapiens
EQKAKR

SEQ ID NO: 5576 - protein, 10 aa, Homo sapiens
VMAAIEKVRK

SEQ ID NO: 5577 - protein, 10 aa, Homo sapiens
VMAAIEKVRK

SEQ ID NO: 5578 - protein, 7 aa, Homo sapiens
KVQEAAR

SEQ ID NO: 5579 - protein, 7 aa, Homo sapiens
KVQEAAR

SEQ ID NO: 5580 - protein, 7 aa, Homo sapiens
TDIYSKK

SEQ ID NO: 5581 - protein, 7 aa, Homo sapiens
TDIYSKK

SEQ ID NO: 5582 - protein, 6 aa, Homo sapiens
SDKLGR

SEQ ID NO: 5583 - protein, 6 aa, Homo sapiens
SDKLGR

SEQ ID NO: 5584 - protein, 6 aa, Homo sapiens
SDKLGR

SEQ ID NO: 5585 - protein, 12 aa, Homo sapiens
EDEDPAKGDQSR

SEQ ID NO: 5586 - protein, 12 aa, Homo sapiens
EDEDPAKGDQSR

SEQ ID NO: 5587 - protein, 12 aa, Homo sapiens
EDEDPAKGDQSR

SEQ ID NO: 5588 - protein, 6 aa, Homo sapiens
KPLTQK

SEQ ID NO: 5589 - protein, 7 aa, Homo sapiens
KPLTQKR

SEQ ID NO: 5590 - protein, 7 aa, Homo sapiens
KPLTQKR

SEQ ID NO: 5591 - protein, 7 aa, Homo sapiens
KPLTQKR

SEQ ID NO: 5592 - protein, 14 aa, Homo sapiens
QNFHMEQLKYAELR

SEQ ID NO: 5593 - protein, 14 aa, Homo sapiens
QNFHMEQLKYAELR

SEQ ID NO: 5594 - protein, 14 aa, Homo sapiens
QNFHMEQLKYAELR

SEQ ID NO: 5595 - protein, 14 aa, Homo sapiens
QNFHMEQLKYAELR

SEQ ID NO: 5596 - protein, 14 aa, Homo sapiens
QNFHMEQLKYAELR

SEQ ID NO: 5597 - protein, 14 aa, Homo sapiens
QNFHMEQLKYAELR

SEQ ID NO: 5598 - protein, 14 aa, Homo sapiens
QNFHMEQLKYAELR

SEQ ID NO: 5599 - protein, 14 aa, Homo sapiens
QNFHMEQLKYAELR

SEQ ID NO: 5600 - protein, 10 aa, Homo sapiens
KGQASLYGKR

SEQ ID NO: 5601 - protein, 7 aa, Homo sapiens
KVQEAAR

SEQ ID NO: 5602 - protein, 7 aa, Homo sapiens
KVQEAAR

SEQ ID NO: 5603 - protein, 11 aa, Homo sapiens
DPKGYVQDLLR

SEQ ID NO: 5604 - protein, 9 aa, Homo sapiens
DRKASANAR

SEQ ID NO: 5605 - protein, 14 aa, Homo sapiens
QNFHMEQLKYAELR

SEQ ID NO: 5606 - protein, 14 aa, Homo sapiens
QNFHMEQLKYAELR

SEQ ID NO: 5607 - protein, 14 aa, Homo sapiens
QNFHMEQLKYAELR

SEQ ID NO: 5608 - protein, 14 aa, Homo sapiens
QNFHMEQLKYAELR

SEQ ID NO: 5609 - protein, 14 aa, Homo sapiens
QNFHMEQLKYAELR

SEQ ID NO: 5610 - protein, 14 aa, Homo sapiens
QNFHMEQLKYAELR

SEQ ID NO: 5611 - protein, 14 aa, Homo sapiens
QNFHMEQLKYAELR

SEQ ID NO: 5612 - protein, 14 aa, Homo sapiens
QNFHMEQLKYAELR

SEQ ID NO: 5613 - protein, 7 aa, Homo sapiens
KVQEAAR

SEQ ID NO: 5614 - protein, 7 aa, Homo sapiens
KVQEAAR

SEQ ID NO: 5615 - protein, 7 aa, Homo sapiens
KVQEAAR

SEQ ID NO: 5616 - protein, 9 aa, Homo sapiens
YFYSKVQQR

SEQ ID NO: 5617 - protein, 9 aa, Homo sapiens
YFYSKVQQR

SEQ ID NO: 5618 - protein, 14 aa, Homo sapiens
QNFHMEQLKYAELR

SEQ ID NO: 5619 - protein, 14 aa, Homo sapiens
QNFHMEQLKYAELR

SEQ ID NO: 5620 - protein, 14 aa, Homo sapiens
QNFHMEQLKYAELR

SEQ ID NO: 5621 - protein, 14 aa, Homo sapiens
QNFHMEQLKYAELR

SEQ ID NO: 5622 - protein, 14 aa, Homo sapiens
QNFHMEQLKYAELR

SEQ ID NO: 5623 - protein, 14 aa, Homo sapiens
QNFHMEQLKYAELR

SEQ ID NO: 5624 - protein, 14 aa, Homo sapiens
QNFHMEQLKYAELR

SEQ ID NO: 5625 - protein, 14 aa, Homo sapiens
QNFHMEQLKYAELR

SEQ ID NO: 5626 - protein, 14 aa, Homo sapiens
QNFHMEQLKYAELR

SEQ ID NO: 5627 - protein, 14 aa, Homo sapiens
QNFHMEQLKYAELR

SEQ ID NO: 5628 - protein, 14 aa, Homo sapiens
QNFHMEQLKYAELR

SEQ ID NO: 5629 - protein, 14 aa, Homo sapiens
QNFHMEQLKYAELR

SEQ ID NO: 5630 - protein, 14 aa, Homo sapiens
QNFHMEQLKYAELR

SEQ ID NO: 5631 - protein, 14 aa, Homo sapiens
QNFHMEQLKYAELR

SEQ ID NO: 5632 - protein, 14 aa, Homo sapiens
QNFHMEQLKYAELR

SEQ ID NO: 5633 - protein, 14 aa, Homo sapiens
QNFHMEQLKYAELR

SEQ ID NO: 5634 - protein, 14 aa, Homo sapiens
QNFHMEQLKYAELR

SEQ ID NO: 5635 - protein, 14 aa, Homo sapiens
QNFHMEQLKYAELR

SEQ ID NO: 5636 - protein, 14 aa, Homo sapiens
QNFHMEQLKYAELR

SEQ ID NO: 5637 - protein, 14 aa, Homo sapiens
QNFHMEQLKYAELR

SEQ ID NO: 5638 - protein, 14 aa, Homo sapiens
QNFHMEQLKYAELR

SEQ ID NO: 5639 - protein, 14 aa, Homo sapiens
QNFHMEQLKYAELR

SEQ ID NO: 5640 - protein, 14 aa, Homo sapiens
QNFHMEQLKYAELR

SEQ ID NO: 5641 - protein, 14 aa, Homo sapiens
QNFHMEQLKYAELR

SEQ ID NO: 5642 - protein, 14 aa, Homo sapiens
QNFHMEQLKYAELR

SEQ ID NO: 5643 - protein, 14 aa, Homo sapiens
QNFHMEQLKYAELR

SEQ ID NO: 5644 - protein, 4 aa, Homo sapiens
RKLR

SEQ ID NO: 5645 - protein, 10 aa, Homo sapiens
THKLQDPHER

SEQ ID NO: 5646 - protein, 10 aa, Homo sapiens
THKLQDPHER

SEQ ID NO: 5647 - protein, 10 aa, Homo sapiens
THKLQDPHER

SEQ ID NO: 5648 - protein, 10 aa, Homo sapiens
THKLQDPHER

SEQ ID NO: 5649 - protein, 14 aa, Homo sapiens
QNFHMEQLKYAELR

SEQ ID NO: 5650 - protein, 10 aa, Homo sapiens
THKLQDPHER

SEQ ID NO: 5651 - protein, 10 aa, Homo sapiens
THKLQDPHER

SEQ ID NO: 5652 - protein, 10 aa, Homo sapiens
THKLQDPHER

SEQ ID NO: 5653 - protein, 10 aa, Homo sapiens
THKLQDPHER

SEQ ID NO: 5654 - protein, 10 aa, Homo sapiens
THKLQDPHER

SEQ ID NO: 5655 - protein, 10 aa, Homo sapiens
THKLQDPHER

SEQ ID NO: 5656 - protein, 14 aa, Homo sapiens
QNFHMEQLKYAELR

SEQ ID NO: 5657 - protein, 10 aa, Homo sapiens
THKLQDPHER

SEQ ID NO: 5658 - protein, 14 aa, Homo sapiens
QNFHMEQLKYAELR

SEQ ID NO: 5659 - protein, 10 aa, Homo sapiens
THKLQDPHER

SEQ ID NO: 5660 - protein, 10 aa, Homo sapiens
THKLQDPHER

SEQ ID NO: 5661 - protein, 14 aa, Homo sapiens
QNFHMEQLKYAELR

SEQ ID NO: 5662 - protein, 14 aa, Homo sapiens
QNFHMEQLKYAELR

SEQ ID NO: 5663 - protein, 10 aa, Homo sapiens
THKLQDPHER

SEQ ID NO: 5664 - protein, 10 aa, Homo sapiens
THKLQDPHER

SEQ ID NO: 5665 - protein, 10 aa, Homo sapiens
THKLQDPHER

SEQ ID NO: 5666 - protein, 10 aa, Homo sapiens
THKLQDPHER

SEQ ID NO: 5667 - protein, 10 aa, Homo sapiens
THKLQDPHER

SEQ ID NO: 5668 - protein, 10 aa, Homo sapiens
THKLQDPHER

SEQ ID NO: 5669 - protein, 10 aa, Homo sapiens
THKLQDPHER

SEQ ID NO: 5670 - protein, 10 aa, Homo sapiens
THKLQDPHER

SEQ ID NO: 5671 - protein, 10 aa, Homo sapiens
THKLQDPHER

SEQ ID NO: 5672 - protein, 10 aa, Homo sapiens
THKLQDPHER

SEQ ID NO: 5673 - protein, 10 aa, Homo sapiens
THKLQDPHER

SEQ ID NO: 5674 - protein, 7 aa, Homo sapiens
KASANAR

SEQ ID NO: 5675 - protein, 7 aa, Homo sapiens
KASANAR

SEQ ID NO: 5676 - protein, 9 aa, Homo sapiens
MKFSEIPQR

SEQ ID NO: 5677 - protein, 14 aa, Homo sapiens
GKEKPTDMQNFGLR

SEQ ID NO: 5678 - protein, 6 aa, Homo sapiens
TVNTKK

SEQ ID NO: 5679 - protein, 8 aa, Homo sapiens
SKGASAGR

SEQ ID NO: 5680 - protein, 7 aa, Homo sapiens
ESDTGKK

SEQ ID NO: 5681 - protein, 15 aa, Homo sapiens
VASAAAKSALEEFSK

SEQ ID NO: 5682 - protein, 15 aa, Homo sapiens
VASAAAKSALEEFSK

SEQ ID NO: 5683 - protein, 15 aa, Homo sapiens
VASAAAKSALEEFSK

SEQ ID NO: 5684 - protein, 15 aa, Homo sapiens
VASAAAKSALEEFSK

SEQ ID NO: 5685 - protein, 15 aa, Homo sapiens
VASAAAKSALEEFSK

SEQ ID NO: 5686 - protein, 15 aa, Homo sapiens
VASAAAKSALEEFSK

SEQ ID NO: 5687 - protein, 15 aa, Homo sapiens
VASAAAKSALEEFSK

SEQ ID NO: 5688 - protein, 15 aa, Homo sapiens
VASAAAKAALEEFSR

SEQ ID NO: 5689 - protein, 15 aa, Homo sapiens
VASAAAKAALEEFSR

SEQ ID NO: 5690 - protein, 15 aa, Homo sapiens
VASAAAKAALEEFSR

SEQ ID NO: 5691 - protein, 15 aa, Homo sapiens
VASAAAKAALEEFSR

SEQ ID NO: 5692 - protein, 15 aa, Homo sapiens
VASAAAKAALEEFSR

SEQ ID NO: 5693 - protein, 15 aa, Homo sapiens
VASAAAKAALEEFSR

SEQ ID NO: 5694 - protein, 15 aa, Homo sapiens
VASAAAKAALEEFSR

SEQ ID NO: 5695 - protein, 15 aa, Homo sapiens
VASAAAKAALEEFSR

SEQ ID NO: 5696 - protein, 15 aa, Homo sapiens
VASAAAKAALEEFSR

SEQ ID NO: 5697 - protein, 15 aa, Homo sapiens
VASAAAKAALEEFSR

SEQ ID NO: 5698 - protein, 15 aa, Homo sapiens
VASAAAKAALEEFSR

SEQ ID NO: 5699 - protein, 15 aa, Homo sapiens
VASAAAKAALEEFSR

SEQ ID NO: 5700 - protein, 15 aa, Homo sapiens
VASAAAKAALEEFSR

SEQ ID NO: 5701 - protein, 5 aa, Homo sapiens
TKVER

SEQ ID NO: 5702 - protein, 7 aa, Homo sapiens
KVQEAAR

SEQ ID NO: 5703 - protein, 6 aa, Homo sapiens
KTKVER

SEQ ID NO: 5704 - protein, 6 aa, Homo sapiens
KTKVER

SEQ ID NO: 5705 - protein, 7 aa, Homo sapiens
KVQEAAR

SEQ ID NO: 5706 - protein, 7 aa, Homo sapiens
KGGNYKK

SEQ ID NO: 5707 - protein, 7 aa, Homo sapiens
KASANAR

SEQ ID NO: 5708 - protein, 7 aa, Homo sapiens
KASANAR

SEQ ID NO: 5709 - protein, 15 aa, Homo sapiens
KFLESTDSFNNELKR

SEQ ID NO: 5710 - protein, 15 aa, Homo sapiens
KFLESTDSFNNELKR

SEQ ID NO: 5711 - protein, 15 aa, Homo sapiens
KFLESTDSFNNELKR

SEQ ID NO: 5712 - protein, 9 aa, Homo sapiens
EKEALEQQR

SEQ ID NO: 5713 - protein, 15 aa, Homo sapiens
KFLESTDSFNNELKR

SEQ ID NO: 5714 - protein, 15 aa, Homo sapiens
KFLESTDSFNNELKR

SEQ ID NO: 5715 - protein, 15 aa, Homo sapiens
KFLESTDSFNNELKR

SEQ ID NO: 5716 - protein, 15 aa, Homo sapiens
KFLESTDSFNNELKR

SEQ ID NO: 5717 - protein, 15 aa, Homo sapiens
KFLESTDSFNNELKR

SEQ ID NO: 5718 - protein, 15 aa, Homo sapiens
KFLESTDSFNNELKR

SEQ ID NO: 5719 - protein, 14 aa, Homo sapiens
KFLESTDSFNNELK

SEQ ID NO: 5720 - protein, 15 aa, Homo sapiens
KFLESTDSFNNELKR

SEQ ID NO: 5721 - protein, 15 aa, Homo sapiens
KFLESTDSFNNELKR

SEQ ID NO: 5722 - protein, 9 aa, Homo sapiens
EKEALEQQR

SEQ ID NO: 5723 - protein, 15 aa, Homo sapiens
KFLESTDSFNNELKR

SEQ ID NO: 5724 - protein, 15 aa, Homo sapiens
KFLESTDSFNNELKR

SEQ ID NO: 5725 - protein, 15 aa, Homo sapiens
KFLESTDSFNNELKR

SEQ ID NO: 5726 - protein, 15 aa, Homo sapiens
KFLESTDSFNNELKR

SEQ ID NO: 5727 - protein, 15 aa, Homo sapiens
KFLESTDSFNNELKR

SEQ ID NO: 5728 - protein, 15 aa, Homo sapiens
KFLESTDSFNNELKR

SEQ ID NO: 5729 - protein, 15 aa, Homo sapiens
KFLESTDSFNNELKR

SEQ ID NO: 5730 - protein, 15 aa, Homo sapiens
KFLESTDSFNNELKR

SEQ ID NO: 5731 - protein, 14 aa, Homo sapiens
QNFHMEQLKYAELR

SEQ ID NO: 5732 - protein, 14 aa, Homo sapiens
QNFHMEQLKYAELR

SEQ ID NO: 5733 - protein, 14 aa, Homo sapiens
QNFHMEQLKYAELR

SEQ ID NO: 5734 - protein, 6 aa, Homo sapiens
MQVLKR

SEQ ID NO: 5735 - protein, 6 aa, Homo sapiens
MQVLKR

SEQ ID NO: 5736 - protein, 6 aa, Homo sapiens
MQVLKR

SEQ ID NO: 5737 - protein, 6 aa, Homo sapiens
MQVLKR

SEQ ID NO: 5738 - protein, 6 aa, Homo sapiens
MQVLKR

SEQ ID NO: 5739 - protein, 10 aa, Homo sapiens
EKEAAEQAER

SEQ ID NO: 5740 - protein, 6 aa, Homo sapiens
MQVLKR

SEQ ID NO: 5741 - protein, 6 aa, Homo sapiens
MQVLKR

SEQ ID NO: 5742 - protein, 6 aa, Homo sapiens
MQVLKR

SEQ ID NO: 5743 - protein, 6 aa, Homo sapiens
MQVLKR

SEQ ID NO: 5744 - protein, 6 aa, Homo sapiens
MQVLKR

SEQ ID NO: 5745 - protein, 6 aa, Homo sapiens
MQVLKR

SEQ ID NO: 5746 - protein, 6 aa, Homo sapiens
MQVLKR

SEQ ID NO: 5747 - protein, 6 aa, Homo sapiens
MQVLKR

SEQ ID NO: 5748 - protein, 6 aa, Homo sapiens
MQVLKR

SEQ ID NO: 5749 - protein, 6 aa, Homo sapiens
MQVLKR

SEQ ID NO: 5750 - protein, 11 aa, Homo sapiens
IYKWVPVTEPK

SEQ ID NO: 5751 - protein, 7 aa, Homo sapiens
AKDDIKR

SEQ ID NO: 5752 - protein, 7 aa, Homo sapiens
AKDDIKR

SEQ ID NO: 5753 - protein, 7 aa, Homo sapiens
AKDDIKR

SEQ ID NO: 5754 - protein, 7 aa, Homo sapiens
AKDDIKR

SEQ ID NO: 5755 - protein, 7 aa, Homo sapiens
AKDDIKR

SEQ ID NO: 5756 - protein, 7 aa, Homo sapiens
AKDDIKR

SEQ ID NO: 5757 - protein, 7 aa, Homo sapiens
AKDDIKR

SEQ ID NO: 5758 - protein, 6 aa, Homo sapiens
IQKLTK

SEQ ID NO: 5759 - protein, 6 aa, Homo sapiens
IQKLTK

SEQ ID NO: 5760 - protein, 7 aa, Homo sapiens
AKDDIKR

SEQ ID NO: 5761 - protein, 7 aa, Homo sapiens
AKDDIKR

SEQ ID NO: 5762 - protein, 7 aa, Homo sapiens
AKDDIKR

SEQ ID NO: 5763 - protein, 6 aa, Homo sapiens
KGKDEK

SEQ ID NO: 5764 - protein, 9 aa, Homo sapiens
VMAAIEKVR

SEQ ID NO: 5765 - protein, 5 aa, Homo sapiens
LKGGR

SEQ ID NO: 5766 - protein, 9 aa, Homo sapiens
VMAAIEKVR

SEQ ID NO: 5767 - protein, 6 aa, Homo sapiens
KGKDEK

SEQ ID NO: 5768 - protein, 5 aa, Homo sapiens
KWEKK

SEQ ID NO: 5769 - protein, 4 aa, Homo sapiens
KWEK

SEQ ID NO: 5770 - protein, 6 aa, Homo sapiens
IQKLTK

SEQ ID NO: 5771 - protein, 7 aa, Homo sapiens
AKDDIKR

SEQ ID NO: 5772 - protein, 8 aa, Homo sapiens
SVAGKIQK

SEQ ID NO: 5773 - protein, 8 aa, Homo sapiens
SVAGKIQK

SEQ ID NO: 5774 - protein, 7 aa, Homo sapiens
AKDDIKR

SEQ ID NO: 5775 - protein, 7 aa, Homo sapiens
AKDDIKR

SEQ ID NO: 5776 - protein, 7 aa, Homo sapiens
AKDDIKR

SEQ ID NO: 5777 - protein, 7 aa, Homo sapiens
AKDDIKR

SEQ ID NO: 5778 - protein, 7 aa, Homo sapiens
AKDDIKR

SEQ ID NO: 5779 - protein, 6 aa, Homo sapiens
IQKLSK

SEQ ID NO: 5780 - protein, 7 aa, Homo sapiens
AKDDIKR

SEQ ID NO: 5781 - protein, 7 aa, Homo sapiens
AKDDIKR

SEQ ID NO: 5782 - protein, 7 aa, Homo sapiens
AKDDIKR

SEQ ID NO: 5783 - protein, 7 aa, Homo sapiens
AKDDIKR

SEQ ID NO: 5784 - protein, 7 aa, Homo sapiens
AKDDIKR

SEQ ID NO: 5785 - protein, 7 aa, Homo sapiens
AKDDIKR

SEQ ID NO: 5786 - protein, 11 aa, Homo sapiens
KWVTVGDTSLR

SEQ ID NO: 5787 - protein, 11 aa, Homo sapiens
KWVTVGDTSLR

SEQ ID NO: 5788 - protein, 11 aa, Homo sapiens
KWVTVGDTSLR

SEQ ID NO: 5789 - protein, 11 aa, Homo sapiens
KWVTVGDTSLR

SEQ ID NO: 5790 - protein, 11 aa, Homo sapiens
KWVTVGDTSLR

SEQ ID NO: 5791 - protein, 11 aa, Homo sapiens
KWVTVGDTSLR

SEQ ID NO: 5792 - protein, 6 aa, Homo sapiens
EQKAKR

SEQ ID NO: 5793 - protein, 5 aa, Homo sapiens
EQKAK

SEQ ID NO: 5794 - protein, 6 aa, Homo sapiens
EQKAKR

SEQ ID NO: 5795 - protein, 11 aa, Homo sapiens
KWVTVGDTSLR

SEQ ID NO: 5796 - protein, 7 aa, Homo sapiens
AKDDIKR

SEQ ID NO: 5797 - protein, 7 aa, Homo sapiens
AKDDIKR

SEQ ID NO: 5798 - protein, 25 aa, Homo sapiens
KRPGDLNVKCTLLLMLDHQPPQYKL

SEQ ID NO: 5799 - protein, 25 aa, Homo sapiens
KRPGDLNVKCTLLLMLDHQPPQYKL

SEQ ID NO: 5800 - protein, 25 aa, Homo sapiens
KRPGDLNVKCTLLLMLDHQPPQYKL

SEQ ID NO: 5801 - protein, 16 aa, Homo sapiens
RMPTTQETDGFQVKRP

SEQ ID NO: 5802 - protein, 16 aa, Homo sapiens
RMPTTQETDGFQVKRP

SEQ ID NO: 5803 - protein, 16 aa, Homo sapiens
RMPTTQETDGFQVKRP

SEQ ID NO: 5804 - protein, 25 aa, Homo sapiens
KRPGDLNVKCTLLLMLDHQPPQYKL

SEQ ID NO: 5805 - protein, 16 aa, Homo sapiens
RMPTTQETDGFQVKRP

SEQ ID NO: 5806 - protein, 16 aa, Homo sapiens
RMPTTQETDGFQVKRP

SEQ ID NO: 5807 - protein, 16 aa, Homo sapiens
RMPTTQETDGFQVKRP

SEQ ID NO: 5808 - protein, 16 aa, Homo sapiens
RMPTTQETDGFQVKRP

SEQ ID NO: 5809 - protein, 25 aa, Homo sapiens
KRPGDLNVKCTLLLMLDHQPPQYKL

SEQ ID NO: 5810 - protein, 16 aa, Homo sapiens
RMPTTQETDGFQVKRP

SEQ ID NO: 5811 - protein, 16 aa, Homo sapiens
RMPTTQETDGFQVKRP

SEQ ID NO: 5812 - protein, 25 aa, Homo sapiens
KRPGDLNVKCTLLLMLDHQPPQYKL

SEQ ID NO: 5813 - protein, 28 aa, Homo sapiens
KLAGLLQHPDPIVINHVISVDPNDQKKT

SEQ ID NO: 5814 - protein, 28 aa, Homo sapiens
KLAGLLQHPDPIVINHVISVDPNDQKKT

SEQ ID NO: 5815 - protein, 23 aa, Homo sapiens
RMPTTQETDGFQVKRPGDLNVKC

SEQ ID NO: 5816 - protein, 12 aa, Homo sapiens
RKMADKVLPQRI

SEQ ID NO: 5817 - protein, 17 aa, Homo sapiens
KIHETIESINQLKTQRD

SEQ ID NO: 5818 - protein, 11 aa, Homo sapiens
RMEIQEAIKKP

SEQ ID NO: 5819 - protein, 11 aa, Homo sapiens
RMEIQEAIKKP

SEQ ID NO: 5820 - protein, 12 aa, Homo sapiens
KRMEIQEAIKKP

SEQ ID NO: 5821 - protein, 11 aa, Homo sapiens
RMEIQEAIKKP

SEQ ID NO: 5822 - protein, 12 aa, Homo sapiens
KRMEIQEAIKKP

SEQ ID NO: 5823 - protein, 11 aa, Homo sapiens
RMEIQEAIKKP

SEQ ID NO: 5824 - protein, 11 aa, Homo sapiens
RMEIQEAIKKP

SEQ ID NO: 5825 - protein, 11 aa, Homo sapiens
RMEIQEAIKKP

SEQ ID NO: 5826 - protein, 12 aa, Homo sapiens
KRMEIQEAIKKP

SEQ ID NO: 5827 - protein, 5 aa, Homo sapiens
RKLRI

SEQ ID NO: 5828 - protein, 12 aa, Homo sapiens
KRMEIQEAIKKP

SEQ ID NO: 5829 - protein, 11 aa, Homo sapiens
RMEIQEAIKKP

SEQ ID NO: 5830 - protein, 9 aa, Homo sapiens
KKPLTQKRK

SEQ ID NO: 5831 - protein, 40 aa, Homo sapiens
RIYISNTFSPSKAEGDSAGTAGTPGGTPAGDKVASWELRV

SEQ ID NO: 5832 - protein, 40 aa, Homo sapiens; identical to SEQ ID NO: 5831

SEQ ID NO: 5833 - protein, 40 aa, Homo sapiens; identical to SEQ ID NO: 5831

SEQ ID NO: 5834 - protein, 33 aa, Homo sapiens
RIYISNTFSPSKAEGDSAGTAGTPGGTPAGDKV

SEQ ID NO: 5835 - protein, 33 aa, Homo sapiens; identical to SEQ ID NO: 5834

SEQ ID NO: 5836 - protein, 33 aa, Homo sapiens; identical to SEQ ID NO: 5834

SEQ ID NO: 5837 - protein, 33 aa, Homo sapiens; identical to SEQ ID NO: 5834

SEQ ID NO: 5838 - protein, 33 aa, Homo sapiens; identical to SEQ ID NO: 5834

SEQ ID NO: 5839 - protein, 19 aa, Homo sapiens
RDLKIITDVIGNPEEERRA

SEQ ID NO: 5840 - protein, 40 aa, Homo sapiens; identical to SEQ ID NO: 5831

SEQ ID NO: 5841 - protein, 29 aa, Homo sapiens
KAEGDSAGTAGTPGGTPAGDKVASWELRV

SEQ ID NO: 5842 - protein, 40 aa, Homo sapiens; identical to SEQ ID NO: 5831

SEQ ID NO: 5843 - protein, 28 aa, Homo sapiens
KLAGLLQHPDPIVINHVISVDPNDQKKT

SEQ ID NO: 5844 - protein, 28 aa, Homo sapiens
KLAGLLQHPDPIVINHVISVDPNDQKKT

SEQ ID NO: 5845 - protein, 13 aa, Homo sapiens
RVEGKLLDDPSKQ

SEQ ID NO: 5846 - protein, 13 aa, Homo sapiens
RVEGKLLDDPSKQ

SEQ ID NO: 5847 - protein, 12 aa, Homo sapiens
RKRMEIQEAIKK

SEQ ID NO: 5848 - protein, 11 aa, Homo sapiens
RHIFAKVQQRR

SEQ ID NO: 5849 - protein, 33 aa, Homo sapiens; identical to SEQ ID NO: 284

SEQ ID NO: 5850 - protein, 33 aa, Homo sapiens; identical to SEQ ID NO: 284

SEQ ID NO: 5851 - protein, 33 aa, Homo sapiens; identical to SEQ ID NO: 284

SEQ ID NO: 5852 - protein, 17 aa, Homo sapiens
RVASAAAKSALEEFSKM

SEQ ID NO: 5853 - protein, 17 aa, Homo sapiens
RVASAAAKSALEEFSKM

SEQ ID NO: 5854 - protein, 33 aa, Homo sapiens; identical to SEQ ID NO: 284

SEQ ID NO: 5855 - protein, 33 aa, Homo sapiens; identical to SEQ ID NO: 284

SEQ ID NO: 5856 - protein, 15 aa, Homo sapiens
KDDWNKVSEHVGSRT

SEQ ID NO: 5857 - protein, 33 aa, Homo sapiens; identical to SEQ ID NO: 284

SEQ ID NO: 5858 - protein, 33 aa, Homo sapiens; identical to SEQ ID NO: 284

SEQ ID NO: 5859 - protein, 25 aa, Homo sapiens
KDMDEPSPVPNVEEVTLPKTVNTKK

SEQ ID NO: 5860 - protein, 10 aa, Homo sapiens
RLWLGKNYKK

SEQ ID NO: 5861 - protein, 12 aa, Homo sapiens
KAKHLAAVEERK

SEQ ID NO: 5862 - protein, 8 aa, Homo sapiens
RKTKVERD

SEQ ID NO: 5863 - protein, 8 aa, Homo sapiens
RKTKVERD

SEQ ID NO: 5864 - protein, 8 aa, Homo sapiens
RKTKVERD

SEQ ID NO: 5865 - protein, 25 aa, Homo sapiens
RDIGEGNLSTAAAAALAAAAVKAKH

SEQ ID NO: 5866 - protein, 25 aa, Homo sapiens
RDIGEGNLSTAAAAALAAAAVKAKH

SEQ ID NO: 5867 - protein, 25 aa, Homo sapiens
RDIGEGNLSTAAAAALAAAAVKAKH

SEQ ID NO: 5868 - protein, 14 aa, Homo sapiens
KEKPTDMQNFGLRT

SEQ ID NO: 5869 - protein, 14 aa, Homo sapiens
KEKPTDMQNFGLRT

SEQ ID NO: 5870 - protein, 21 aa, Homo sapiens
KTPQQTSASQQMLNFPDKGKE

SEQ ID NO: 5871 - protein, 14 aa, Homo sapiens
KEKPTDMQNFGLRT

SEQ ID NO: 5872 - protein, 14 aa, Homo sapiens
KEKPTDMQNFGLRT

SEQ ID NO: 5873 - protein, 14 aa, Homo sapiens
KEKPTDMQNFGLRT

SEQ ID NO: 5874 - protein, 21 aa, Homo sapiens
KTPQQTSASQQMLNFPDKGKE

SEQ ID NO: 5875 - protein, 14 aa, Homo sapiens
RTDMYTKKNVPSKS

SEQ ID NO: 5876 - protein, 9 aa, Homo sapiens
RKVEEAAKV

SEQ ID NO: 5877 - protein, 17 aa, Homo sapiens
KMKEEVPTALVEAHVRK

SEQ ID NO: 5878 - protein, 11 aa, Homo sapiens
KSKAAASATRE

SEQ ID NO: 5879 - protein, 11 aa, Homo sapiens
KSKAAASATRE

SEQ ID NO: 5880 - protein, 11 aa, Homo sapiens
KSKAAASATRE

SEQ ID NO: 5881 - protein, 11 aa, Homo sapiens
KSKAAASATRE

SEQ ID NO: 5882 - protein, 17 aa, Homo sapiens
RVASAAAKSALEEFSKM

SEQ ID NO: 5883 - protein, 28 aa, Homo sapiens
KTKVERDIGEGNLSTAAAAALAAAAVKA

SEQ ID NO: 5884 - protein, 17 aa, Homo sapiens
RVASAAAKSALEEFSKM

SEQ ID NO: 5885 - protein, 17 aa, Homo sapiens
RVASAAAKSALEEFSKM

SEQ ID NO: 5886 - protein, 17 aa, Homo sapiens
KMKEEVPTALVEAHVRK

SEQ ID NO: 5887 - protein, 17 aa, Homo sapiens
KMKEEVPTALVEAHVRK

SEQ ID NO: 5888 - protein, 17 aa, Homo sapiens
RVASAAAKSALEEFSKM

SEQ ID NO: 5889 - protein, 17 aa, Homo sapiens
KMKEEVPTALVEAHVRK

SEQ ID NO: 5890 - protein, 17 aa, Homo sapiens
RVASAAAKSALEEFSKM

SEQ ID NO: 5891 - protein, 25 aa, Homo sapiens
KSALEEFSKMKEEVPTALVEAHVRK

SEQ ID NO: 5892 - protein, 17 aa, Homo sapiens
KMKEEVPTALVEAHVRK

SEQ ID NO: 5893 - protein, 17 aa, Homo sapiens
RVASAAAKSALEEFSKM

SEQ ID NO: 5894 - protein, 17 aa, Homo sapiens
KMKEEVPTALVEAHVRK

SEQ ID NO: 5895 - protein, 17 aa, Homo sapiens
RVASAAAKSALEEFSKM

SEQ ID NO: 5896 - protein, 17 aa, Homo sapiens
RVASAAAKSALEEFSKM

SEQ ID NO: 5897 - protein, 17 aa, Homo sapiens
RVASAAAKSALEEFSKM

SEQ ID NO: 5898 - protein, 17 aa, Homo sapiens
RVASAAAKSALEEFSKM

SEQ ID NO: 5899 - protein, 17 aa, Homo sapiens
RVASAAAKSALEEFSKM

SEQ ID NO: 5900 - protein, 17 aa, Homo sapiens
RVASAAAKSALEEFSKM

SEQ ID NO: 5901 - protein, 17 aa, Homo sapiens
RVASAAAKSALEEFSKM

SEQ ID NO: 5902 - protein, 17 aa, Homo sapiens
RVASAAAKSALEEFSKM

SEQ ID NO: 5903 - protein, 17 aa, Homo sapiens
RVASAAAKSALEEFSKM

SEQ ID NO: 5904 - protein, 17 aa, Homo sapiens
RVASAAAKSALEEFSKM

SEQ ID NO: 5905 - protein, 17 aa, Homo sapiens
RVASAAAKSALEEFSKM

SEQ ID NO: 5906 - protein, 17 aa, Homo sapiens
RVASAAAKSALEEFSKM

SEQ ID NO: 5907 - protein, 25 aa, Homo sapiens
KSALEEFSKMKEEVPTALVEAHVRK

SEQ ID NO: 5908 - protein, 25 aa, Homo sapiens
KSALEEFSKMKEEVPTALVEAHVRK

SEQ ID NO: 5909 - protein, 25 aa, Homo sapiens
KSALEEFSKMKEEVPTALVEAHVRK

SEQ ID NO: 5910 - protein, 25 aa, Homo sapiens
KSALEEFSKMKEEVPTALVEAHVRK

SEQ ID NO: 5911 - protein, 25 aa, Homo sapiens
KSALEEFSKMKEEVPTALVEAHVRK

SEQ ID NO: 5912 - protein, 25 aa, Homo sapiens
KSALEEFSKMKEEVPTALVEAHVRK

SEQ ID NO: 5913 - protein, 25 aa, Homo sapiens
KSALEEFSKMKEEVPTALVEAHVRK

SEQ ID NO: 5914 - protein, 25 aa, Homo sapiens
KSALEEFSKMKEEVPTALVEAHVRK

SEQ ID NO: 5915 - protein, 25 aa, Homo sapiens
KSALEEFSKMKEEVPTALVEAHVRK

SEQ ID NO: 5916 - protein, 17 aa, Homo sapiens
RVASAAAKSALEEFSKM

SEQ ID NO: 5917 - protein, 17 aa, Homo sapiens
RVASAAAKSALEEFSKM

SEQ ID NO: 5918 - protein, 17 aa, Homo sapiens
RVASAAAKSALEEFSKM

SEQ ID NO: 5919 - protein, 17 aa, Homo sapiens
RVASAAAKSALEEFSKM

SEQ ID NO: 5920 - protein, 17 aa, Homo sapiens
RVASAAAKSALEEFSKM

SEQ ID NO: 5921 - protein, 25 aa, Homo sapiens
KSALEEFSKMKEEVPTALVEAHVRK

SEQ ID NO: 5922 - protein, 17 aa, Homo sapiens
RVASAAAKSALEEFSKM

SEQ ID NO: 5923 - protein, 17 aa, Homo sapiens
RVASAAAKSALEEFSKM

SEQ ID NO: 5924 - protein, 17 aa, Homo sapiens
RVASAAAKSALEEFSKM

SEQ ID NO: 5925 - protein, 17 aa, Homo sapiens
RVASAAAKSALEEFSKM

SEQ ID NO: 5926 - protein, 17 aa, Homo sapiens
RVASAAAKSALEEFSKM

SEQ ID NO: 5927 - protein, 17 aa, Homo sapiens
RVASAAAKSALEEFSKM

SEQ ID NO: 5928 - protein, 14 aa, Homo sapiens
KEKPTDMQNFGLRT

SEQ ID NO: 5929 - protein, 14 aa, Homo sapiens
KEKPTDMQNFGLRT

SEQ ID NO: 5930 - protein, 14 aa, Homo sapiens
KEKPTDMQNFGLRT

SEQ ID NO: 5931 - protein, 22 aa, Homo sapiens
KEPKEGQEEVLKEVVESEGERK

SEQ ID NO: 5932 - protein, 22 aa, Homo sapiens
KEPKEGQEEVLKEVVESEGERK

SEQ ID NO: 5933 - protein, 19 aa, Homo sapiens
KEGQEEVLKEVVESEGERK

SEQ ID NO: 5934 - protein, 12 aa, Homo sapiens
KAKHLAAVEERK

SEQ ID NO: 5935 - protein, 12 aa, Homo sapiens
KAKHLAAVEERK

SEQ ID NO: 5936 - protein, 12 aa, Homo sapiens
KAKHLAAVEERK

SEQ ID NO: 5937 - protein, 12 aa, Homo sapiens
KAKHLAAVEERK

SEQ ID NO: 5938 - protein, 17 aa, Homo sapiens
RKIKSLVALLVETQMKK

SEQ ID NO: 5939 - protein, 12 aa, Homo sapiens
KAKHLAAVEERK

SEQ ID NO: 5940 - protein, 12 aa, Homo sapiens
KAKHLAAVEERK

SEQ ID NO: 5941 - protein, 12 aa, Homo sapiens
KAKHLAAVEERK

SEQ ID NO: 5942 - protein, 12 aa, Homo sapiens
KAKHLAAVEERK

SEQ ID NO: 5943 - protein, 12 aa, Homo sapiens
KAKHLAAVEERK

SEQ ID NO: 5944 - protein, 12 aa, Homo sapiens
KAKHLAAVEERK

SEQ ID NO: 5945 - protein, 12 aa, Homo sapiens
KAKHLAAVEERK

SEQ ID NO: 5946 - protein, 12 aa, Homo sapiens
KAKHLAAVEERK

SEQ ID NO: 5947 - protein, 17 aa, Homo sapiens
RKIKSLVALLVETQMKK

SEQ ID NO: 5948 - protein, 12 aa, Homo sapiens
KAKHLAAVEERK

SEQ ID NO: 5949 - protein, 12 aa, Homo sapiens
KAKHLAAVEERK

SEQ ID NO: 5950 - protein, 17 aa, Homo sapiens
RKIKSLVALLVETQMKK

SEQ ID NO: 5951 - protein, 12 aa, Homo sapiens
KAKHLAAVEERK

SEQ ID NO: 5952 - protein, 17 aa, Homo sapiens
RKIKSLVALLVETQMKK

SEQ ID NO: 5953 - protein, 12 aa, Homo sapiens
KAKHLAAVEERK

SEQ ID NO: 5954 - protein, 12 aa, Homo sapiens
KAKHLAAVEERK

SEQ ID NO: 5955 - protein, 12 aa, Homo sapiens
KAKHLAAVEERK

SEQ ID NO: 5956 - protein, 12 aa, Homo sapiens
KAKHLAAVEERK

SEQ ID NO: 5957 - protein, 12 aa, Homo sapiens
KAKHLAAVEERK

SEQ ID NO: 5958 - protein, 12 aa, Homo sapiens
KAKHLAAVEERK

SEQ ID NO: 5959 - protein, 17 aa, Homo sapiens
RKIKSLVALLVETQMKK

SEQ ID NO: 5960 - protein, 12 aa, Homo sapiens
KAKHLAAVEERK

SEQ ID NO: 5961 - protein, 11 aa, Homo sapiens
RKKDGGPNVKY

SEQ ID NO: 5962 - protein, 11 aa, Homo sapiens
KKDSESAPVKG

SEQ ID NO: 5963 - protein, 9 aa, Homo sapiens
RTDMYTKKN

SEQ ID NO: 5964 - protein, 9 aa, Homo sapiens
RTDMYTKKN

SEQ ID NO: 5965 - protein, 11 aa, Homo sapiens
KSKAAASATRE

SEQ ID NO: 5966 - protein, 9 aa, Homo sapiens
RTDMYTKKN

SEQ ID NO: 5967 - protein, 9 aa, Homo sapiens
RTDMYTKKN

SEQ ID NO: 5968 - protein, 11 aa, Homo sapiens
KSKAAASATRE

SEQ ID NO: 5969 - protein, 11 aa, Homo sapiens
KSKAAASATRE

SEQ ID NO: 5970 - protein, 11 aa, Homo sapiens
KSKAAASATRE

SEQ ID NO: 5971 - protein, 11 aa, Homo sapiens
KSKAAASATRE

SEQ ID NO: 5972 - protein, 11 aa, Homo sapiens
KSKAAASATRE

SEQ ID NO: 5973 - protein, 11 aa, Homo sapiens
KSKAAASATRE

SEQ ID NO: 5974 - protein, 11 aa, Homo sapiens
KSKAAASATRE

SEQ ID NO: 5975 - protein, 11 aa, Homo sapiens
KSKAAASATRE

SEQ ID NO: 5976 - protein, 11 aa, Homo sapiens
KSKAAASATRE

SEQ ID NO: 5977 - protein, 11 aa, Homo sapiens
KSKAAASATRE

SEQ ID NO: 5978 - protein, 12 aa, Homo sapiens
RVEGQATDEKKE

SEQ ID NO: 5979 - protein, 12 aa, Homo sapiens
RVEGQATDEKKE

SEQ ID NO: 5980 - protein, 12 aa, Homo sapiens
RVEGQATDEKKE

SEQ ID NO: 5981 - protein, 12 aa, Homo sapiens
RVEGQATDEKKE

SEQ ID NO: 5982 - protein, 8 aa, Homo sapiens
KEPKEPRE

SEQ ID NO: 5983 - protein, 17 aa, Homo sapiens
KMKEEVPTALVEAHVRK

SEQ ID NO: 5984 - protein, 17 aa, Homo sapiens
KMKEEVPTALVEAHVRK

SEQ ID NO: 5985 - protein, 11 aa, Homo sapiens
KSKAAASATRE

SEQ ID NO: 5986 - protein, 11 aa, Homo sapiens
KSKAAASATRE

SEQ ID NO: 5987 - protein, 11 aa, Homo sapiens
KSKAAASATRE

SEQ ID NO: 5988 - protein, 11 aa, Homo sapiens
KSKAAASATRE

SEQ ID NO: 5989 - protein, 11 aa, Homo sapiens
KSKAAASATRE

SEQ ID NO: 5990 - protein, 30 aa, Homo sapiens
KSLSSLVVQLLQFQEEVFGKHVSNAPLTKL

SEQ ID NO: 5991 - protein, 30 aa, Homo sapiens; identical to SEQ ID NO: 5990

SEQ ID NO: 5992 - protein, 30 aa, Homo sapiens; identical to SEQ ID NO: 5990

SEQ ID NO: 5993 - protein, 30 aa, Homo sapiens; identical to SEQ ID NO: 5990

SEQ ID NO: 5994 - protein, 30 aa, Homo sapiens; identical to SEQ ID NO: 5990

SEQ ID NO: 5995 - protein, 32 aa, Homo sapiens
RGHREEEQEDLTKDMDEPSPVPNVEEVTLPKT

SEQ ID NO: 5996 - protein, 16 aa, Homo sapiens
KTVNTKKDSESAPVKG

SEQ ID NO: 5997 - protein, 32 aa, Homo sapiens; identical to SEQ ID NO: 5995

SEQ ID NO: 5998 - protein, 16 aa, Homo sapiens
KTVNTKKDSESAPVKG

SEQ ID NO: 5999 - protein, 32 aa, Homo sapiens; identical to SEQ ID NO: 5995

SEQ ID NO: 6000 - protein, 32 aa, Homo sapiens; identical to SEQ ID NO: 5995

SEQ ID NO: 6001 - protein, 16 aa, Homo sapiens
KTVNTKKDSESAPVKG

SEQ ID NO: 6002 - protein, 32 aa, Homo sapiens; identical to SEQ ID NO: 5995

SEQ ID NO: 6003 - protein, 32 aa, Homo sapiens; identical to SEQ ID NO: 5995

SEQ ID NO: 6004 - protein, 21 aa, Homo sapiens
REGGGAIEEEAKEKTSEAPKK

SEQ ID NO: 6005 - protein, 21 aa, Homo sapiens
REGGGAIEEEAKEKTSEAPKK

SEQ ID NO: 6006 - protein, 10 aa, Homo sapiens
KEKTSEAPKK

SEQ ID NO: 6007 - protein, 19 aa, Homo sapiens
KEGQEEVLKEVVESEGERK

SEQ ID NO: 6008 - protein, 9 aa, Homo sapiens
KNVPSKSKA

SEQ ID NO: 6009 - protein, 8 aa, Homo sapiens
RKTKVERD

SEQ ID NO: 6010 - protein, 19 aa, Homo sapiens
KESEKSDGDPIVDPEKEKE

SEQ ID NO: 6011 - protein, 19 aa, Homo sapiens
KESEKSDGDPIVDPEKEKE

SEQ ID NO: 6012 - protein, 19 aa, Homo sapiens
KESEKSDGDPIVDPEKEKE

SEQ ID NO: 6013 - protein, 30 aa, Homo sapiens
KWILDTDTFNEWMNEEDYEVNDDKNPVSRR

SEQ ID NO: 6014 - protein, 30 aa, Homo sapiens; identical to SEQ ID NO: 6013

SEQ ID NO: 6015 - protein, 30 aa, Homo sapiens; identical to SEQ ID NO: 6013

SEQ ID NO: 6016 - protein, 30 aa, Homo sapiens; identical to SEQ ID NO: 6013

SEQ ID NO: 6017 - protein, 19 aa, Homo sapiens
KEGQEEVLKEVVESEGERK

SEQ ID NO: 6018 - protein, 8 aa, Homo sapiens
RKTKVERD

SEQ ID NO: 6019 - protein, 8 aa, Homo sapiens
RKTKVERD

SEQ ID NO: 6020 - protein, 8 aa, Homo sapiens
RKTKVERD

SEQ ID NO: 6021 - protein, 19 aa, Homo sapiens
KEGQEEVLKEVVESEGERK

SEQ ID NO: 6022 - protein, 8 aa, Homo sapiens
RKTKVERD

SEQ ID NO: 6023 - protein, 19 aa, Homo sapiens
KEGQEEVLKEVVESEGERK

SEQ ID NO: 6024 - protein, 19 aa, Homo sapiens
KEGQEEVLKEVVESEGERK

SEQ ID NO: 6025 - protein, 8 aa, Homo sapiens
RKTKVERD

SEQ ID NO: 6026 - protein, 19 aa, Homo sapiens
KEGQEEVLKEVVESEGERK

SEQ ID NO: 6027 - protein, 19 aa, Homo sapiens
KEGQEEVLKEVVESEGERK

SEQ ID NO: 6028 - protein, 19 aa, Homo sapiens
KEGQEEVLKEVVESEGERK

SEQ ID NO: 6029 - protein, 8 aa, Homo sapiens
RKTKVERD

SEQ ID NO: 6030 - protein, 8 aa, Homo sapiens
RKTKVERD

SEQ ID NO: 6031 - protein, 19 aa, Homo sapiens
KEGQEEVLKEVVESEGERK

SEQ ID NO: 6032 - protein, 19 aa, Homo sapiens
KEGQEEVLKEVVESEGERK

SEQ ID NO: 6033 - protein, 7 aa, Homo sapiens
KTKVERD

SEQ ID NO: 6034 - protein, 19 aa, Homo sapiens
KEGQEEVLKEVVESEGERK

SEQ ID NO: 6035 - protein, 19 aa, Homo sapiens
KEGQEEVLKEVVESEGERK

SEQ ID NO: 6036 - protein, 19 aa, Homo sapiens
KEGQEEVLKEVVESEGERK

SEQ ID NO: 6037 - protein, 8 aa, Homo sapiens
RKTKVERD

SEQ ID NO: 6038 - protein, 19 aa, Homo sapiens
KEGQEEVLKEVVESEGERK

SEQ ID NO: 6039 - protein, 19 aa, Homo sapiens
KEGQEEVLKEVVESEGERK

SEQ ID NO: 6040 - protein, 19 aa, Homo sapiens
KEGQEEVLKEVVESEGERK

SEQ ID NO: 6041 - protein, 19 aa, Homo sapiens
KEGQEEVLKEVVESEGERK

SEQ ID NO: 6042 - protein, 19 aa, Homo sapiens
KEGQEEVLKEVVESEGERK

SEQ ID NO: 6043 - protein, 8 aa, Homo sapiens
RKTKVERD

SEQ ID NO: 6044 - protein, 8 aa, Homo sapiens
RKTKVERD

SEQ ID NO: 6045 - protein, 8 aa, Homo sapiens
RKTKVERD

SEQ ID NO: 6046 - protein, 8 aa, Homo sapiens
RKTKVERD

SEQ ID NO: 6047 - protein, 13 aa, Homo sapiens
RKVEEAAKVTGKA

SEQ ID NO: 6048 - protein, 13 aa, Homo sapiens
RKVEEAAKVTGKA

SEQ ID NO: 6049 - protein, 8 aa, Homo sapiens
RKTKVERD

SEQ ID NO: 6050 - protein, 8 aa, Homo sapiens
RKTKVERD

SEQ ID NO: 6051 - protein, 13 aa, Homo sapiens
RKVEEAAKVTGKA

SEQ ID NO: 6052 - protein, 8 aa, Homo sapiens
RKTKVERD

SEQ ID NO: 6053 - protein, 8 aa, Homo sapiens
RKTKVERD

SEQ ID NO: 6054 - protein, 8 aa, Homo sapiens
RKTKVERD

SEQ ID NO: 6055 - protein, 13 aa, Homo sapiens
RKVEEAAKVTGKA

SEQ ID NO: 6056 - protein, 13 aa, Homo sapiens
RKVEEAAKVTGKA

SEQ ID NO: 6057 - protein, 13 aa, Homo sapiens
RKVEEAAKVTGKA

SEQ ID NO: 6058 - protein, 13 aa, Homo sapiens
RKVEEAAKVTGKA

SEQ ID NO: 6059 - protein, 13 aa, Homo sapiens
RKVEEAAKVTGKA

SEQ ID NO: 6060 - protein, 12 aa, Homo sapiens
KVEEAAKVTGKA

SEQ ID NO: 6061 - protein, 8 aa, Homo sapiens
RKTKVERD

SEQ ID NO: 6062 - protein, 15 aa, Homo sapiens
RVEGQATDEKKEPKE

SEQ ID NO: 6063 - protein, 8 aa, Homo sapiens
RKTKVERD

SEQ ID NO: 6064 - protein, 8 aa, Homo sapiens
RKTKVERD

SEQ ID NO: 6065 - protein, 8 aa, Homo sapiens
RKTKVERD

SEQ ID NO: 6066 - protein, 13 aa, Homo sapiens
RKVEEAAKVTGKA

SEQ ID NO: 6067 - protein, 8 aa, Homo sapiens
RKTKVERD

SEQ ID NO: 6068 - protein, 13 aa, Homo sapiens
RKVEEAAKVTGKA

SEQ ID NO: 6069 - protein, 13 aa, Homo sapiens
RKVEEAAKVTGKA

SEQ ID NO: 6070 - protein, 7 aa, Homo sapiens
KTKVERD

SEQ ID NO: 6071 - protein, 13 aa, Homo sapiens
RKVEEAAKVTGKA

SEQ ID NO: 6072 - protein, 13 aa, Homo sapiens
RKVEEAAKVTGKA

SEQ ID NO: 6073 - protein, 8 aa, Homo sapiens
RKTKVERD

SEQ ID NO: 6074 - protein, 8 aa, Homo sapiens
RKTKVERD

SEQ ID NO: 6075 - protein, 8 aa, Homo sapiens
RKTKVERD

SEQ ID NO: 6076 - protein, 8 aa, Homo sapiens
RKTKVERD

SEQ ID NO: 6077 - protein, 8 aa, Homo sapiens
RKTKVERD

SEQ ID NO: 6078 - protein, 12 aa, Homo sapiens
KAKHLAAVEERK

SEQ ID NO: 6079 - protein, 12 aa, Homo sapiens
KAKHLAAVEERK

SEQ ID NO: 6080 - protein, 12 aa, Homo sapiens
KAKHLAAVEERK

SEQ ID NO: 6081 - protein, 8 aa, Homo sapiens
KKGGNYKK

SEQ ID NO: 6082 - protein, 20 aa, Homo sapiens
KISAKTLTDEVNSPDSDRRD

SEQ ID NO: 6083 - protein, 20 aa, Homo sapiens
KISAKTLTDEVNSPDSDRRD

SEQ ID NO: 6084 - protein, 20 aa, Homo sapiens
KISAKTLTDEVNSPDSDRRD

SEQ ID NO: 6085 - protein, 9 aa, Homo sapiens
KGGNYKKRK

SEQ ID NO: 6086 - protein, 9 aa, Homo sapiens
KGGNYKKRK

SEQ ID NO: 6087 - protein, 20 aa, Homo sapiens
KISAKTLTDEVNSPDSDRRD

SEQ ID NO: 6088 - protein, 20 aa, Homo sapiens
KISAKTLTDEVNSPDSDRRD

SEQ ID NO: 6089 - protein, 20 aa, Homo sapiens
KISAKTLTDEVNSPDSDRRD

SEQ ID NO: 6090 - protein, 11 aa, Homo sapiens
RKKDGGPNVKY

SEQ ID NO: 6091 - protein, 20 aa, Homo sapiens
KISAKTLTDEVNSPDSDRRD

SEQ ID NO: 6092 - protein, 20 aa, Homo sapiens
KISAKTLTDEVNSPDSDRRD

SEQ ID NO: 6093 - protein, 20 aa, Homo sapiens
KISAKTLTDEVNSPDSDRRD

SEQ ID NO: 6094 - protein, 20 aa, Homo sapiens
KISAKTLTDEVNSPDSDRRD

SEQ ID NO: 6095 - protein, 20 aa, Homo sapiens
KISAKTLTDEVNSPDSDRRD

SEQ ID NO: 6096 - protein, 7 aa, Homo sapiens
RKVHAKW

SEQ ID NO: 6097 - protein, 36 aa, Homo sapiens
RHQGTVTEDKNNASHVVYPVPGNLEEEEWVRPVMKR

SEQ ID NO: 6098 - protein, 36 aa, Homo sapiens; identical to SEQ ID NO: 6097

SEQ ID NO: 6099 - protein, 36 aa, Homo sapiens; identical to SEQ ID NO: 6097

SEQ ID NO: 6100 - protein, 36 aa, Homo sapiens; identical to SEQ ID NO: 6097

SEQ ID NO: 6101 - protein, 36 aa, Homo sapiens; identical to SEQ ID NO: 6097

SEQ ID NO: 6102 - protein, 17 aa, Homo sapiens
KMKEEVPTALVEAHVRK

SEQ ID NO: 6103 - protein, 25 aa, Homo sapiens
KSALEEFSKMKEEVPTALVEAHVRK

SEQ ID NO: 6104 - protein, 7 aa, Homo sapiens
KTKVERD

SEQ ID NO: 6105 - protein, 25 aa, Homo sapiens
KSALEEFSKMKEEVPTALVEAHVRK

SEQ ID NO: 6106 - protein, 12 aa, Homo sapiens
KAKHLAAVEERK

SEQ ID NO: 6107 - protein, 25 aa, Homo sapiens
KSALEEFSKMKEEVPTALVEAHVRK

SEQ ID NO: 6108 - protein, 25 aa, Homo sapiens
KSALEEFSKMKEEVPTALVEAHVRK

SEQ ID NO: 6109 - protein, 25 aa, Homo sapiens
KSALEEFSKMKEEVPTALVEAHVRK

SEQ ID NO: 6110 - protein, 25 aa, Homo sapiens
KSALEEFSKMKEEVPTALVEAHVRK

SEQ ID NO: 6111 - protein, 25 aa, Homo sapiens
KSALEEFSKMKEEVPTALVEAHVRK

SEQ ID NO: 6112 - protein, 28 aa, Homo sapiens
KSLVQNNCLSRPNIFLCPEIEPKLLGKL

SEQ ID NO: 6113 - protein, 28 aa, Homo sapiens
KSLVQNNCLSRPNIFLCPEIEPKLLGKL

SEQ ID NO: 6114 - protein, 28 aa, Homo sapiens
KSLVQNNCLSRPNIFLCPEIEPKLLGKL

SEQ ID NO: 6115 - protein, 9 aa, Homo sapiens
KLKDIIKRH

SEQ ID NO: 6116 - protein, 28 aa, Homo sapiens
KSLVQNNCLSRPNIFLCPEIEPKLLGKL

SEQ ID NO: 6117 - protein, 18 aa, Homo sapiens
RPNIFLCPEIEPKLLGKL

SEQ ID NO: 6118 - protein, 28 aa, Homo sapiens
KSLVQNNCLSRPNIFLCPEIEPKLLGKL

SEQ ID NO: 6119 - protein, 18 aa, Homo sapiens
RPNIFLCPEIEPKLLGKL

SEQ ID NO: 6120 - protein, 28 aa, Homo sapiens
KSLVQNNCLSRPNIFLCPEIEPKLLGKL

SEQ ID NO: 6121 - protein, 30 aa, Homo sapiens; identical to SEQ ID NO: 5990

SEQ ID NO: 6122 - protein, 30 aa, Homo sapiens; identical to SEQ ID NO: 5990

SEQ ID NO: 6123 - protein, 30 aa, Homo sapiens; identical to SEQ ID NO: 5990

SEQ ID NO: 6124 - protein, 30 aa, Homo sapiens; identical to SEQ ID NO: 5990

SEQ ID NO: 6125 - protein, 30 aa, Homo sapiens; identical to SEQ ID NO: 5990

SEQ ID NO: 6126 - protein, 11 aa, Homo sapiens
RKKDGGPNVKY

SEQ ID NO: 6127 - protein, 30 aa, Homo sapiens; identical to SEQ ID NO: 5990

SEQ ID NO: 6128 - protein, 14 aa, Homo sapiens
KDEEKGKEGDSEKE

SEQ ID NO: 6129 - protein, 9 aa, Homo sapiens
KTSEAPKKD

SEQ ID NO: 6130 - protein, 10 aa, Homo sapiens
KFKSDQGWRR

SEQ ID NO: 6131 - protein, 10 aa, Homo sapiens
KFKSDQGWRR

SEQ ID NO: 6132 - protein, 38 aa, Homo sapiens
KVTGKADPAFGLESSGIAGTTSDEPERIEESGNDEARV

SEQ ID NO: 6133 - protein, 38 aa, Homo sapiens; identical to SEQ ID NO: 6132

SEQ ID NO: 6134 - protein, 38 aa, Homo sapiens; identical to SEQ ID NO: 6132

SEQ ID NO: 6135 - protein, 38 aa, Homo sapiens; identical to SEQ ID NO: 6132

SEQ ID NO: 6136 - protein, 38 aa, Homo sapiens; identical to SEQ ID NO: 6132

SEQ ID NO: 6137 - protein, 38 aa, Homo sapiens; identical to SEQ ID NO: 6132

SEQ ID NO: 6138 - protein, 38 aa, Homo sapiens; identical to SEQ ID NO: 6132

SEQ ID NO: 6139 - protein, 38 aa, Homo sapiens; identical to SEQ ID NO: 6132

SEQ ID NO: 6140 - protein, 38 aa, Homo sapiens; identical to SEQ ID NO: 6132

SEQ ID NO: 6141 - protein, 7 aa, Homo sapiens
KTKVERD

SEQ ID NO: 6142 - protein, 38 aa, Homo sapiens; identical to SEQ ID NO: 6132

SEQ ID NO: 6143 - protein, 28 aa, Homo sapiens
KVTGKADPAFGLESSGIAGTTSDEPERI

SEQ ID NO: 6144 - protein, 38 aa, Homo sapiens; identical to SEQ ID NO: 6132

SEQ ID NO: 6145 - protein, 38 aa, Homo sapiens; identical to SEQ ID NO: 6132

SEQ ID NO: 6146 - protein, 18 aa, Homo sapiens
KAGGSLCHILAAAYKFKS

SEQ ID NO: 6147 - protein, 18 aa, Homo sapiens
KAGGSLCHILAAAYKFKS

SEQ ID NO: 6148 - protein, 17 aa, Homo sapiens
KMKEEVPTALVEAHVRK

SEQ ID NO: 6149 - protein, 17 aa, Homo sapiens
KMKEEVPTALVEAHVRK

SEQ ID NO: 6150 - protein, 17 aa, Homo sapiens
KMKEEVPTALVEAHVRK

SEQ ID NO: 6151 - protein, 17 aa, Homo sapiens
KMKEEVPTALVEAHVRK

SEQ ID NO: 6152 - protein, 7 aa, Homo sapiens
KTKVERD

SEQ ID NO: 6153 - protein, 17 aa, Homo sapiens
KMKEEVPTALVEAHVRK

SEQ ID NO: 6154 - protein, 17 aa, Homo sapiens
KMKEEVPTALVEAHVRK

SEQ ID NO: 6155 - protein, 17 aa, Homo sapiens
KMKEEVPTALVEAHVRK

SEQ ID NO: 6156 - protein, 17 aa, Homo sapiens
KMKEEVPTALVEAHVRK

SEQ ID NO: 6157 - protein, 17 aa, Homo sapiens
KMKEEVPTALVEAHVRK

SEQ ID NO: 6158 - protein, 17 aa, Homo sapiens
KMKEEVPTALVEAHVRK

SEQ ID NO: 6159 - protein, 12 aa, Homo sapiens
KAKHLAAVEERK

SEQ ID NO: 6160 - protein, 17 aa, Homo sapiens
KMKEEVPTALVEAHVRK

SEQ ID NO: 6161 - protein, 12 aa, Homo sapiens
KAKHLAAVEERK

SEQ ID NO: 6162 - protein, 17 aa, Homo sapiens
KMKEEVPTALVEAHVRK

SEQ ID NO: 6163 - protein, 17 aa, Homo sapiens
KMKEEVPTALVEAHVRK

SEQ ID NO: 6164 - protein, 17 aa, Homo sapiens
KMKEEVPTALVEAHVRK

SEQ ID NO: 6165 - protein, 12 aa, Homo sapiens
KAKHLAAVEERK

SEQ ID NO: 6166 - protein, 17 aa, Homo sapiens
KMKEEVPTALVEAHVRK

SEQ ID NO: 6167 - protein, 12 aa, Homo sapiens
KAKHLAAVEERK

SEQ ID NO: 6168 - protein, 17 aa, Homo sapiens
KMKEEVPTALVEAHVRK

SEQ ID NO: 6169 - protein, 17 aa, Homo sapiens
KMKEEVPTALVEAHVRK

SEQ ID NO: 6170 - protein, 12 aa, Homo sapiens
KAKHLAAVEERK

SEQ ID NO: 6171 - protein, 12 aa, Homo sapiens
KAKHLAAVEERK

SEQ ID NO: 6172 - protein, 17 aa, Homo sapiens
KMKEEVPTALVEAHVRK

SEQ ID NO: 6173 - protein, 17 aa, Homo sapiens
KMKEEVPTALVEAHVRK

SEQ ID NO: 6174 - protein, 17 aa, Homo sapiens
KMKEEVPTALVEAHVRK

SEQ ID NO: 6175 - protein, 17 aa, Homo sapiens
KMKEEVPTALVEAHVRK

SEQ ID NO: 6176 - protein, 8 aa, Homo sapiens
RKTKVERD

SEQ ID NO: 6177 - protein, 17 aa, Homo sapiens
KMKEEVPTALVEAHVRK

SEQ ID NO: 6178 - protein, 17 aa, Homo sapiens
KMKEEVPTALVEAHVRK

SEQ ID NO: 6179 - protein, 17 aa, Homo sapiens
KMKEEVPTALVEAHVRK

SEQ ID NO: 6180 - protein, 17 aa, Homo sapiens
KMKEEVPTALVEAHVRK

SEQ ID NO: 6181 - protein, 17 aa, Homo sapiens
KMKEEVPTALVEAHVRK

SEQ ID NO: 6182 - protein, 17 aa, Homo sapiens
KMKEEVPTALVEAHVRK

SEQ ID NO: 6183 - protein, 17 aa, Homo sapiens
KMKEEVPTALVEAHVRK

SEQ ID NO: 6184 - protein, 17 aa, Homo sapiens
KMKEEVPTALVEAHVRK

SEQ ID NO: 6185 - protein, 17 aa, Homo sapiens
KMKEEVPTALVEAHVRK

SEQ ID NO: 6186 - protein, 13 aa, Homo sapiens
RKVEEAAKVTGKA

SEQ ID NO: 6187 - protein, 13 aa, Homo sapiens
RKVEEAAKVTGKA

SEQ ID NO: 6188 - protein, 17 aa, Homo sapiens
KMKEEVPTALVEAHVRK

SEQ ID NO: 6189 - protein, 17 aa, Homo sapiens
KMKEEVPTALVEAHVRK

SEQ ID NO: 6190 - protein, 17 aa, Homo sapiens
KMKEEVPTALVEAHVRK

SEQ ID NO: 6191 - protein, 17 aa, Homo sapiens
KMKEEVPTALVEAHVRK

SEQ ID NO: 6192 - protein, 9 aa, Homo sapiens
RKVEEAAKV

SEQ ID NO: 6193 - protein, 17 aa, Homo sapiens
KMKEEVPTALVEAHVRK

SEQ ID NO: 6194 - protein, 17 aa, Homo sapiens
KMKEEVPTALVEAHVRK

SEQ ID NO: 6195 - protein, 9 aa, Homo sapiens
RKVEEAAKV

SEQ ID NO: 6196 - protein, 9 aa, Homo sapiens
RKVEEAAKV

SEQ ID NO: 6197 - protein, 17 aa, Homo sapiens
KMKEEVPTALVEAHVRK

SEQ ID NO: 6198 - protein, 17 aa, Homo sapiens
KMKEEVPTALVEAHVRK

SEQ ID NO: 6199 - protein, 17 aa, Homo sapiens
KMKEEVPTALVEAHVRK

SEQ ID NO: 6200 - protein, 9 aa, Homo sapiens
RKVEEAAKV

SEQ ID NO: 6201 - protein, 17 aa, Homo sapiens
KMKEEVPTALVEAHVRK

SEQ ID NO: 6202 - protein, 40 aa, Homo sapiens
RDKQVLLHWGYYPDSYDTWIPASEIEASVEDAPTPEKPRK

SEQ ID NO: 6203 - protein, 40 aa, Homo sapiens; identical to SEQ ID NO: 6202

SEQ ID NO: 6204 - protein, 40 aa, Homo sapiens; identical to SEQ ID NO: 6202

SEQ ID NO: 6205 - protein, 40 aa, Homo sapiens; identical to SEQ ID NO: 6202

SEQ ID NO: 6206 - protein, 40 aa, Homo sapiens; identical to SEQ ID NO: 6202

SEQ ID NO: 6207 - protein, 40 aa, Homo sapiens; identical to SEQ ID NO: 6202

SEQ ID NO: 6208 - protein, 40 aa, Homo sapiens; identical to SEQ ID NO: 6202

SEQ ID NO: 6209 - protein, 12 aa, Homo sapiens
KAKHLAAVEERK

SEQ ID NO: 6210 - protein, 9 aa, Homo sapiens
RKVEEAAKV

SEQ ID NO: 6211 - protein, 9 aa, Homo sapiens
RKVEEAAKV

SEQ ID NO: 6212 - protein, 9 aa, Homo sapiens
RKVEEAAKV

SEQ ID NO: 6213 - protein, 9 aa, Homo sapiens
RKVEEAAKV

SEQ ID NO: 6214 - protein, 9 aa, Homo sapiens
RKVEEAAKV

SEQ ID NO: 6215 - protein, 38 aa, Homo sapiens; identical to SEQ ID NO: 6132

SEQ ID NO: 6216 - protein, 38 aa, Homo sapiens; identical to SEQ ID NO: 6132

SEQ ID NO: 6217 - protein, 38 aa, Homo sapiens; identical to SEQ ID NO: 6132

SEQ ID NO: 6218 - protein, 38 aa, Homo sapiens; identical to SEQ ID NO: 6132

SEQ ID NO: 6219 - protein, 9 aa, Homo sapiens
RKVEEAAKV

SEQ ID NO: 6220 - protein, 38 aa, Homo sapiens; identical to SEQ ID NO: 6132

SEQ ID NO: 6221 - protein, 9 aa, Homo sapiens
RKVEEAAKV

SEQ ID NO: 6222 - protein, 9 aa, Homo sapiens
RKVEEAAKV

SEQ ID NO: 6223 - protein, 9 aa, Homo sapiens
RKVEEAAKV

SEQ ID NO: 6224 - protein, 9 aa, Homo sapiens
RKVEEAAKV

SEQ ID NO: 6225 - protein, 9 aa, Homo sapiens
RKVEEAAKV

SEQ ID NO: 6226 - protein, 18 aa, Homo sapiens
RLLEDSALSKYDATKQKR

SEQ ID NO: 6227 - protein, 18 aa, Homo sapiens
RLLEDSALSKYDATKQKR

SEQ ID NO: 6228 - protein, 18 aa, Homo sapiens
RLLEDSALSKYDATKQKR

SEQ ID NO: 6229 - protein, 18 aa, Homo sapiens
RLLEDSALSKYDATKQKR

SEQ ID NO: 6230 - protein, 9 aa, Homo sapiens
RKFSSFFKS

SEQ ID NO: 6231 - protein, 19 aa, Homo sapiens
REFVICDKYLQQIFESQRM

SEQ ID NO: 6232 - protein, 19 aa, Homo sapiens
REFVICDKYLQQIFESQRM

SEQ ID NO: 6233 - protein, 19 aa, Homo sapiens
REFVICDKYLQQIFESQRM

SEQ ID NO: 6234 - protein, 19 aa, Homo sapiens
REFVICDKYLQQIFESQRM

SEQ ID NO: 6235 - protein, 19 aa, Homo sapiens
REFVICDKYLQQIFESQRM

SEQ ID NO: 6236 - protein, 12 aa, Homo sapiens
KTHKLQDPHERE

SEQ ID NO: 6237 - protein, 19 aa, Homo sapiens
REFVICDKYLQQIFESQRM

SEQ ID NO: 6238 - protein, 19 aa, Homo sapiens
REFVICDKYLQQIFESQRM

SEQ ID NO: 6239 - protein, 19 aa, Homo sapiens
REFVICDKYLQQIFESQRM

SEQ ID NO: 6240 - protein, 10 aa, Homo sapiens
RKLDQTIMRK

SEQ ID NO: 6241 - protein, 9 aa, Homo sapiens
RNHNAKKKK

SEQ ID NO: 6242 - protein, 9 aa, Homo sapiens
RNHNAKKKK

SEQ ID NO: 6243 - protein, 9 aa, Homo sapiens
RNHNAKKKK

SEQ ID NO: 6244 - protein, 11 aa, Homo sapiens
KMADKILPQRI

SEQ ID NO: 6245 - protein, 11 aa, Homo sapiens
KMADKILPQRI

SEQ ID NO: 6246 - protein, 12 aa, Homo sapiens
KKMADKILPQRI

SEQ ID NO: 6247 - protein, 29 aa, Homo sapiens
RIFISNTFNPAKSDAEDGEGTVASWELRV

SEQ ID NO: 6248 - protein, 29 aa, Homo sapiens
RIFISNTFNPAKSDAEDGEGTVASWELRV

SEQ ID NO: 6249 - protein, 29 aa, Homo sapiens
RIFISNTFNPAKSDAEDGEGTVASWELRV

SEQ ID NO: 6250 - protein, 29 aa, Homo sapiens
RIFISNTFNPAKSDAEDGEGTVASWELRV

SEQ ID NO: 6251 - protein, 29 aa, Homo sapiens
RIFISNTFNPAKSDAEDGEGTVASWELRV

SEQ ID NO: 6252 - protein, 29 aa, Homo sapiens
RIFISNTFNPAKSDAEDGEGTVASWELRV

SEQ ID NO: 6253 - protein, 29 aa, Homo sapiens
RIFISNTFNPAKSDAEDGEGTVASWELRV

SEQ ID NO: 6254 - protein, 29 aa, Homo sapiens
RIFISNTFNPAKSDAEDGEGTVASWELRV

SEQ ID NO: 6255 - protein, 29 aa, Homo sapiens
RIFISNTFNPAKSDAEDGEGTVASWELRV

SEQ ID NO: 6256 - protein, 29 aa, Homo sapiens
RIFISNTFNPAKSDAEDGEGTVASWELRV

SEQ ID NO: 6257 - protein, 29 aa, Homo sapiens
RIFISNTFNPAKSDAEDGEGTVASWELRV

SEQ ID NO: 6258 - protein, 16 aa, Homo sapiens
RTATTQETDGFQVKRP

SEQ ID NO: 6259 - protein, 29 aa, Homo sapiens
RIFISNTFNPAKSDAEDGEGTVASWELRV

SEQ ID NO: 6260 - protein, 29 aa, Homo sapiens
RIFISNTFNPAKSDAEDGEGTVASWELRV

SEQ ID NO: 6261 - protein, 33 aa, Homo sapiens
RIFISNTFNPAKSDAEDGEGTVASWELRVEGRL

SEQ ID NO: 6262 - protein, 23 aa, Homo sapiens
RTATTQETDGFQVKRPGDVNVRC

SEQ ID NO: 6263 - protein, 23 aa, Homo sapiens
RTATTQETDGFQVKRPGDVNVRC

SEQ ID NO: 6264 - protein, 33 aa, Homo sapiens; identical to SEQ ID NO: 6261

SEQ ID NO: 6265 - protein, 29 aa, Homo sapiens
RIFISNTFNPAKSDAEDGEGTVASWELRV

SEQ ID NO: 6266 - protein, 33 aa, Homo sapiens; identical to SEQ ID NO: 6261

SEQ ID NO: 6267 - protein, 29 aa, Homo sapiens
RIFISNTFNPAKSDAEDGEGTVASWELRV

SEQ ID NO: 6268 - protein, 33 aa, Homo sapiens; identical to SEQ ID NO: 6261

SEQ ID NO: 6269 - protein, 33 aa, Homo sapiens; identical to SEQ ID NO: 6261

SEQ ID NO: 6270 - protein, 23 aa, Homo sapiens
RTATTQETDGFQVKRPGDVNVRC

SEQ ID NO: 6271 - protein, 33 aa, Homo sapiens; identical to SEQ ID NO: 6261

SEQ ID NO: 6272 - protein, 29 aa, Homo sapiens
RIFISNTFNPAKSDAEDGEGTVASWELRV

SEQ ID NO: 6273 - protein, 23 aa, Homo sapiens
RTATTQETDGFQVKRPGDVNVRC

SEQ ID NO: 6274 - protein, 29 aa, Homo sapiens
RIFISNTFNPAKSDAEDGEGTVASWELRV

SEQ ID NO: 6275 - protein, 23 aa, Homo sapiens
RTATTQETDGFQVKRPGDVNVRC

SEQ ID NO: 6276 - protein, 33 aa, Homo sapiens; identical to SEQ ID NO: 6261

SEQ ID NO: 6277 - protein, 33 aa, Homo sapiens; identical to SEQ ID NO: 6261

SEQ ID NO: 6278 - protein, 29 aa, Homo sapiens
RIFISNTFNPAKSDAEDGEGTVASWELRV

SEQ ID NO: 6279 - protein, 23 aa, Homo sapiens
RTATTQETDGFQVKRPGDVNVRC

SEQ ID NO: 6280 - protein, 33 aa, Homo sapiens; identical to SEQ ID NO: 6261

SEQ ID NO: 6281 - protein, 23 aa, Homo sapiens
RTATTQETDGFQVKRPGDVNVRC

SEQ ID NO: 6282 - protein, 29 aa, Homo sapiens
RIFISNTFNPAKSDAEDGEGTVASWELRV

SEQ ID NO: 6283 - protein, 33 aa, Homo sapiens; identical to SEQ ID NO: 6261

SEQ ID NO: 6284 - protein, 33 aa, Homo sapiens; identical to SEQ ID NO: 6261

SEQ ID NO: 6285 - protein, 29 aa, Homo sapiens
RIFISNTFNPAKSDAEDGEGTVASWELRV

SEQ ID NO: 6286 - protein, 28 aa, Homo sapiens
RLHALLMPPEPIIINHVISVDPNDQKKT

SEQ ID NO: 6287 - protein, 28 aa, Homo sapiens
RLHALLMPPEPIIINHVISVDPNDQKKT

SEQ ID NO: 6288 - protein, 28 aa, Homo sapiens
RLHALLMPPEPIIINHVISVDPNDQKKT

SEQ ID NO: 6289 - protein, 28 aa, Homo sapiens
RLHALLMPPEPIIINHVISVDPNDQKKT

SEQ ID NO: 6290 - protein, 9 aa, Homo sapiens
RNHNAKKKK

SEQ ID NO: 6291 - protein, 9 aa, Homo sapiens
RNHNAKKKK

SEQ ID NO: 6292 - protein, 9 aa, Homo sapiens
RNHNAKKKK

SEQ ID NO: 6293 - protein, 9 aa, Homo sapiens
RNHNAKKKK

SEQ ID NO: 6294 - protein, 9 aa, Homo sapiens
RNHNAKKKK

SEQ ID NO: 6295 - protein, 7 aa, Homo sapiens
RKMADKV

SEQ ID NO: 6296 - protein, 21 aa, Homo sapiens
RKRPAPQQIQQVQQQAVQNRN

SEQ ID NO: 6297 - protein, 21 aa, Homo sapiens
RKRPAPQQIQQVQQQAVQNRN

SEQ ID NO: 6298 - protein, 21 aa, Homo sapiens
RKRPAPQQIQQVQQQAVQNRN

SEQ ID NO: 6299 - protein, 21 aa, Homo sapiens
RKRPAPQQIQQVQQQAVQNRN

SEQ ID NO: 6300 - protein, 21 aa, Homo sapiens
RKRPAPQQIQQVQQQAVQNRN

SEQ ID NO: 6301 - protein, 21 aa, Homo sapiens
RKRPAPQQIQQVQQQAVQNRN

SEQ ID NO: 6302 - protein, 21 aa, Homo sapiens
RKRPAPQQIQQVQQQAVQNRN

SEQ ID NO: 6303 - protein, 21 aa, Homo sapiens
RKRPAPQQIQQVQQQAVQNRN

SEQ ID NO: 6304 - protein, 23 aa, Homo sapiens
RTATTQETDGFQVKRPGDVNVRC

SEQ ID NO: 6305 - protein, 23 aa, Homo sapiens
RTATTQETDGFQVKRPGDVNVRC

SEQ ID NO: 6306 - protein, 11 aa, Homo sapiens
RMKFSEIPQRL

SEQ ID NO: 6307 - protein, 11 aa, Homo sapiens
RMKFSEIPQRL

SEQ ID NO: 6308 - protein, 11 aa, Homo sapiens
KMADKILPQRI

SEQ ID NO: 6309 - protein, 11 aa, Homo sapiens
KMADKILPQRI

SEQ ID NO: 6310 - protein, 17 aa, Homo sapiens
RVASAAAKAALEEFSRV

SEQ ID NO: 6311 - protein, 17 aa, Homo sapiens
RVASAAAKAALEEFSRV

SEQ ID NO: 6312 - protein, 18 aa, Homo sapiens
RVREEVPLELVEAHVKKV

SEQ ID NO: 6313 - protein, 18 aa, Homo sapiens
RVREEVPLELVEAHVKKV

SEQ ID NO: 6314 - protein, 18 aa, Homo sapiens
RVREEVPLELVEAHVKKV

SEQ ID NO: 6315 - protein, 7 aa, Homo sapiens
RKKSGKK

SEQ ID NO: 6316 - protein, 12 aa, Homo sapiens
KKGQASLYGKRR

SEQ ID NO: 6317 - protein, 28 aa, Homo sapiens
KKKVEHEISEGNVATAAAAALASAATKA

SEQ ID NO: 6318 - protein, 18 aa, Homo sapiens
RVREEVPLELVEAHVKKV

SEQ ID NO: 6319 - protein, 9 aa, Homo sapiens
KKVQEAARA

SEQ ID NO: 6320 - protein, 9 aa, Homo sapiens
KKVQEAARA

SEQ ID NO: 6321 - protein, 10 aa, Homo sapiens
KSKGASAGRE

SEQ ID NO: 6322 - protein, 9 aa, Homo sapiens
RTDIYSKKT

SEQ ID NO: 6323 - protein, 9 aa, Homo sapiens
RTDIYSKKT

SEQ ID NO: 6324 - protein, 9 aa, Homo sapiens
RTDIYSKKT

SEQ ID NO: 6325 - protein, 9 aa, Homo sapiens
RTDIYSKKT

SEQ ID NO: 6326 - protein, 9 aa, Homo sapiens
RTDIYSKKT

SEQ ID NO: 6327 - protein, 9 aa, Homo sapiens
RTDIYSKKT

SEQ ID NO: 6328 - protein, 9 aa, Homo sapiens
RTDIYSKKT

SEQ ID NO: 6329 - protein, 9 aa, Homo sapiens
RTDIYSKKT

SEQ ID NO: 6330 - protein, 18 aa, Homo sapiens
RVREEVPLELVEAHVKKV

SEQ ID NO: 6331 - protein, 18 aa, Homo sapiens
RVREEVPLELVEAHVKKV

SEQ ID NO: 6332 - protein, 25 aa, Homo sapiens
KDMEDPTPVPNIEEVVLPKNVNLKK

SEQ ID NO: 6333 - protein, 9 aa, Homo sapiens
KLKDIIKRH

SEQ ID NO: 6334 - protein, 34 aa, Homo sapiens
RNVEMFMNIEKTLVQNNCLTRPNIYLIPDIDLKL

SEQ ID NO: 6335 - protein, 34 aa, Homo sapiens; identical to SEQ ID NO: 6334

SEQ ID NO: 6336 - protein, 18 aa, Homo sapiens
KAGGALCHILGAAYKYKN

SEQ ID NO: 6337 - protein, 18 aa, Homo sapiens
KAGGALCHILGAAYKYKN

SEQ ID NO: 6338 - protein, 17 aa, Homo sapiens
RKHSPSPPPPTPTESRK

SEQ ID NO: 6339 - protein, 17 aa, Homo sapiens
RKHSPSPPPPTPTESRK

SEQ ID NO: 6340 - protein, 17 aa, Homo sapiens
RKHSPSPPPPTPTESRK

SEQ ID NO: 6341 - protein, 31 aa, Homo sapiens; identical to SEQ ID NO: 263

SEQ ID NO: 6342 - protein, 31 aa, Homo sapiens; identical to SEQ ID NO: 263

SEQ ID NO: 6343 - protein, 31 aa, Homo sapiens; identical to SEQ ID NO: 263

SEQ ID NO: 6344 - protein, 11 aa, Homo sapiens
RDRKASANARK

SEQ ID NO: 6345 - protein, 8 aa, Homo sapiens
RKPVSFRQ

SEQ ID NO: 6346 - protein, 13 aa, Homo sapiens
RHQGTFTDEKSKA

SEQ ID NO: 6347 - protein, 13 aa, Homo sapiens
RHQGTFTDEKSKA

SEQ ID NO: 6348 - protein, 13 aa, Homo sapiens
RHQGTFTDEKSKA

SEQ ID NO: 6349 - protein, 8 aa, Homo sapiens
RKPVSFRQ

SEQ ID NO: 6350 - protein, 13 aa, Homo sapiens
RHQGTFTDEKSKA

SEQ ID NO: 6351 - protein, 39 aa, Homo sapiens
KQVLVHWGFYPDSYDTWVHSNDVDAEIEDPPIPEKPWKV

SEQ ID NO: 6352 - protein, 13 aa, Homo sapiens
RHQGTFTDEKSKA

SEQ ID NO: 6353 - protein, 41 aa, Homo sapiens
KEKQVLVHWGFYPDSYDTWVHSNDVDAEIEDPPIPEKPWKV

SEQ ID NO: 6354 - protein, 13 aa, Homo sapiens
RHQGTFTDEKSKA

SEQ ID NO: 6355 - protein, 13 aa, Homo sapiens
RHQGTFTDEKSKA

SEQ ID NO: 6356 - protein, 13 aa, Homo sapiens
RHQGTFTDEKSKA

SEQ ID NO: 6357 - protein, 13 aa, Homo sapiens
RHQGTFTDEKSKA

SEQ ID NO: 6358 - protein, 13 aa, Homo sapiens
RHQGTFTDEKSKA

SEQ ID NO: 6359 - protein, 14 aa, Homo sapiens
KRHQGTFTDEKSKA

SEQ ID NO: 6360 - protein, 13 aa, Homo sapiens
RHQGTFTDEKSKA

SEQ ID NO: 6361 - protein, 13 aa, Homo sapiens
RHQGTFTDEKSKA

SEQ ID NO: 6362 - protein, 13 aa, Homo sapiens
RHQGTFTDEKSKA

SEQ ID NO: 6363 - protein, 13 aa, Homo sapiens
RHQGTFTDEKSKA

SEQ ID NO: 6364 - protein, 13 aa, Homo sapiens
RHQGTFTDEKSKA

SEQ ID NO: 6365 - protein, 13 aa, Homo sapiens
RHQGTFTDEKSKA

SEQ ID NO: 6366 - protein, 13 aa, Homo sapiens
RHQGTFTDEKSKA

SEQ ID NO: 6367 - protein, 16 aa, Homo sapiens
RISTKNEEPVRSPERR

SEQ ID NO: 6368 - protein, 16 aa, Homo sapiens
RISTKNEEPVRSPERR

SEQ ID NO: 6369 - protein, 13 aa, Homo sapiens
RHQGTFTDEKSKA

SEQ ID NO: 6370 - protein, 11 aa, Homo sapiens
KKGQASLYGKR

SEQ ID NO: 6371 - protein, 11 aa, Homo sapiens
KKGQASLYGKR

SEQ ID NO: 6372 - protein, 11 aa, Homo sapiens
KKGQASLYGKR

SEQ ID NO: 6373 - protein, 11 aa, Homo sapiens
KKGQASLYGKR

SEQ ID NO: 6374 - protein, 12 aa, Homo sapiens
KAKHLAAVEERK

SEQ ID NO: 6375 - protein, 27 aa, Homo sapiens
KKVEHEISEGNVATAAAAALASAATKA

SEQ ID NO: 6376 - protein, 27 aa, Homo sapiens
KKVEHEISEGNVATAAAAALASAATKA

SEQ ID NO: 6377 - protein, 18 aa, Homo sapiens
RVREEVPLELVEAHVKKV

SEQ ID NO: 6378 - protein, 18 aa, Homo sapiens
RVREEVPLELVEAHVKKV

SEQ ID NO: 6379 - protein, 16 aa, Homo sapiens
RISTKNEEPVRSPERR

SEQ ID NO: 6380 - protein, 16 aa, Homo sapiens
RISTKNEEPVRSPERR

SEQ ID NO: 6381 - protein, 16 aa, Homo sapiens
RISTKNEEPVRSPERR

SEQ ID NO: 6382 - protein, 16 aa, Homo sapiens
RISTKNEEPVRSPERR

SEQ ID NO: 6383 - protein, 12 aa, Homo sapiens
RISTKNEEPVRS

SEQ ID NO: 6384 - protein, 12 aa, Homo sapiens
RISTKNEEPVRS

SEQ ID NO: 6385 - protein, 16 aa, Homo sapiens
RISTKNEEPVRSPERR

SEQ ID NO: 6386 - protein, 9 aa, Homo sapiens
RKASANARK

SEQ ID NO: 6387 - protein, 16 aa, Homo sapiens
RISTKNEEPVRSPERR

SEQ ID NO: 6388 - protein, 16 aa, Homo sapiens
RISTKNEEPVRSPERR

SEQ ID NO: 6389 - protein, 11 aa, Homo sapiens
RDRKASANARK

SEQ ID NO: 6390 - protein, 9 aa, Homo sapiens
RKASANARK

SEQ ID NO: 6391 - protein, 12 aa, Homo sapiens
RISTKNEEPVRS

SEQ ID NO: 6392 - protein, 11 aa, Homo sapiens
RDRKASANARK

SEQ ID NO: 6393 - protein, 16 aa, Homo sapiens
RISTKNEEPVRSPERR

SEQ ID NO: 6394 - protein, 16 aa, Homo sapiens
RISTKNEEPVRSPERR

SEQ ID NO: 6395 - protein, 16 aa, Homo sapiens
RISTKNEEPVRSPERR

SEQ ID NO: 6396 - protein, 16 aa, Homo sapiens
RISTKNEEPVRSPERR

SEQ ID NO: 6397 - protein, 16 aa, Homo sapiens
RISTKNEEPVRSPERR

SEQ ID NO: 6398 - protein, 12 aa, Homo sapiens
RISTKNEEPVRS

SEQ ID NO: 6399 - protein, 16 aa, Homo sapiens
RISTKNEEPVRSPERR

SEQ ID NO: 6400 - protein, 9 aa, Homo sapiens
RKASANARK

SEQ ID NO: 6401 - protein, 16 aa, Homo sapiens
RISTKNEEPVRSPERR

SEQ ID NO: 6402 - protein, 12 aa, Homo sapiens
RISTKNEEPVRS

SEQ ID NO: 6403 - protein, 16 aa, Homo sapiens
RISTKNEEPVRSPERR

SEQ ID NO: 6404 - protein, 14 aa, Homo sapiens
KEKPVDLQNFGLRT

SEQ ID NO: 6405 - protein, 14 aa, Homo sapiens
KEKPVDLQNFGLRT

SEQ ID NO: 6406 - protein, 20 aa, Homo sapiens
RSPQVPAAQQMLNFPEKNKE

SEQ ID NO: 6407 - protein, 14 aa, Homo sapiens
KEKPVDLQNFGLRT

SEQ ID NO: 6408 - protein, 14 aa, Homo sapiens
KEKPVDLQNFGLRT

SEQ ID NO: 6409 - protein, 14 aa, Homo sapiens
KEKPVDLQNFGLRT

SEQ ID NO: 6410 - protein, 14 aa, Homo sapiens
KEKPVDLQNFGLRT

SEQ ID NO: 6411 - protein, 14 aa, Homo sapiens
KEKPVDLQNFGLRT

SEQ ID NO: 6412 - protein, 14 aa, Homo sapiens
KEKPVDLQNFGLRT

SEQ ID NO: 6413 - protein, 14 aa, Homo sapiens
KEKPVDLQNFGLRT

SEQ ID NO: 6414 - protein, 20 aa, Homo sapiens
RSPQVPAAQQMLNFPEKNKE

SEQ ID NO: 6415 - protein, 20 aa, Homo sapiens
RSPQVPAAQQMLNFPEKNKE

SEQ ID NO: 6416 - protein, 20 aa, Homo sapiens
RSPQVPAAQQMLNFPEKNKE

SEQ ID NO: 6417 - protein, 20 aa, Homo sapiens
RSPQVPAAQQMLNFPEKNKE

SEQ ID NO: 6418 - protein, 20 aa, Homo sapiens
RSPQVPAAQQMLNFPEKNKE

SEQ ID NO: 6419 - protein, 20 aa, Homo sapiens
RSPQVPAAQQMLNFPEKNKE

SEQ ID NO: 6420 - protein, 14 aa, Homo sapiens
KEKPVDLQNFGLRT

SEQ ID NO: 6421 - protein, 20 aa, Homo sapiens
RSPQVPAAQQMLNFPEKNKE

SEQ ID NO: 6422 - protein, 14 aa, Homo sapiens
KEKPVDLQNFGLRT

SEQ ID NO: 6423 - protein, 14 aa, Homo sapiens
KEKPVDLQNFGLRT

SEQ ID NO: 6424 - protein, 18 aa, Homo sapiens
RVREEVPLELVEAHVKKV

SEQ ID NO: 6425 - protein, 10 aa, Homo sapiens
RVWLGKHYKK

SEQ ID NO: 6426 - protein, 10 aa, Homo sapiens
KSKGASAGRE

SEQ ID NO: 6427 - protein, 10 aa, Homo sapiens
KSKGASAGRE

SEQ ID NO: 6428 - protein, 10 aa, Homo sapiens
KSKGASAGRE

SEQ ID NO: 6429 - protein, 10 aa, Homo sapiens
KSKGASAGRE

SEQ ID NO: 6430 - protein, 27 aa, Homo sapiens
KKVEHEISEGNVATAAAAALASAATKA

SEQ ID NO: 6431 - protein, 27 aa, Homo sapiens
KKVEHEISEGNVATAAAAALASAATKA

SEQ ID NO: 6432 - protein, 27 aa, Homo sapiens
KKVEHEISEGNVATAAAAALASAATKA

SEQ ID NO: 6433 - protein, 27 aa, Homo sapiens
KKVEHEISEGNVATAAAAALASAATKA

SEQ ID NO: 6434 - protein, 27 aa, Homo sapiens
KKVEHEISEGNVATAAAAALASAATKA

SEQ ID NO: 6435 - protein, 27 aa, Homo sapiens
KKVEHEISEGNVATAAAAALASAATKA

SEQ ID NO: 6436 - protein, 27 aa, Homo sapiens
KKVEHEISEGNVATAAAAALASAATKA

SEQ ID NO: 6437 - protein, 18 aa, Homo sapiens
RVREEVPLELVEAHVKKV

SEQ ID NO: 6438 - protein, 18 aa, Homo sapiens
RVREEVPLELVEAHVKKV

SEQ ID NO: 6439 - protein, 18 aa, Homo sapiens
RVREEVPLELVEAHVKKV

SEQ ID NO: 6440 - protein, 19 aa, Homo sapiens
RVASAAAKAALEEFSRVRE

SEQ ID NO: 6441 - protein, 19 aa, Homo sapiens
RVASAAAKAALEEFSRVRE

SEQ ID NO: 6442 - protein, 19 aa, Homo sapiens
RVASAAAKAALEEFSRVRE

SEQ ID NO: 6443 - protein, 19 aa, Homo sapiens
RVASAAAKAALEEFSRVRE

SEQ ID NO: 6444 - protein, 19 aa, Homo sapiens
RVASAAAKAALEEFSRVRE

SEQ ID NO: 6445 - protein, 19 aa, Homo sapiens
RVASAAAKAALEEFSRVRE

SEQ ID NO: 6446 - protein, 19 aa, Homo sapiens
RVASAAAKAALEEFSRVRE

SEQ ID NO: 6447 - protein, 19 aa, Homo sapiens
RVASAAAKAALEEFSRVRE

SEQ ID NO: 6448 - protein, 19 aa, Homo sapiens
RVASAAAKAALEEFSRVRE

SEQ ID NO: 6449 - protein, 19 aa, Homo sapiens
RVASAAAKAALEEFSRVRE

SEQ ID NO: 6450 - protein, 19 aa, Homo sapiens
RVASAAAKAALEEFSRVRE

SEQ ID NO: 6451 - protein, 18 aa, Homo sapiens
RVREEVPLELVEAHVKKV

SEQ ID NO: 6452 - protein, 9 aa, Homo sapiens
RESDTGKKK

SEQ ID NO: 6453 - protein, 17 aa, Homo sapiens
RVASAAAKAALEEFSRV

SEQ ID NO: 6454 - protein, 17 aa, Homo sapiens
RVASAAAKAALEEFSRV

SEQ ID NO: 6455 - protein, 17 aa, Homo sapiens
RVASAAAKAALEEFSRV

SEQ ID NO: 6456 - protein, 17 aa, Homo sapiens
RVASAAAKAALEEFSRV

SEQ ID NO: 6457 - protein, 17 aa, Homo sapiens
RVASAAAKAALEEFSRV

SEQ ID NO: 6458 - protein, 17 aa, Homo sapiens
RVASAAAKAALEEFSRV

SEQ ID NO: 6459 - protein, 17 aa, Homo sapiens
RVASAAAKAALEEFSRV

SEQ ID NO: 6460 - protein, 17 aa, Homo sapiens
RVASAAAKAALEEFSRV

SEQ ID NO: 6461 - protein, 17 aa, Homo sapiens
RVASAAAKAALEEFSRV

SEQ ID NO: 6462 - protein, 17 aa, Homo sapiens
RVASAAAKAALEEFSRV

SEQ ID NO: 6463 - protein, 17 aa, Homo sapiens
RVASAAAKAALEEFSRV

SEQ ID NO: 6464 - protein, 17 aa, Homo sapiens
RVASAAAKAALEEFSRV

SEQ ID NO: 6465 - protein, 27 aa, Homo sapiens
KKVEHEISEGNVATAAAAALASAATKA

SEQ ID NO: 6466 - protein, 27 aa, Homo sapiens
KKVEHEISEGNVATAAAAALASAATKA

SEQ ID NO: 6467 - protein, 27 aa, Homo sapiens
KKVEHEISEGNVATAAAAALASAATKA

SEQ ID NO: 6468 - protein, 27 aa, Homo sapiens
KKVEHEISEGNVATAAAAALASAATKA

SEQ ID NO: 6469 - protein, 27 aa, Homo sapiens
KKVEHEISEGNVATAAAAALASAATKA

SEQ ID NO: 6470 - protein, 27 aa, Homo sapiens
KKVEHEISEGNVATAAAAALASAATKA

SEQ ID NO: 6471 - protein, 27 aa, Homo sapiens
KKVEHEISEGNVATAAAAALASAATKA

SEQ ID NO: 6472 - protein, 27 aa, Homo sapiens
KKVEHEISEGNVATAAAAALASAATKA

SEQ ID NO: 6473 - protein, 27 aa, Homo sapiens
KKVEHEISEGNVATAAAAALASAATKA

SEQ ID NO: 6474 - protein, 27 aa, Homo sapiens
KKVEHEISEGNVATAAAAALASAATKA

SEQ ID NO: 6475 - protein, 17 aa, Homo sapiens
RVASAAAKAALEEFSRV

SEQ ID NO: 6476 - protein, 27 aa, Homo sapiens
KKVEHEISEGNVATAAAAALASAATKA

SEQ ID NO: 6477 - protein, 27 aa, Homo sapiens
KKVEHEISEGNVATAAAAALASAATKA

SEQ ID NO: 6478 - protein, 27 aa, Homo sapiens
KKVEHEISEGNVATAAAAALASAATKA

SEQ ID NO: 6479 - protein, 27 aa, Homo sapiens
KKVEHEISEGNVATAAAAALASAATKA

SEQ ID NO: 6480 - protein, 27 aa, Homo sapiens
KKVEHEISEGNVATAAAAALASAATKA

SEQ ID NO: 6481 - protein, 27 aa, Homo sapiens
KKVEHEISEGNVATAAAAALASAATKA

SEQ ID NO: 6482 - protein, 27 aa, Homo sapiens
KKVEHEISEGNVATAAAAALASAATKA

SEQ ID NO: 6483 - protein, 17 aa, Homo sapiens
RVASAAAKAALEEFSRV

SEQ ID NO: 6484 - protein, 27 aa, Homo sapiens
KKVEHEISEGNVATAAAAALASAATKA

SEQ ID NO: 6485 - protein, 17 aa, Homo sapiens
RVASAAAKAALEEFSRV

SEQ ID NO: 6486 - protein, 12 aa, Homo sapiens
KAKHLAAVEERK

SEQ ID NO: 6487 - protein, 12 aa, Homo sapiens
KAKHLAAVEERK

SEQ ID NO: 6488 - protein, 17 aa, Homo sapiens
RVASAAAKAALEEFSRV

SEQ ID NO: 6489 - protein, 17 aa, Homo sapiens
RVASAAAKAALEEFSRV

SEQ ID NO: 6490 - protein, 17 aa, Homo sapiens
RVASAAAKAALEEFSRV

SEQ ID NO: 6491 - protein, 17 aa, Homo sapiens
RVASAAAKAALEEFSRV

SEQ ID NO: 6492 - protein, 17 aa, Homo sapiens
RVASAAAKAALEEFSRV

SEQ ID NO: 6493 - protein, 17 aa, Homo sapiens
RVASAAAKAALEEFSRV

SEQ ID NO: 6494 - protein, 17 aa, Homo sapiens
RVASAAAKAALEEFSRV

SEQ ID NO: 6495 - protein, 28 aa, Homo sapiens
KKKVEHEISEGNVATAAAAALASAATKA

SEQ ID NO: 6496 - protein, 28 aa, Homo sapiens
KKKVEHEISEGNVATAAAAALASAATKA

SEQ ID NO: 6497 - protein, 17 aa, Homo sapiens
RVASAAAKAALEEFSRV

SEQ ID NO: 6498 - protein, 28 aa, Homo sapiens
KKKVEHEISEGNVATAAAAALASAATKA

SEQ ID NO: 6499 - protein, 17 aa, Homo sapiens
RVASAAAKAALEEFSRV

SEQ ID NO: 6500 - protein, 17 aa, Homo sapiens
RVASAAAKAALEEFSRV

SEQ ID NO: 6501 - protein, 17 aa, Homo sapiens
RVASAAAKAALEEFSRV

SEQ ID NO: 6502 - protein, 10 aa, Homo sapiens
KYKNEQGWRR

SEQ ID NO: 6503 - protein, 11 aa, Homo sapiens
KYKNEQGWRRF

SEQ ID NO: 6504 - protein, 9 aa, Homo sapiens
RKASANARK

SEQ ID NO: 6505 - protein, 9 aa, Homo sapiens
RKASANARK

SEQ ID NO: 6506 - protein, 41 aa, Homo sapiens; identical to SEQ ID NO: 6353

SEQ ID NO: 6507 - protein, 10 aa, Homo sapiens
RKDGGPATKF

SEQ ID NO: 6508 - protein, 27 aa, Homo sapiens
KKVEHEISEGNVATAAAAALASAATKA

SEQ ID NO: 6509 - protein, 27 aa, Homo sapiens
KKVEHEISEGNVATAAAAALASAATKA

SEQ ID NO: 6510 - protein, 27 aa, Homo sapiens
KKVEHEISEGNVATAAAAALASAATKA

SEQ ID NO: 6511 - protein, 27 aa, Homo sapiens
KKVEHEISEGNVATAAAAALASAATKA

SEQ ID NO: 6512 - protein, 27 aa, Homo sapiens
KKVEHEISEGNVATAAAAALASAATKA

SEQ ID NO: 6513 - protein, 27 aa, Homo sapiens
KKVEHEISEGNVATAAAAALASAATKA

SEQ ID NO: 6514 - protein, 27 aa, Homo sapiens
KKVEHEISEGNVATAAAAALASAATKA

SEQ ID NO: 6515 - protein, 27 aa, Homo sapiens
KKVEHEISEGNVATAAAAALASAATKA

SEQ ID NO: 6516 - protein, 36 aa, Homo sapiens
RASGKVDPTYGLESSCIAGTGPDEPEKLEGAEEEKM

SEQ ID NO: 6517 - protein, 36 aa, Homo sapiens; identical to SEQ ID NO: 6516

SEQ ID NO: 6518 - protein, 9 aa, Homo sapiens
KKVQEAARA

SEQ ID NO: 6519 - protein, 9 aa, Homo sapiens
KKVQEAARA

SEQ ID NO: 6520 - protein, 11 aa, Homo sapiens
RDRKASANARK

SEQ ID NO: 6521 - protein, 9 aa, Homo sapiens
KKVQEAARA

SEQ ID NO: 6522 - protein, 9 aa, Homo sapiens
RKASANARK

SEQ ID NO: 6523 - protein, 11 aa, Homo sapiens
RDRKASANARK

SEQ ID NO: 6524 - protein, 11 aa, Homo sapiens
RDRKASANARK

SEQ ID NO: 6525 - protein, 9 aa, Homo sapiens
RKASANARK

SEQ ID NO: 6526 - protein, 11 aa, Homo sapiens
KGQASLYGKRR

SEQ ID NO: 6527 - protein, 11 aa, Homo sapiens
KGQASLYGKRR

SEQ ID NO: 6528 - protein, 11 aa, Homo sapiens
RDRKASANARK

SEQ ID NO: 6529 - protein, 9 aa, Homo sapiens
RKASANARK

SEQ ID NO: 6530 - protein, 9 aa, Homo sapiens
RKASANARK

SEQ ID NO: 6531 - protein, 9 aa, Homo sapiens
RKASANARK

SEQ ID NO: 6532 - protein, 24 aa, Homo sapiens
KDGGPATKFWESPETVSQLDSVRV

SEQ ID NO: 6533 - protein, 9 aa, Homo sapiens
RKASANARK

SEQ ID NO: 6534 - protein, 9 aa, Homo sapiens
RKASANARK

SEQ ID NO: 6535 - protein, 9 aa, Homo sapiens
RKASANARK

SEQ ID NO: 6536 - protein, 30 aa, Homo sapiens
KTLAGLVVQLLQFQEDAFGKHVTNPAFTKL

SEQ ID NO: 6537 - protein, 30 aa, Homo sapiens; identical to SEQ ID NO: 6536

SEQ ID NO: 6538 - protein, 30 aa, Homo sapiens; identical to SEQ ID NO: 6536

SEQ ID NO: 6539 - protein, 30 aa, Homo sapiens; identical to SEQ ID NO: 6536

SEQ ID NO: 6540 - protein, 30 aa, Homo sapiens; identical to SEQ ID NO: 6536

SEQ ID NO: 6541 - protein, 30 aa, Homo sapiens; identical to SEQ ID NO: 6536

SEQ ID NO: 6542 - protein, 34 aa, Homo sapiens
KTLAGLVVQLLQFQEDAFGKHVTNPAFTKLPAKC

SEQ ID NO: 6543 - protein, 9 aa, Homo sapiens
RKASANARK

SEQ ID NO: 6544 - protein, 34 aa, Homo sapiens; identical to SEQ ID NO: 6542

SEQ ID NO: 6545 - protein, 17 aa, Homo sapiens
RKHSPSPPPPTPTESRK

SEQ ID NO: 6546 - protein, 17 aa, Homo sapiens
RKHSPSPPPPTPTESRK

SEQ ID NO: 6547 - protein, 17 aa, Homo sapiens
RKHSPSPPPPTPTESRK

SEQ ID NO: 6548 - protein, 17 aa, Homo sapiens
RKHSPSPPPPTPTESRK

SEQ ID NO: 6549 - protein, 9 aa, Homo sapiens
RKASANARK

SEQ ID NO: 6550 - protein, 11 aa, Homo sapiens
RDRKASANARK

SEQ ID NO: 6551 - protein, 10 aa, Homo sapiens
RKDGGPATKF

SEQ ID NO: 6552 - protein, 11 aa, Homo sapiens
RRKDGGPATKF

SEQ ID NO: 6553 - protein, 11 aa, Homo sapiens
RRKDGGPATKF

SEQ ID NO: 6554 - protein, 9 aa, Homo sapiens
KKVQEAARA

SEQ ID NO: 6555 - protein, 11 aa, Homo sapiens
RDRKASANARK

SEQ ID NO: 6556 - protein, 27 aa, Homo sapiens
KSKASHHIYPYSSSQDDEEWLRPVMRK

SEQ ID NO: 6557 - protein, 27 aa, Homo sapiens
KSKASHHIYPYSSSQDDEEWLRPVMRK

SEQ ID NO: 6558 - protein, 22 aa, Homo sapiens
REKLTELMFEHYNIPAFFLCKT

SEQ ID NO: 6559 - protein, 31 aa, Homo sapiens
RDDGSTLMEIDGDKGKQGGPTYYIDTNALRV

SEQ ID NO: 6560 - protein, 31 aa, Homo sapiens; identical to SEQ ID NO: 6559

SEQ ID NO: 6561 - protein, 22 aa, Homo sapiens
REKLTELMFEHYNIPAFFLCKT

SEQ ID NO: 6562 - protein, 31 aa, Homo sapiens; identical to SEQ ID NO: 6559

SEQ ID NO: 6563 - protein, 31 aa, Homo sapiens; identical to SEQ ID NO: 6559

SEQ ID NO: 6564 - protein, 31 aa, Homo sapiens; identical to SEQ ID NO: 6559

SEQ ID NO: 6565 - protein, 15 aa, Homo sapiens
KQEYEEGGKQCVERK

SEQ ID NO: 6566 - protein, 15 aa, Homo sapiens
KQEYEEGGKQCVERK

SEQ ID NO: 6567 - protein, 22 aa, Homo sapiens
REKLTELMFEHYNIPAFFLCKT

SEQ ID NO: 6568 - protein, 15 aa, Homo sapiens
KQEYEEGGKQCVERK

SEQ ID NO: 6569 - protein, 15 aa, Homo sapiens
KQEYEEGGKQCVERK

SEQ ID NO: 6570 - protein, 15 aa, Homo sapiens
KQEYEEGGKQCVERK

SEQ ID NO: 6571 - protein, 22 aa, Homo sapiens
REKLTELMFEHYNIPAFFLCKT

SEQ ID NO: 6572 - protein, 15 aa, Homo sapiens
KQEYEEGGKQCVERK

SEQ ID NO: 6573 - protein, 15 aa, Homo sapiens
KQEYEEGGKQCVERK

SEQ ID NO: 6574 - protein, 22 aa, Homo sapiens
REKLTELMFEHYNIPAFFLCKT

SEQ ID NO: 6575 - protein, 15 aa, Homo sapiens
KQEYEEGGKQCVERK

SEQ ID NO: 6576 - protein, 22 aa, Homo sapiens
REKLTELMFEHYNIPAFFLCKT

SEQ ID NO: 6577 - protein, 15 aa, Homo sapiens
KQEYEEGGKQCVERK

SEQ ID NO: 6578 - protein, 22 aa, Homo sapiens
REKLTELMFEHYNIPAFFLCKT

SEQ ID NO: 6579 - protein, 15 aa, Homo sapiens
KQEYEEGGKQCVERK

SEQ ID NO: 6580 - protein, 22 aa, Homo sapiens
REKLTELMFEHYNIPAFFLCKT

SEQ ID NO: 6581 - protein, 22 aa, Homo sapiens
REKLTELMFEHYNIPAFFLCKT

SEQ ID NO: 6582 - protein, 23 aa, Homo sapiens
KREKLTELMFEHYNIPAFFLCKT

SEQ ID NO: 6583 - protein, 15 aa, Homo sapiens
KQEYEEGGKQCVERK

SEQ ID NO: 6584 - protein, 15 aa, Homo sapiens
KQEYEEGGKQCVERK

SEQ ID NO: 6585 - protein, 22 aa, Homo sapiens
REKLTELMFEHYNIPAFFLCKT

SEQ ID NO: 6586 - protein, 15 aa, Homo sapiens
KQEYEEGGKQCVERK

SEQ ID NO: 6587 - protein, 22 aa, Homo sapiens
REKLTELMFEHYNIPAFFLCKT

SEQ ID NO: 6588 - protein, 23 aa, Homo sapiens
KREKLTELMFEHYNIPAFFLCKT

SEQ ID NO: 6589 - protein, 15 aa, Homo sapiens
KQEYEEGGKQCVERK

SEQ ID NO: 6590 - protein, 15 aa, Homo sapiens
KQEYEEGGKQCVERK

SEQ ID NO: 6591 - protein, 15 aa, Homo sapiens
KQEYEEGGKQCVERK

SEQ ID NO: 6592 - protein, 15 aa, Homo sapiens
KQEYEEGGKQCVERK

SEQ ID NO: 6593 - protein, 22 aa, Homo sapiens
REKLTELMFEHYNIPAFFLCKT

SEQ ID NO: 6594 - protein, 15 aa, Homo sapiens
KQEYEEGGKQCVERK

SEQ ID NO: 6595 - protein, 15 aa, Homo sapiens
KQEYEEGGKQCVERK

SEQ ID NO: 6596 - protein, 15 aa, Homo sapiens
KQEYEEGGKQCVERK

SEQ ID NO: 6597 - protein, 22 aa, Homo sapiens
REKLTELMFEHYNIPAFFLCKT

SEQ ID NO: 6598 - protein, 15 aa, Homo sapiens
KQEYEEGGKQCVERK

SEQ ID NO: 6599 - protein, 23 aa, Homo sapiens
KREKLTELMFEHYNIPAFFLCKT

SEQ ID NO: 6600 - protein, 15 aa, Homo sapiens
KQEYEEGGKQCVERK

SEQ ID NO: 6601 - protein, 17 aa, Homo sapiens
RDDGSTLMEIDGDKGKQ

SEQ ID NO: 6602 - protein, 30 aa, Homo sapiens; identical to SEQ ID NO: 1097

SEQ ID NO: 6603 - protein, 31 aa, Homo sapiens; identical to SEQ ID NO: 6559

SEQ ID NO: 6604 - protein, 22 aa, Homo sapiens
REKLTELMFEHYNIPAFFLCKT

SEQ ID NO: 6605 - protein, 22 aa, Homo sapiens
REKLTELMFEHYNIPAFFLCKT

SEQ ID NO: 6606 - protein, 22 aa, Homo sapiens
REKLTELMFEHYNIPAFFLCKT

SEQ ID NO: 6607 - protein, 30 aa, Homo sapiens; identical to SEQ ID NO: 1097

SEQ ID NO: 6608 - protein, 22 aa, Homo sapiens
REKLTELMFEHYNIPAFFLCKT

SEQ ID NO: 6609 - protein, 22 aa, Homo sapiens
REKLTELMFEHYNIPAFFLCKT

SEQ ID NO: 6610 - protein, 22 aa, Homo sapiens
REKLTELMFEHYNIPAFFLCKT

SEQ ID NO: 6611 - protein, 22 aa, Homo sapiens
REKLTELMFEHYNIPAFFLCKT

SEQ ID NO: 6612 - protein, 17 aa, Homo sapiens
RDDGSTLMEIDGDKGKQ

SEQ ID NO: 6613 - protein, 31 aa, Homo sapiens; identical to SEQ ID NO: 6559

SEQ ID NO: 6614 - protein, 22 aa, Homo sapiens
REKLTELMFEHYNIPAFFLCKT

SEQ ID NO: 6615 - protein, 22 aa, Homo sapiens
REKLTELMFEHYNIPAFFLCKT

SEQ ID NO: 6616 - protein, 22 aa, Homo sapiens
REKLTELMFEHYNIPAFFLCKT

SEQ ID NO: 6617 - protein, 22 aa, Homo sapiens
REKLTELMFEHYNIPAFFLCKT

SEQ ID NO: 6618 - protein, 22 aa, Homo sapiens
REKLTELMFEHYNIPAFFLCKT

SEQ ID NO: 6619 - protein, 22 aa, Homo sapiens
REKLTELMFEHYNIPAFFLCKT

SEQ ID NO: 6620 - protein, 22 aa, Homo sapiens
REKLTELMFEHYNIPAFFLCKT

SEQ ID NO: 6621 - protein, 22 aa, Homo sapiens
REKLTELMFEHYNIPAFFLCKT

SEQ ID NO: 6622 - protein, 22 aa, Homo sapiens
REKLTELMFEHYNIPAFFLCKT

SEQ ID NO: 6623 - protein, 22 aa, Homo sapiens
REKLTELMFEHYNIPAFFLCKT

SEQ ID NO: 6624 - protein, 22 aa, Homo sapiens
REKLTELMFEHYNIPAFFLCKT

SEQ ID NO: 6625 - protein, 14 aa, Homo sapiens
RLKLIANNTTVERR

SEQ ID NO: 6626 - protein, 15 aa, Homo sapiens
RLKLIANNTTVERRF

SEQ ID NO: 6627 - protein, 31 aa, Homo sapiens; identical to SEQ ID NO: 783

SEQ ID NO: 6628 - protein, 45 aa, Homo sapiens; identical to SEQ ID NO: 928

SEQ ID NO: 6629 - protein, 45 aa, Homo sapiens; identical to SEQ ID NO: 928

SEQ ID NO: 6630 - protein, 31 aa, Homo sapiens; identical to SEQ ID NO: 783

SEQ ID NO: 6631 - protein, 45 aa, Homo sapiens; identical to SEQ ID NO: 928

SEQ ID NO: 6632 - protein, 45 aa, Homo sapiens; identical to SEQ ID NO: 928

SEQ ID NO: 6633 - protein, 45 aa, Homo sapiens; identical to SEQ ID NO: 928

SEQ ID NO: 6634 - protein, 45 aa, Homo sapiens; identical to SEQ ID NO: 928

SEQ ID NO: 6635 - protein, 31 aa, Homo sapiens; identical to SEQ ID NO: 783

SEQ ID NO: 6636 - protein, 31 aa, Homo sapiens; identical to SEQ ID NO: 783

SEQ ID NO: 6637 - protein, 31 aa, Homo sapiens; identical to SEQ ID NO: 783

SEQ ID NO: 6638 - protein, 31 aa, Homo sapiens; identical to SEQ ID NO: 783

SEQ ID NO: 6639 - protein, 45 aa, Homo sapiens; identical to SEQ ID NO: 928

SEQ ID NO: 6640 - protein, 31 aa, Homo sapiens; identical to SEQ ID NO: 783

SEQ ID NO: 6641 - protein, 31 aa, Homo sapiens; identical to SEQ ID NO: 783

SEQ ID NO: 6642 - protein, 31 aa, Homo sapiens; identical to SEQ ID NO: 783

SEQ ID NO: 6643 - protein, 31 aa, Homo sapiens; identical to SEQ ID NO: 783

SEQ ID NO: 6644 - protein, 31 aa, Homo sapiens; identical to SEQ ID NO: 783

SEQ ID NO: 6645 - protein, 31 aa, Homo sapiens; identical to SEQ ID NO: 783

SEQ ID NO: 6646 - protein, 31 aa, Homo sapiens; identical to SEQ ID NO: 783

SEQ ID NO: 6647 - protein, 45 aa, Homo sapiens; identical to SEQ ID NO: 928

SEQ ID NO: 6648 - protein, 45 aa, Homo sapiens; identical to SEQ ID NO: 928

SEQ ID NO: 6649 - protein, 35 aa, Homo sapiens
RENMEAISPLKNGMVEDWDSFQAILDHTYKMHVKS

SEQ ID NO: 6650 - protein, 35 aa, Homo sapiens; identical to SEQ ID NO: 6649

SEQ ID NO: 6651 - protein, 35 aa, Homo sapiens; identical to SEQ ID NO: 6649

SEQ ID NO: 6652 - protein, 35 aa, Homo sapiens; identical to SEQ ID NO: 6649

SEQ ID NO: 6653 - protein, 11 aa, Homo sapiens
REGSPANWKRK

SEQ ID NO: 6654 - protein, 11 aa, Homo sapiens
RKEKLPQVTRS

SEQ ID NO: 6655 - protein, 11 aa, Homo sapiens
REGSPANWKRK

SEQ ID NO: 6656 - protein, 11 aa, Homo sapiens
RKEKLPQVTRS

SEQ ID NO: 6657 - protein, 11 aa, Homo sapiens
REGSPANWKRK

SEQ ID NO: 6658 - protein, 11 aa, Homo sapiens
RKEKLPQVTRS

SEQ ID NO: 6659 - protein, 11 aa, Homo sapiens
REGSPANWKRK

SEQ ID NO: 6660 - protein, 11 aa, Homo sapiens
REGSPANWKRK

SEQ ID NO: 6661 - protein, 11 aa, Homo sapiens
RKEKLPQVTRS

SEQ ID NO: 6662 - protein, 11 aa, Homo sapiens
RKEKLPQVTRS

SEQ ID NO: 6663 - protein, 11 aa, Homo sapiens
RKEKLPQVTRS

SEQ ID NO: 6664 - protein, 15 aa, Homo sapiens
KEAVREGSPANWKRK

SEQ ID NO: 6665 - protein, 15 aa, Homo sapiens
KEAVREGSPANWKRK

SEQ ID NO: 6666 - protein, 11 aa, Homo sapiens
RKEKLPQVTRS

SEQ ID NO: 6667 - protein, 11 aa, Homo sapiens
RKEKLPQVTRS

SEQ ID NO: 6668 - protein, 11 aa, Homo sapiens
REGSPANWKRK

SEQ ID NO: 6669 - protein, 11 aa, Homo sapiens
REGSPANWKRK

SEQ ID NO: 6670 - protein, 11 aa, Homo sapiens
REGSPANWKRK

SEQ ID NO: 6671 - protein, 11 aa, Homo sapiens
RKEKLPQVTRS

SEQ ID NO: 6672 - protein, 11 aa, Homo sapiens
REGSPANWKRK

SEQ ID NO: 6673 - protein, 15 aa, Homo sapiens
KEAVREGSPANWKRK

SEQ ID NO: 6674 - protein, 11 aa, Homo sapiens
REGSPANWKRK

SEQ ID NO: 6675 - protein, 11 aa, Homo sapiens
RKEKLPQVTRS

SEQ ID NO: 6676 - protein, 11 aa, Homo sapiens
REGSPANWKRK

SEQ ID NO: 6677 - protein, 11 aa, Homo sapiens
REGSPANWKRK

SEQ ID NO: 6678 - protein, 11 aa, Homo sapiens
REGSPANWKRK

SEQ ID NO: 6679 - protein, 15 aa, Homo sapiens
KEAVREGSPANWKRK

SEQ ID NO: 6680 - protein, 11 aa, Homo sapiens
REGSPANWKRK

SEQ ID NO: 6681 - protein, 11 aa, Homo sapiens
REGSPANWKRK

SEQ ID NO: 6682 - protein, 11 aa, Homo sapiens
RKEKLPQVTRS

SEQ ID NO: 6683 - protein, 11 aa, Homo sapiens
REGSPANWKRK

SEQ ID NO: 6684 - protein, 11 aa, Homo sapiens
RKEKLPQVTRS

SEQ ID NO: 6685 - protein, 11 aa, Homo sapiens
REGSPANWKRK

SEQ ID NO: 6686 - protein, 11 aa, Homo sapiens
RKEKLPQVTRS

SEQ ID NO: 6687 - protein, 11 aa, Homo sapiens
REGSPANWKRK

SEQ ID NO: 6688 - protein, 11 aa, Homo sapiens
REGSPANWKRK

SEQ ID NO: 6689 - protein, 11 aa, Homo sapiens
RKEKLPQVTRS

SEQ ID NO: 6690 - protein, 11 aa, Homo sapiens
REGSPANWKRK

SEQ ID NO: 6691 - protein, 11 aa, Homo sapiens
REGSPANWKRK

SEQ ID NO: 6692 - protein, 11 aa, Homo sapiens
REGSPANWKRK

SEQ ID NO: 6693 - protein, 15 aa, Homo sapiens
KEAVREGSPANWKRK

SEQ ID NO: 6694 - protein, 11 aa, Homo sapiens
REGSPANWKRK

SEQ ID NO: 6695 - protein, 11 aa, Homo sapiens
REGSPANWKRK

SEQ ID NO: 6696 - protein, 11 aa, Homo sapiens
REGSPANWKRK

SEQ ID NO: 6697 - protein, 15 aa, Homo sapiens
KEAVREGSPANWKRK

SEQ ID NO: 6698 - protein, 11 aa, Homo sapiens
REGSPANWKRK

SEQ ID NO: 6699 - protein, 15 aa, Homo sapiens
KEAVREGSPANWKRK

SEQ ID NO: 6700 - protein, 11 aa, Homo sapiens
RKEKLPQVTRS

SEQ ID NO: 6701 - protein, 15 aa, Homo sapiens
KEAVREGSPANWKRK

SEQ ID NO: 6702 - protein, 11 aa, Homo sapiens
REGSPANWKRK

SEQ ID NO: 6703 - protein, 11 aa, Homo sapiens
RKEKLPQVTRS

SEQ ID NO: 6704 - protein, 11 aa, Homo sapiens
REGSPANWKRK

SEQ ID NO: 6705 - protein, 11 aa, Homo sapiens
REGSPANWKRK

SEQ ID NO: 6706 - protein, 11 aa, Homo sapiens
RKEKLPQVTRS

SEQ ID NO: 6707 - protein, 11 aa, Homo sapiens
REGSPANWKRK

SEQ ID NO: 6708 - protein, 11 aa, Homo sapiens
REGSPANWKRK

SEQ ID NO: 6709 - protein, 11 aa, Homo sapiens
RKEKLPQVTRS

SEQ ID NO: 6710 - protein, 11 aa, Homo sapiens
RKEKLPQVTRS

SEQ ID NO: 6711 - protein, 11 aa, Homo sapiens
REGSPANWKRK

SEQ ID NO: 6712 - protein, 11 aa, Homo sapiens
RKEKLPQVTRS

SEQ ID NO: 6713 - protein, 11 aa, Homo sapiens
REGSPANWKRK

SEQ ID NO: 6714 - protein, 11 aa, Homo sapiens
REGSPANWKRK

SEQ ID NO: 6715 - protein, 11 aa, Homo sapiens
REGSPANWKRK

SEQ ID NO: 6716 - protein, 15 aa, Homo sapiens
KEAVREGSPANWKRK

SEQ ID NO: 6717 - protein, 11 aa, Homo sapiens
REGSPANWKRK

SEQ ID NO: 6718 - protein, 12 aa, Homo sapiens
REGSPANWKRKE

SEQ ID NO: 6719 - protein, 11 aa, Homo sapiens
REGSPANWKRK

SEQ ID NO: 6720 - protein, 12 aa, Homo sapiens
REGSPANWKRKE

SEQ ID NO: 6721 - protein, 11 aa, Homo sapiens
REGSPANWKRK

SEQ ID NO: 6722 - protein, 24 aa, Homo sapiens
KMHVKSEASLHPVLMSEAPWNTRA

SEQ ID NO: 6723 - protein, 24 aa, Homo sapiens
KMHVKSEASLHPVLMSEAPWNTRA

SEQ ID NO: 6724 - protein, 24 aa, Homo sapiens
KMHVKSEASLHPVLMSEAPWNTRA

SEQ ID NO: 6725 - protein, 24 aa, Homo sapiens
KMHVKSEASLHPVLMSEAPWNTRA

SEQ ID NO: 6726 - protein, 25 aa, Homo sapiens
RAGYAGEDCPKVDFPTAIGMVVERD

SEQ ID NO: 6727 - protein, 25 aa, Homo sapiens
RAGYAGEDCPKVDFPTAIGMVVERD

SEQ ID NO: 6728 - protein, 25 aa, Homo sapiens
RAGYAGEDCPKVDFPTAIGMVVERD

SEQ ID NO: 6729 - protein, 24 aa, Homo sapiens
KMHVKSEASLHPVLMSEAPWNTRA

SEQ ID NO: 6730 - protein, 25 aa, Homo sapiens
RAGYAGEDCPKVDFPTAIGMVVERD

SEQ ID NO: 6731 - protein, 24 aa, Homo sapiens
KMHVKSEASLHPVLMSEAPWNTRA

SEQ ID NO: 6732 - protein, 25 aa, Homo sapiens
RAGYAGEDCPKVDFPTAIGMVVERD

SEQ ID NO: 6733 - protein, 24 aa, Homo sapiens
KMHVKSEASLHPVLMSEAPWNTRA

SEQ ID NO: 6734 - protein, 35 aa, Homo sapiens; identical to SEQ ID NO: 6649

SEQ ID NO: 6735 - protein, 35 aa, Homo sapiens; identical to SEQ ID NO: 6649

SEQ ID NO: 6736 - protein, 35 aa, Homo sapiens; identical to SEQ ID NO: 6649

SEQ ID NO: 6737 - protein, 11 aa, Homo sapiens
RKEKLPQVTRS

SEQ ID NO: 6738 - protein, 38 aa, Homo sapiens
RAGYAGEDCPKVDFPTAIGMVVERDDGSTLMEIDGDKG

SEQ ID NO: 6739 - protein, 38 aa, Homo sapiens; identical to SEQ ID NO: 6738

SEQ ID NO: 6740 - protein, 38 aa, Homo sapiens; identical to SEQ ID NO: 6738

SEQ ID NO: 6741 - protein, 38 aa, Homo sapiens; identical to SEQ ID NO: 6738

SEQ ID NO: 6742 - protein, 25 aa, Homo sapiens
RAGYAGEDCPKVDFPTAIGMVVERD

SEQ ID NO: 6743 - protein, 38 aa, Homo sapiens; identical to SEQ ID NO: 6738

SEQ ID NO: 6744 - protein, 38 aa, Homo sapiens; identical to SEQ ID NO: 6738

SEQ ID NO: 6745 - protein, 25 aa, Homo sapiens
RELFQEMNIELVPPYMIASKEAVRE

SEQ ID NO: 6746 - protein, 25 aa, Homo sapiens
RELFQEMNIELVPPYMIASKEAVRE

SEQ ID NO: 6747 - protein, 25 aa, Homo sapiens
RELFQEMNIELVPPYMIASKEAVRE

SEQ ID NO: 6748 - protein, 25 aa, Homo sapiens
RELFQEMNIELVPPYMIASKEAVRE

SEQ ID NO: 6749 - protein, 25 aa, Homo sapiens
RELFQEMNIELVPPYMIASKEAVRE

SEQ ID NO: 6750 - protein, 25 aa, Homo sapiens
RELFQEMNIELVPPYMIASKEAVRE

SEQ ID NO: 6751 - protein, 25 aa, Homo sapiens
RELFQEMNIELVPPYMIASKEAVRE

SEQ ID NO: 6752 - protein, 11 aa, Homo sapiens
RKEKLPQVTRS

SEQ ID NO: 6753 - protein, 25 aa, Homo sapiens
RELFQEMNIELVPPYMIASKEAVRE

SEQ ID NO: 6754 - protein, 25 aa, Homo sapiens
RELFQEMNIELVPPYMIASKEAVRE

SEQ ID NO: 6755 - protein, 25 aa, Homo sapiens
RELFQEMNIELVPPYMIASKEAVRE

SEQ ID NO: 6756 - protein, 14 aa, Homo sapiens
KWVPVTDSKEKEKS

SEQ ID NO: 6757 - protein, 14 aa, Homo sapiens
KWVPVTDSKEKEKS

SEQ ID NO: 6758 - protein, 14 aa, Homo sapiens
KWVPVTDSKEKEKS

SEQ ID NO: 6759 - protein, 14 aa, Homo sapiens
KWVPVTDSKEKEKS

SEQ ID NO: 6760 - protein, 31 aa, Homo sapiens
KTFGQKPVKFQLEDDGEFYMIGSEVGNYLRM

SEQ ID NO: 6761 - protein, 17 aa, Homo sapiens
KYKAVSISTEPPTYLRE

SEQ ID NO: 6762 - protein, 8 aa, Homo sapiens
REQKAKRN

SEQ ID NO: 6763 - protein, 8 aa, Homo sapiens
REQKAKRN

SEQ ID NO: 6764 - protein, 8 aa, Homo sapiens
RGSLYKRY

SEQ ID NO: 6765 - protein, 8 aa, Homo sapiens
RGSLYKRY

SEQ ID NO: 6766 - protein, 8 aa, Homo sapiens
REQKAKRN

SEQ ID NO: 6767 - protein, 8 aa, Homo sapiens
REQKAKRN

SEQ ID NO: 6768 - protein, 13 aa, Homo sapiens
RLDMEIDGQKLRD

SEQ ID NO: 6769 - protein, 13 aa, Homo sapiens
RLDMEIDGQKLRD

SEQ ID NO: 6770 - protein, 9 aa, Homo sapiens
KKIRDQDRN

SEQ ID NO: 6771 - protein, 13 aa, Homo sapiens
RLDMEIDGQKLRD

SEQ ID NO: 6772 - protein, 13 aa, Homo sapiens
RLDMEIDGQKLRD

SEQ ID NO: 6773 - protein, 13 aa, Homo sapiens
RLDMEIDGQKLRD

SEQ ID NO: 6774 - protein, 13 aa, Homo sapiens
RLDMEIDGQKLRD

SEQ ID NO: 6775 - protein, 13 aa, Homo sapiens
RLDMEIDGQKLRD

SEQ ID NO: 6776 - protein, 13 aa, Homo sapiens
RLDMEIDGQKLRD

SEQ ID NO: 6777 - protein, 5 aa, Homo sapiens
KKIRD

SEQ ID NO: 6778 - protein, 13 aa, Homo sapiens
RLDMEIDGQKLRD

SEQ ID NO: 6779 - protein, 13 aa, Homo sapiens
RLDMEIDGQKLRD

SEQ ID NO: 6780 - protein, 13 aa, Homo sapiens
RLDMEIDGQKLRD

SEQ ID NO: 6781 - protein, 13 aa, Homo sapiens
RLDMEIDGQKLRD

SEQ ID NO: 6782 - protein, 16 aa, Homo sapiens
KLTKAVATYHANTERE

SEQ ID NO: 6783 - protein, 16 aa, Homo sapiens
KLTKAVATYHANTERE

SEQ ID NO: 6784 - protein, 10 aa, Homo sapiens
RSVTGKIQKL

SEQ ID NO: 6785 - protein, 19 aa, Homo sapiens
KLTKAVATYHANTEREQKK

SEQ ID NO: 6786 - protein, 18 aa, Homo sapiens
KKIPDPDSDDVSEVDARH

SEQ ID NO: 6787 - protein, 6 aa, Homo sapiens
KKDKRL

SEQ ID NO: 6788 - protein, 24 aa, Homo sapiens
RHIIENAKQDVDDEYGVSQALARG

SEQ ID NO: 6789 - protein, 19 aa, Homo sapiens
KVIHVESGKILTGTDAPKA

SEQ ID NO: 6790 - protein, 19 aa, Homo sapiens
KVIHVESGKILTGTDAPKA

SEQ ID NO: 6791 - protein, 19 aa, Homo sapiens
KVIHVESGKILTGTDAPKA

SEQ ID NO: 6792 - protein, 19 aa, Homo sapiens
KKKIPDPDSDDVSEVDARH

SEQ ID NO: 6793 - protein, 19 aa, Homo sapiens
KKKIPDPDSDDVSEVDARH

SEQ ID NO: 6794 - protein, 9 aa, Homo sapiens
RKEKAQDRL

SEQ ID NO: 6795 - protein, 10 aa, Homo sapiens
KYKDSSSGRQ

SEQ ID NO: 6796 - protein, 10 aa, Homo sapiens
KYKDSSSGRQ

SEQ ID NO: 6797 - protein, 10 aa, Homo sapiens
KYKDSSSGRQ

SEQ ID NO: 6798 - protein, 7 aa, Homo sapiens
KKIKERI

SEQ ID NO: 6799 - protein, 12 aa, Homo sapiens
KVSYKGSPAARR

SEQ ID NO: 6800 - protein, 7 aa, Homo sapiens
KIKLGRK

SEQ ID NO: 6801 - protein, 7 aa, Homo sapiens
RNHKYRS

SEQ ID NO: 6802 - protein, 9 aa, Homo sapiens
RIRNHKYRS

SEQ ID NO: 6803 - protein, 9 aa, Homo sapiens
RIRNHKYRS

SEQ ID NO: 6804 - protein, 12 aa, Homo sapiens
KVSYKGSPAARR

SEQ ID NO: 6805 - protein, 13 aa, Homo sapiens
RKELPEYYELIRK

SEQ ID NO: 6806 - protein, 13 aa, Homo sapiens
RKELPEYYELIRK

SEQ ID NO: 6807 - protein, 18 aa, Homo sapiens
RKRDSDAGSSTPTTSTRS

SEQ ID NO: 6808 - protein, 18 aa, Homo sapiens
RKRDSDAGSSTPTTSTRS

SEQ ID NO: 6809 - protein, 8 aa, Homo sapiens
RQKKSSRK

SEQ ID NO: 6810 - protein, 19 aa, Homo sapiens
RGRPPAEKLSPNPPNLTKK

SEQ ID NO: 6811 - protein, 36 aa, Homo sapiens
RKICNHPYMFQHIEESFSEHLGFTGGIVQGLDLYRA

SEQ ID NO: 6812 - protein, 15 aa, Homo sapiens
RLTCEEEEEKMFGRG

SEQ ID NO: 6813 - protein, 17 aa, Homo sapiens
KAVATYHANTEREQKKE

SEQ ID NO: 6814 - protein, 17 aa, Homo sapiens
KAVATYHANTEREQKKE

SEQ ID NO: 6815 - protein, 10 aa, Homo sapiens
REQKKENERI

SEQ ID NO: 6816 - protein, 10 aa, Homo sapiens
REQKKENERI

SEQ ID NO: 6817 - protein, 10 aa, Homo sapiens
REQKKENERI

SEQ ID NO: 6818 - protein, 17 aa, Homo sapiens
KAVATYHANTEREQKKE

SEQ ID NO: 6819 - protein, 11 aa, Homo sapiens
KENERIEKERM

SEQ ID NO: 6820 - protein, 17 aa, Homo sapiens
KAVATYHANTEREQKKE

SEQ ID NO: 6821 - protein, 17 aa, Homo sapiens
KAVATYHANTEREQKKE

SEQ ID NO: 6822 - protein, 17 aa, Homo sapiens
KAVATYHANTEREQKKE

SEQ ID NO: 6823 - protein, 17 aa, Homo sapiens
KAVATYHANTEREQKKE

SEQ ID NO: 6824 - protein, 17 aa, Homo sapiens
KAVATYHANTEREQKKE

SEQ ID NO: 6825 - protein, 17 aa, Homo sapiens
KAVATYHANTEREQKKE

SEQ ID NO: 6826 - protein, 17 aa, Homo sapiens
KAVATYHANTEREQKKE

SEQ ID NO: 6827 - protein, 17 aa, Homo sapiens
KAVATYHANTEREQKKE

SEQ ID NO: 6828 - protein, 17 aa, Homo sapiens
KAVATYHANTEREQKKE

SEQ ID NO: 6829 - protein, 17 aa, Homo sapiens
KAVATYHANTEREQKKE

SEQ ID NO: 6830 - protein, 17 aa, Homo sapiens
KAVATYHANTEREQKKE

SEQ ID NO: 6831 - protein, 17 aa, Homo sapiens
KAVATYHANTEREQKKE

SEQ ID NO: 6832 - protein, 11 aa, Homo sapiens
KENERIEKERM

SEQ ID NO: 6833 - protein, 17 aa, Homo sapiens
KAVATYHANTEREQKKE

SEQ ID NO: 6834 - protein, 17 aa, Homo sapiens
KAVATYHANTEREQKKE

SEQ ID NO: 6835 - protein, 17 aa, Homo sapiens
KAVATYHANTEREQKKE

SEQ ID NO: 6836 - protein, 18 aa, Homo sapiens
RGQPLPDHLQMAVQGKRP

SEQ ID NO: 6837 - protein, 18 aa, Homo sapiens
RGQPLPDHLQMAVQGKRP

SEQ ID NO: 6838 - protein, 12 aa, Homo sapiens
RYNQMKGMGMRS

SEQ ID NO: 6839 - protein, 12 aa, Homo sapiens
RYNQMKGMGMRS

SEQ ID NO: 6840 - protein, 12 aa, Homo sapiens
RYNQMKGMGMRS

SEQ ID NO: 6841 - protein, 18 aa, Homo sapiens
RGQPLPDHLQMAVQGKRP

SEQ ID NO: 6842 - protein, 12 aa, Homo sapiens
RYNQMKGMGMRS

SEQ ID NO: 6843 - protein, 7 aa, Homo sapiens
RIEKERM

SEQ ID NO: 6844 - protein, 11 aa, Homo sapiens
KENERIEKERM

SEQ ID NO: 6845 - protein, 11 aa, Homo sapiens
KENERIEKERM

SEQ ID NO: 6846 - protein, 11 aa, Homo sapiens
KENERIEKERM

SEQ ID NO: 6847 - protein, 11 aa, Homo sapiens
KENERIEKERM

SEQ ID NO: 6848 - protein, 11 aa, Homo sapiens
KENERIEKERM

SEQ ID NO: 6849 - protein, 11 aa, Homo sapiens
KENERIEKERM

SEQ ID NO: 6850 - protein, 11 aa, Homo sapiens
KENERIEKERM

SEQ ID NO: 6851 - protein, 11 aa, Homo sapiens
KENERIEKERM

SEQ ID NO: 6852 - protein, 13 aa, Homo sapiens
RQHKAAQVAKEKK

SEQ ID NO: 6853 - protein, 18 aa, Homo sapiens
RLCTVNSVEEKILAAAKY

SEQ ID NO: 6854 - protein, 18 aa, Homo sapiens
RLCTVNSVEEKILAAAKY

SEQ ID NO: 6855 - protein, 12 aa, Homo sapiens
KVSYKGSPAARR

SEQ ID NO: 6856 - protein, 24 aa, Homo sapiens
RGMLLKTFNEPGSEYFIFLLSTRA

SEQ ID NO: 6857 - protein, 24 aa, Homo sapiens
RGMLLKTFNEPGSEYFIFLLSTRA

SEQ ID NO: 6858 - protein, 13 aa, Homo sapiens
RKELPEYYELIRK

SEQ ID NO: 6859 - protein, 24 aa, Homo sapiens
RGMLLKTFNEPGSEYFIFLLSTRA

SEQ ID NO: 6860 - protein, 12 aa, Homo sapiens
KVSYKGSPAARR

SEQ ID NO: 6861 - protein, 12 aa, Homo sapiens
KVSYKGSPAARR

SEQ ID NO: 6862 - protein, 12 aa, Homo sapiens
KVSYKGSPAARR

SEQ ID NO: 6863 - protein, 12 aa, Homo sapiens
KVSYKGSPAARR

SEQ ID NO: 6864 - protein, 12 aa, Homo sapiens
KVSYKGSPAARR

SEQ ID NO: 6865 - protein, 9 aa, Homo sapiens
RKEKAQDRL

SEQ ID NO: 6866 - protein, 7 aa, Homo sapiens
RLKGGRR

SEQ ID NO: 6867 - protein, 7 aa, Homo sapiens
RLKGGRR

SEQ ID NO: 6868 - protein, 9 aa, Homo sapiens
KVKIKLGRK

SEQ ID NO: 6869 - protein, 6 aa, Homo sapiens
KVKIKL

SEQ ID NO: 6870 - protein, 18 aa, Homo sapiens
RGQPLPDHLQMAVQGKRP

SEQ ID NO: 6871 - protein, 18 aa, Homo sapiens
RGQPLPDHLQMAVQGKRP

SEQ ID NO: 6872 - protein, 13 aa, Homo sapiens
RAQIMAYKMLARG

SEQ ID NO: 6873 - protein, 12 aa, Homo sapiens
RYNQMKGMGMRS

SEQ ID NO: 6874 - protein, 22 aa, Homo sapiens
RLMEEDELPSWIIKDDAEVERL

SEQ ID NO: 6875 - protein, 22 aa, Homo sapiens
RLMEEDELPSWIIKDDAEVERL

SEQ ID NO: 6876 - protein, 22 aa, Homo sapiens
RLMEEDELPSWIIKDDAEVERL

SEQ ID NO: 6877 - protein, 15 aa, Homo sapiens
RLTCEEEEEKMFGRG

SEQ ID NO: 6878 - protein, 22 aa, Homo sapiens
RLMEEDELPSWIIKDDAEVERL

SEQ ID NO: 6879 - protein, 22 aa, Homo sapiens
RLMEEDELPSWIIKDDAEVERL

SEQ ID NO: 6880 - protein, 15 aa, Homo sapiens
RLTCEEEEEKMFGRG

SEQ ID NO: 6881 - protein, 22 aa, Homo sapiens
RLMEEDELPSWIIKDDAEVERL

SEQ ID NO: 6882 - protein, 15 aa, Homo sapiens
RLTCEEEEEKMFGRG

SEQ ID NO: 6883 - protein, 22 aa, Homo sapiens
RLMEEDELPSWIIKDDAEVERL

SEQ ID NO: 6884 - protein, 15 aa, Homo sapiens
RLTCEEEEEKMFGRG

SEQ ID NO: 6885 - protein, 15 aa, Homo sapiens
RLTCEEEEEKMFGRG

SEQ ID NO: 6886 - protein, 22 aa, Homo sapiens
RLMEEDELPSWIIKDDAEVERL

SEQ ID NO: 6887 - protein, 22 aa, Homo sapiens
RLMEEDELPSWIIKDDAEVERL

SEQ ID NO: 6888 - protein, 15 aa, Homo sapiens
RLTCEEEEEKMFGRG

SEQ ID NO: 6889 - protein, 15 aa, Homo sapiens
RLTCEEEEEKIFGRG

SEQ ID NO: 6890 - protein, 22 aa, Homo sapiens
RLMEEDELPSWIIKDDAEVERL

SEQ ID NO: 6891 - protein, 15 aa, Homo sapiens
RLTCEEEEEKMFGRG

SEQ ID NO: 6892 - protein, 15 aa, Homo sapiens
RLTCEEEEEKMFGRG

SEQ ID NO: 6893 - protein, 22 aa, Homo sapiens
RLMEEDELPSWIIKDDAEVERL

SEQ ID NO: 6894 - protein, 22 aa, Homo sapiens
RLMEEDELPSWIIKDDAEVERL

SEQ ID NO: 6895 - protein, 15 aa, Homo sapiens
RLTCEEEEEKMFGRG

SEQ ID NO: 6896 - protein, 15 aa, Homo sapiens
RLTCEEEEEKMFGRG

SEQ ID NO: 6897 - protein, 15 aa, Homo sapiens
RLTCEEEEEKMFGRG

SEQ ID NO: 6898 - protein, 22 aa, Homo sapiens
RLMEEDELPSWIIKDDAEVERL

SEQ ID NO: 6899 - protein, 15 aa, Homo sapiens
RLTCEEEEEKMFGRG

SEQ ID NO: 6900 - protein, 15 aa, Homo sapiens
RLTCEEEEEKMFGRG

SEQ ID NO: 6901 - protein, 15 aa, Homo sapiens
RLTCEEEEEKMFGRG

SEQ ID NO: 6902 - protein, 22 aa, Homo sapiens
RLMEEDELPSWIIKDDAEVERL

SEQ ID NO: 6903 - protein, 15 aa, Homo sapiens
RLTCEEEEEKMFGRG

SEQ ID NO: 6904 - protein, 22 aa, Homo sapiens
RLMEEDELPSWIIKDDAEVERL

SEQ ID NO: 6905 - protein, 15 aa, Homo sapiens
RLTCEEEEEKMFGRG

SEQ ID NO: 6906 - protein, 15 aa, Homo sapiens
RLTCEEEEEKMFGRG

SEQ ID NO: 6907 - protein, 15 aa, Homo sapiens
RLTCEEEEEKMFGRG

SEQ ID NO: 6908 - protein, 15 aa, Homo sapiens
RLTCEEEEEKMFGRG

SEQ ID NO: 6909 - protein, 22 aa, Homo sapiens
RLMEEDELPSWIIKDDAEVERL

SEQ ID NO: 6910 - protein, 15 aa, Homo sapiens
RLTCEEEEEKMFGRG

SEQ ID NO: 6911 - protein, 15 aa, Homo sapiens
RLTCEEEEEKMFGRG

SEQ ID NO: 6912 - protein, 15 aa, Homo sapiens
RLTCEEEEEKMFGRG

SEQ ID NO: 6913 - protein, 15 aa, Homo sapiens
RLTCEEEEEKMFGRG

SEQ ID NO: 6914 - protein, 22 aa, Homo sapiens
RLMEEDELPSWIIKDDAEVERL

SEQ ID NO: 6915 - protein, 15 aa, Homo sapiens
RLTCEEEEEKMFGRG

SEQ ID NO: 6916 - protein, 15 aa, Homo sapiens
RLTCEEEEEKMFGRG

SEQ ID NO: 6917 - protein, 22 aa, Homo sapiens
RLMEEDELPSWIIKDDAEVERL

SEQ ID NO: 6918 - protein, 15 aa, Homo sapiens
RLTCEEEEEKMFGRG

SEQ ID NO: 6919 - protein, 22 aa, Homo sapiens
RLMEEDELPSWIIKDDAEVERL

SEQ ID NO: 6920 - protein, 18 aa, Homo sapiens
KVIQAGMFDQKSSSHERR

SEQ ID NO: 6921 - protein, 18 aa, Homo sapiens
KVIQAGMFDQKSSSHERR

SEQ ID NO: 6922 - protein, 18 aa, Homo sapiens
RKRDSDAGSSTPTTSTRS

SEQ ID NO: 6923 - protein, 18 aa, Homo sapiens
KVIQAGMFDQKSSSHERR

SEQ ID NO: 6924 - protein, 18 aa, Homo sapiens
KVIQAGMFDQKSSSHERR

SEQ ID NO: 6925 - protein, 18 aa, Homo sapiens
KVIQAGMFDQKSSSHERR

SEQ ID NO: 6926 - protein, 18 aa, Homo sapiens
KVIQAGMFDQKSSSHERR

SEQ ID NO: 6927 - protein, 19 aa, Homo sapiens
KVIQAGMFDQKSSSHERRA

SEQ ID NO: 6928 - protein, 12 aa, Homo sapiens
KVSYKGSPAARR

SEQ ID NO: 6929 - protein, 7 aa, Homo sapiens
RLKGGRR

SEQ ID NO: 6930 - protein, 7 aa, Homo sapiens
RSVKVKI

SEQ ID NO: 6931 - protein, 18 aa, Homo sapiens
RKRDSDAGSSTPTTSTRS

SEQ ID NO: 6932 - protein, 15 aa, Homo sapiens
RLTCEEEEEKMFGRG

SEQ ID NO: 6933 - protein, 16 aa, Homo sapiens
RHRKEVDYSDSLTEKQ

SEQ ID NO: 6934 - protein, 16 aa, Homo sapiens
RHRKEVDYSDSLTEKQ

SEQ ID NO: 6935 - protein, 8 aa, Homo sapiens
RGFKYLRL

SEQ ID NO: 6936 - protein, 13 aa, Homo sapiens
RKELPEYYELIRK

SEQ ID NO: 6937 - protein, 12 aa, Homo sapiens
RLDGTTKAEDRG

SEQ ID NO: 6938 - protein, 12 aa, Homo sapiens
RLDGTTKAEDRG

SEQ ID NO: 6939 - protein, 12 aa, Homo sapiens
RLDGTTKAEDRG

SEQ ID NO: 6940 - protein, 19 aa, Homo sapiens
RGRPPAEKLSPNPPNLTKK

SEQ ID NO: 6941 - protein, 7 aa, Homo sapiens
RNHKYRS

SEQ ID NO: 6942 - protein, 19 aa, Homo sapiens
KKKIPDPDSDDVSEVDARH

SEQ ID NO: 6943 - protein, 18 aa, Homo sapiens
KKIPDPDSDDVSEVDARH

SEQ ID NO: 6944 - protein, 18 aa, Homo sapiens
KKIPDPDSDDVSEVDARH

SEQ ID NO: 6945 - protein, 24 aa, Homo sapiens
RHIIENAKQDVDDEYGVSQALARG

SEQ ID NO: 6946 - protein, 24 aa, Homo sapiens
RHIIENAKQDVDDEYGVSQALARG

SEQ ID NO: 6947 - protein, 24 aa, Homo sapiens
RHIIENAKQDVDDEYGVSQALARG

SEQ ID NO: 6948 - protein, 18 aa, Homo sapiens
KTIQTIALITYLMEHKRI

SEQ ID NO: 6949 - protein, 18 aa, Homo sapiens
RKRDSDAGSSTPTTSTRS

SEQ ID NO: 6950 - protein, 18 aa, Homo sapiens
RKRDSDAGSSTPTTSTRS

SEQ ID NO: 6951 - protein, 18 aa, Homo sapiens
RKRDSDAGSSTPTTSTRS

SEQ ID NO: 6952 - protein, 18 aa, Homo sapiens
RKRDSDAGSSTPTTSTRS

SEQ ID NO: 6953 - protein, 9 aa, Homo sapiens
RKEKAQDRL

SEQ ID NO: 6954 - protein, 18 aa, Homo sapiens
RKRDSDAGSSTPTTSTRS

SEQ ID NO: 6955 - protein, 19 aa, Homo sapiens
RGRPPAEKLSPNPPNLTKK

SEQ ID NO: 6956 - protein, 18 aa, Homo sapiens
RKRDSDAGSSTPTTSTRS

SEQ ID NO: 6957 - protein, 18 aa, Homo sapiens
RKRDSDAGSSTPTTSTRS

SEQ ID NO: 6958 - protein, 18 aa, Homo sapiens
RKRDSDAGSSTPTTSTRS

SEQ ID NO: 6959 - protein, 18 aa, Homo sapiens
RKRDSDAGSSTPTTSTRS

SEQ ID NO: 6960 - protein, 19 aa, Homo sapiens
KVIHVESGKILTGTDAPKA

SEQ ID NO: 6961 - protein, 18 aa, Homo sapiens
RKRDSDAGSSTPTTSTRS

SEQ ID NO: 6962 - protein, 18 aa, Homo sapiens
RKRDSDAGSSTPTTSTRS

SEQ ID NO: 6963 - protein, 18 aa, Homo sapiens
RKRDSDAGSSTPTTSTRS

SEQ ID NO: 6964 - protein, 18 aa, Homo sapiens
RKRDSDAGSSTPTTSTRS

SEQ ID NO: 6965 - protein, 18 aa, Homo sapiens
RKRDSDAGSSTPTTSTRS

SEQ ID NO: 6966 - protein, 18 aa, Homo sapiens
RKRDSDAGSSTPTTSTRS

SEQ ID NO: 6967 - protein, 18 aa, Homo sapiens
RKRDSDAGSSTPTTSTRS

SEQ ID NO: 6968 - protein, 18 aa, Homo sapiens
RKRDSDAGSSTPTTSTRS

SEQ ID NO: 6969 - protein, 18 aa, Homo sapiens
RKRDSDAGSSTPTTSTRS

SEQ ID NO: 6970 - protein, 18 aa, Homo sapiens
RKRDSDAGSSTPTTSTRS

SEQ ID NO: 6971 - protein, 15 aa, Homo sapiens
RLTCEEEEEKMFGRG

SEQ ID NO: 6972 - protein, 15 aa, Homo sapiens
RLTCEEEEEKMFGRG

SEQ ID NO: 6973 - protein, 15 aa, Homo sapiens
RLTCEEEEEKMFGRG

SEQ ID NO: 6974 - protein, 15 aa, Homo sapiens
RLTCEEEEEKMFGRG

SEQ ID NO: 6975 - protein, 15 aa, Homo sapiens
RLTCEEEEEKMFGRG

SEQ ID NO: 6976 - protein, 16 aa, Homo sapiens
RHRKEVDYSDSLTEKQ

SEQ ID NO: 6977 - protein, 18 aa, Homo sapiens
RKRDSDAGSSTPTTSTRS

SEQ ID NO: 6978 - protein, 18 aa, Homo sapiens
RKRDSDAGSSTPTTSTRS

SEQ ID NO: 6979 - protein, 18 aa, Homo sapiens
RKRDSDAGSSTPTTSTRS

SEQ ID NO: 6980 - protein, 18 aa, Homo sapiens
RKRDSDAGSSTPTTSTRS

SEQ ID NO: 6981 - protein, 15 aa, Homo sapiens
RLTCEEEEEKMFGRG

SEQ ID NO: 6982 - protein, 6 aa, Homo sapiens
KKDKRL

SEQ ID NO: 6983 - protein, 18 aa, Homo sapiens
KKIPDPDSDDVSEVDARH

SEQ ID NO: 6984 - protein, 13 aa, Homo sapiens
RKELPEYYELIRK

SEQ ID NO: 6985 - protein, 13 aa, Homo sapiens
RKELPEYYELIRK

SEQ ID NO: 6986 - protein, 13 aa, Homo sapiens
RKELPEYYELIRK

SEQ ID NO: 6987 - protein, 19 aa, Homo sapiens
KVIHVESGKILTGTDAPKA

SEQ ID NO: 6988 - protein, 13 aa, Homo sapiens
RKELPEYYELIRK

SEQ ID NO: 6989 - protein, 13 aa, Homo sapiens
RKELPEYYELIRK

SEQ ID NO: 6990 - protein, 13 aa, Homo sapiens
RKELPEYYELIRK

SEQ ID NO: 6991 - protein, 7 aa, Homo sapiens
RLKGGRR

SEQ ID NO: 6992 - protein, 9 aa, Homo sapiens
RKEKAQDRL

SEQ ID NO: 6993 - protein, 10 aa, Homo sapiens
KQQKIEQERK

SEQ ID NO: 6994 - protein, 10 aa, Homo sapiens
KQQKIEQERK

SEQ ID NO: 6995 - protein, 11 aa, Homo sapiens
KQQKIEQERKR

SEQ ID NO: 6996 - protein, 9 aa, Homo sapiens
RITEKLEKQ

SEQ ID NO: 6997 - protein, 13 aa, Homo sapiens
RWKYMIVDEGHRM

SEQ ID NO: 6998 - protein, 24 aa, Homo sapiens
RHIIENAKQDVDDEYGVSQALARG

SEQ ID NO: 6999 - protein, 24 aa, Homo sapiens
RHIIENAKQDVDDEYGVSQALARG

SEQ ID NO: 7000 - protein, 19 aa, Homo sapiens
KKKIPDPDSDDVSEVDARH

SEQ ID NO: 7001 - protein, 19 aa, Homo sapiens
KKKIPDPDSDDVSEVDARH

SEQ ID NO: 7002 - protein, 19 aa, Homo sapiens
KKKIPDPDSDDVSEVDARH

SEQ ID NO: 7003 - protein, 11 aa, Homo sapiens
RSRDKDDESKK

SEQ ID NO: 7004 - protein, 11 aa, Homo sapiens
RSRDKDDESKK

SEQ ID NO: 7005 - protein, 9 aa, Homo sapiens
RIRNHKYRS

SEQ ID NO: 7006 - protein, 19 aa, Homo sapiens
KKKIPDPDSDDVSEVDARH

SEQ ID NO: 7007 - protein, 18 aa, Homo sapiens
KKIPDPDSDDVSEVDARH

SEQ ID NO: 7008 - protein, 18 aa, Homo sapiens
KKIPDPDSDDVSEVDARH

SEQ ID NO: 7009 - protein, 19 aa, Homo sapiens
KKKIPDPDSDDVSEVDARH

SEQ ID NO: 7010 - protein, 19 aa, Homo sapiens
KKKIPDPDSDDVSEVDARH

SEQ ID NO: 7011 - protein, 19 aa, Homo sapiens
KKKIPDPDSDDVSEVDARH

SEQ ID NO: 7012 - protein, 19 aa, Homo sapiens
KKKIPDPDSDDVSEVDARH

SEQ ID NO: 7013 - protein, 19 aa, Homo sapiens
KKKIPDPDSDDVSEVDARH

SEQ ID NO: 7014 - protein, 15 aa, Homo sapiens
RLTCEEEEEKMFGRG

SEQ ID NO: 7015 - protein, 15 aa, Homo sapiens
RLTCEEEEEKMFGRG

SEQ ID NO: 7016 - protein, 18 aa, Homo sapiens
RKRDSDAGSSTPTTSTRS

SEQ ID NO: 7017 - protein, 18 aa, Homo sapiens
RKRDSDAGSSTPTTSTRS

SEQ ID NO: 7018 - protein, 16 aa, Homo sapiens
RHRKEVDYSDSLTEKQ

SEQ ID NO: 7019 - protein, 16 aa, Homo sapiens
RHRKEVDYSDSLTEKQ

SEQ ID NO: 7020 - protein, 16 aa, Homo sapiens
RHRKEVDYSDSLTEKQ

SEQ ID NO: 7021 - protein, 15 aa, Homo sapiens
RLTCEEEEEKMFGRG

SEQ ID NO: 7022 - protein, 15 aa, Homo sapiens
RLTCEEEEEKMFGRG

SEQ ID NO: 7023 - protein, 12 aa, Homo sapiens
RLDGTTKAEDRG

SEQ ID NO: 7024 - protein, 15 aa, Homo sapiens
RLTCEEEEEKMFGRG

SEQ ID NO: 7025 - protein, 18 aa, Homo sapiens
RKRDSDAGSSTPTTSTRS

SEQ ID NO: 7026 - protein, 18 aa, Homo sapiens
RKRDSDAGSSTPTTSTRS

SEQ ID NO: 7027 - protein, 18 aa, Homo sapiens
RKRDSDAGSSTPTTSTRS

SEQ ID NO: 7028 - protein, 18 aa, Homo sapiens
RKRDSDAGSSTPTTSTRS

SEQ ID NO: 7029 - protein, 18 aa, Homo sapiens
RKRDSDAGSSTPTTSTRS

SEQ ID NO: 7030 - protein, 12 aa, Homo sapiens
RLDGTTKAEDRG

SEQ ID NO: 7031 - protein, 12 aa, Homo sapiens
RLDGTTKAEDRG

SEQ ID NO: 7032 - protein, 12 aa, Homo sapiens
RLDGTTKAEDRG

SEQ ID NO: 7033 - protein, 12 aa, Homo sapiens
RLDGTTKAEDRG

SEQ ID NO: 7034 - protein, 16 aa, Homo sapiens
RHRKEVDYSDSLTEKQ

SEQ ID NO: 7035 - protein, 12 aa, Homo sapiens
RLDGTTKAEDRG

SEQ ID NO: 7036 - protein, 16 aa, Homo sapiens
RHRKEVDYSDSLTEKQ

SEQ ID NO: 7037 - protein, 16 aa, Homo sapiens
RHRKEVDYSDSLTEKQ

SEQ ID NO: 7038 - protein, 13 aa, Homo sapiens
RKELPEYYELIRK

SEQ ID NO: 7039 - protein, 12 aa, Homo sapiens
RLDGTTKAEDRG

SEQ ID NO: 7040 - protein, 9 aa, Homo sapiens
RKEKAQDRL

SEQ ID NO: 7041 - protein, 15 aa, Homo sapiens
KYLRLDGTTKAEDRG

SEQ ID NO: 7042 - protein, 8 aa, Homo sapiens
RQKKSSRK

SEQ ID NO: 7043 - protein, 12 aa, Homo sapiens
RLDGTTKAEDRG

SEQ ID NO: 7044 - protein, 12 aa, Homo sapiens
RLDGTTKAEDRG

SEQ ID NO: 7045 - protein, 15 aa, Homo sapiens
KYLRLDGTTKAEDRG

SEQ ID NO: 7046 - protein, 12 aa, Homo sapiens
RLDGTTKAEDRG

SEQ ID NO: 7047 - protein, 15 aa, Homo sapiens
KYLRLDGTTKAEDRG

SEQ ID NO: 7048 - protein, 12 aa, Homo sapiens
RLDGTTKAEDRG

SEQ ID NO: 7049 - protein, 12 aa, Homo sapiens
RLDGTTKAEDRG

SEQ ID NO: 7050 - protein, 12 aa, Homo sapiens
RLDGTTKAEDRG

SEQ ID NO: 7051 - protein, 12 aa, Homo sapiens
RLDGTTKAEDRG

SEQ ID NO: 7052 - protein, 12 aa, Homo sapiens
RLDGTTKAEDRG

SEQ ID NO: 7053 - protein, 12 aa, Homo sapiens
RLDGTTKAEDRG

SEQ ID NO: 7054 - protein, 11 aa, Homo sapiens
KIVDAVIKYKD

SEQ ID NO: 7055 - protein, 7 aa, Homo sapiens
RLKGGRR

SEQ ID NO: 7056 - protein, 7 aa, Homo sapiens
RLKGGRR

SEQ ID NO: 7057 - protein, 7 aa, Homo sapiens
RLKGGRR

SEQ ID NO: 7058 - protein, 7 aa, Homo sapiens
RLKGGRR

SEQ ID NO: 7059 - protein, 19 aa, Homo sapiens
RGRPPAEKLSPNPPNLTKK

SEQ ID NO: 7060 - protein, 19 aa, Homo sapiens
RGRPPAEKLSPNPPNLTKK

SEQ ID NO: 7061 - protein, 19 aa, Homo sapiens
RGRPPAEKLSPNPPNLTKK

SEQ ID NO: 7062 - protein, 19 aa, Homo sapiens
RGRPPAEKLSPNPPNLTKK

SEQ ID NO: 7063 - protein, 19 aa, Homo sapiens
RGRPPAEKLSPNPPNLTKK

SEQ ID NO: 7064 - protein, 19 aa, Homo sapiens
RGRPPAEKLSPNPPNLTKK

SEQ ID NO: 7065 - protein, 19 aa, Homo sapiens
RGRPPAEKLSPNPPNLTKK

SEQ ID NO: 7066 - protein, 19 aa, Homo sapiens
RGRPPAEKLSPNPPNLTKK

SEQ ID NO: 7067 - protein, 19 aa, Homo sapiens
RGRPPAEKLSPNPPNLTKK

SEQ ID NO: 7068 - protein, 19 aa, Homo sapiens
RGRPPAEKLSPNPPNLTKK

SEQ ID NO: 7069 - protein, 19 aa, Homo sapiens
RGRPPAEKLSPNPPNLTKK

SEQ ID NO: 7070 - protein, 19 aa, Homo sapiens
RGRPPAEKLSPNPPNLTKK

SEQ ID NO: 7071 - protein, 19 aa, Homo sapiens
RGRPPAEKLSPNPPNLTKK

SEQ ID NO: 7072 - protein, 19 aa, Homo sapiens
RGRPPAEKLSPNPPNLTKK

SEQ ID NO: 7073 - protein, 19 aa, Homo sapiens
RGRPPAEKLSPNPPNLTKK

SEQ ID NO: 7074 - protein, 19 aa, Homo sapiens
RGRPPAEKLSPNPPNLTKK

SEQ ID NO: 7075 - protein, 19 aa, Homo sapiens
RGRPPAEKLSPNPPNLTKK

SEQ ID NO: 7076 - protein, 19 aa, Homo sapiens
RGRPPAEKLSPNPPNLTKK

SEQ ID NO: 7077 - protein, 19 aa, Homo sapiens
RGRPPAEKLSPNPPNLTKK

SEQ ID NO: 7078 - protein, 19 aa, Homo sapiens
RGRPPAEKLSPNPPNLTKK

SEQ ID NO: 7079 - protein, 7 aa, Homo sapiens
RLKGGRR

SEQ ID NO: 7080 - protein, 19 aa, Homo sapiens
RGRPPAEKLSPNPPNLTKK

SEQ ID NO: 7081 - protein, 19 aa, Homo sapiens
RGRPPAEKLSPNPPNLTKK

SEQ ID NO: 7082 - protein, 19 aa, Homo sapiens
RGRPPAEKLSPNPPNLTKK

SEQ ID NO: 7083 - protein, 19 aa, Homo sapiens
RGRPPAEKLSPNPPNLTKK

SEQ ID NO: 7084 - protein, 16 aa, Homo sapiens
RHRKEVDYSDSLTEKQ

SEQ ID NO: 7085 - protein, 16 aa, Homo sapiens
RHRKEVDYSDSLTEKQ

SEQ ID NO: 7086 - protein, 16 aa, Homo sapiens
RHRKEVDYSDSLTEKQ

SEQ ID NO: 7087 - protein, 13 aa, Homo sapiens
RKELPEYYELIRK

SEQ ID NO: 7088 - protein, 13 aa, Homo sapiens
RKELPEYYELIRK

SEQ ID NO: 7089 - protein, 16 aa, Homo sapiens
RHRKEVDYSDSLTEKQ

SEQ ID NO: 7090 - protein, 14 aa, Homo sapiens
RKEVDYSDSLTEKQ

SEQ ID NO: 7091 - protein, 16 aa, Homo sapiens
RHRKEVDYSDSLTEKQ

SEQ ID NO: 7092 - protein, 16 aa, Homo sapiens
RHRKEVDYSDSLTEKQ

SEQ ID NO: 7093 - protein, 16 aa, Homo sapiens
RHRKEVDYSDSLTEKQ

SEQ ID NO: 7094 - protein, 18 aa, Homo sapiens
RKRDSDAGSSTPTTSTRS

SEQ ID NO: 7095 - protein, 16 aa, Homo sapiens
RHRKEVDYSDSLTEKQ

SEQ ID NO: 7096 - protein, 16 aa, Homo sapiens
RHRKEVDYSDSLTEKQ

SEQ ID NO: 7097 - protein, 7 aa, Homo sapiens
RNHKYRS

SEQ ID NO: 7098 - protein, 16 aa, Homo sapiens
RHRKEVDYSDSLTEKQ

SEQ ID NO: 7099 - protein, 19 aa, Homo sapiens
RGRPPAEKLSPNPPNLTKK

SEQ ID NO: 7100 - protein, 7 aa, Homo sapiens
RSVKVKI

SEQ ID NO: 7101 - protein, 12 aa, Homo sapiens
KVSYKGSPAARR

SEQ ID NO: 7102 - protein, 27 aa, Homo sapiens
RAKPVVSDDDSEEEQEEDRSGSGSEED

SEQ ID NO: 7103 - protein, 27 aa, Homo sapiens
RAKPVVSDDDSEEEQEEDRSGSGSEED

SEQ ID NO: 7104 - protein, 19 aa, Homo sapiens
KVIHVESGKILTGTDAPKA

SEQ ID NO: 7105 - protein, 7 aa, Homo sapiens
RLKGGRR

SEQ ID NO: 7106 - protein, 7 aa, Homo sapiens
RLKGGRR

SEQ ID NO: 7107 - protein, 9 aa, Homo sapiens
RKEKAQDRL

SEQ ID NO: 7108 - protein, 7 aa, Homo sapiens
KIKLGRK

SEQ ID NO: 7109 - protein, 7 aa, Homo sapiens
KIKLGRK

SEQ ID NO: 7110 - protein, 9 aa, Homo sapiens
RKEKAQDRL

SEQ ID NO: 7111 - protein, 9 aa, Homo sapiens
KVKIKLGRK

SEQ ID NO: 7112 - protein, 7 aa, Homo sapiens
KIKLGRK

SEQ ID NO: 7113 - protein, 7 aa, Homo sapiens
KIKLGRK

SEQ ID NO: 7114 - protein, 7 aa, Homo sapiens
KIKLGRK

SEQ ID NO: 7115 - protein, 7 aa, Homo sapiens
KIKLGRK

SEQ ID NO: 7116 - protein, 9 aa, Homo sapiens
RKEKAQDRL

SEQ ID NO: 7117 - protein, 12 aa, Homo sapiens
KKIVDAVIKYKD

SEQ ID NO: 7118 - protein, 11 aa, Homo sapiens
KIVDAVIKYKD

SEQ ID NO: 7119 - protein, 11 aa, Homo sapiens
KIVDAVIKYKD

SEQ ID NO: 7120 - protein, 11 aa, Homo sapiens
KIVDAVIKYKD

SEQ ID NO: 7121 - protein, 24 aa, Homo sapiens
RHIIENAKQDVDDEYGVSQALARG

SEQ ID NO: 7122 - protein, 24 aa, Homo sapiens
RHIIENAKQDVDDEYGVSQALARG

SEQ ID NO: 7123 - protein, 24 aa, Homo sapiens
RHIIENAKQDVDDEYGVSQALARG

SEQ ID NO: 7124 - protein, 24 aa, Homo sapiens
RHIIENAKQDVDDEYGVSQALARG

SEQ ID NO: 7125 - protein, 24 aa, Homo sapiens
RHIIENAKQDVDDEYGVSQALARG

SEQ ID NO: 7126 - protein, 24 aa, Homo sapiens
RHIIENAKQDVDDEYGVSQALARG

SEQ ID NO: 7127 - protein, 13 aa, Homo sapiens
RWKYMIVDEGHRM

SEQ ID NO: 7128 - protein, 24 aa, Homo sapiens
RHIIENAKQDVDDEYGVSQALARG

SEQ ID NO: 7129 - protein, 13 aa, Homo sapiens
RWKYMIVDEGHRM

SEQ ID NO: 7130 - protein, 24 aa, Homo sapiens
RHIIENAKQDVDDEYGVSQALARG

SEQ ID NO: 7131 - protein, 24 aa, Homo sapiens
RHIIENAKQDVDDEYGVSQALARG

SEQ ID NO: 7132 - protein, 7 aa, Homo sapiens
RIEKERM

SEQ ID NO: 7133 - protein, 7 aa, Homo sapiens
RIEKERM

SEQ ID NO: 7134 - protein, 9 aa, Homo sapiens
RKLIDQKKD

SEQ ID NO: 7135 - protein, 10 aa, Homo sapiens
KKENERIEKE

SEQ ID NO: 7136 - protein, 18 aa, Homo sapiens
RKRDSDAGSSTPTTSTRS

SEQ ID NO: 7137 - protein, 12 aa, Homo sapiens
KVSYKGSPAARR

SEQ ID NO: 7138 - protein, 12 aa, Homo sapiens
KVSYKGSPAARR

SEQ ID NO: 7139 - protein, 13 aa, Homo sapiens
RKELPEYYELIRK

SEQ ID NO: 7140 - protein, 13 aa, Homo sapiens
RKELPEYYELIRK

SEQ ID NO: 7141 - protein, 18 aa, Homo sapiens
RKRDSDAGSSTPTTSTRS

SEQ ID NO: 7142 - protein, 10 aa, Homo sapiens
REEARNPKRK

SEQ ID NO: 7143 - protein, 10 aa, Homo sapiens
REEARNPKRK

SEQ ID NO: 7144 - protein, 8 aa, Homo sapiens
RQKKSSRK

SEQ ID NO: 7145 - protein, 8 aa, Homo sapiens
RQKKSSRK

SEQ ID NO: 7146 - protein, 8 aa, Homo sapiens
RQKKSSRK

SEQ ID NO: 7147 - protein, 8 aa, Homo sapiens
RQKKSSRK

SEQ ID NO: 7148 - protein, 11 aa, Homo sapiens
KVMATIEKVRR

SEQ ID NO: 7149 - protein, 17 aa, Homo sapiens
RIFKWVPVVDPQEEERR

SEQ ID NO: 7150 - protein, 9 aa, Homo sapiens
RAKDDIKKV

SEQ ID NO: 7151 - protein, 11 aa, Homo sapiens
KVMATIEKVRR

SEQ ID NO: 7152 - protein, 9 aa, Homo sapiens
RAKDDIKKV

SEQ ID NO: 7153 - protein, 9 aa, Homo sapiens
RAKDDIKKV

SEQ ID NO: 7154 - protein, 17 aa, Homo sapiens
RIFKWVPVVDPQEEERR

SEQ ID NO: 7155 - protein, 17 aa, Homo sapiens
RIFKWVPVVDPQEEERR

SEQ ID NO: 7156 - protein, 17 aa, Homo sapiens
RIFKWVPVVDPQEEERR

SEQ ID NO: 7157 - protein, 17 aa, Homo sapiens
RIFKWVPVVDPQEEERR

SEQ ID NO: 7158 - protein, 13 aa, Homo sapiens
KKWVTVGDTSLRI

SEQ ID NO: 7159 - protein, 13 aa, Homo sapiens
KKWVTVGDTSLRI

SEQ ID NO: 7160 - protein, 9 aa, Homo sapiens
RAKDDIKRV

SEQ ID NO: 7161 - protein, 13 aa, Homo sapiens
RIYKWVPVTEPKV

SEQ ID NO: 7162 - protein, 9 aa, Homo sapiens
RAKDDIKRV

SEQ ID NO: 7163 - protein, 13 aa, Homo sapiens
RIYKWVPVTEPKV

SEQ ID NO: 7164 - protein, 13 aa, Homo sapiens
RIYKWVPVTEPKV

SEQ ID NO: 7165 - protein, 13 aa, Homo sapiens
RIYKWVPVTEPKV

SEQ ID NO: 7166 - protein, 9 aa, Homo sapiens
RAKDDIKRV

SEQ ID NO: 7167 - protein, 9 aa, Homo sapiens
RAKDDIKRV

SEQ ID NO: 7168 - protein, 9 aa, Homo sapiens
RAKDDIKRV

SEQ ID NO: 7169 - protein, 11 aa, Homo sapiens
RVMAAIEKVRK

SEQ ID NO: 7170 - protein, 11 aa, Homo sapiens
RVMAAIEKVRK

SEQ ID NO: 7171 - protein, 9 aa, Homo sapiens
RAKDDIKRV

SEQ ID NO: 7172 - protein, 9 aa, Homo sapiens
RAKDDIKRV

SEQ ID NO: 7173 - protein, 11 aa, Homo sapiens
RVMAAIEKVRK

SEQ ID NO: 7174 - protein, 11 aa, Homo sapiens
RVMAAIEKVRK

SEQ ID NO: 7175 - protein, 11 aa, Homo sapiens
RVMAAIEKVRK

SEQ ID NO: 7176 - protein, 11 aa, Homo sapiens
RVMAAIEKVRK

SEQ ID NO: 7177 - protein, 11 aa, Homo sapiens
RVMAAIEKVRK

SEQ ID NO: 7178 - protein, 9 aa, Homo sapiens
RAKDDIKRV

SEQ ID NO: 7179 - protein, 11 aa, Homo sapiens
RVMAAIEKVRK

SEQ ID NO: 7180 - protein, 13 aa, Homo sapiens
KKWVTVGDTSLRI

SEQ ID NO: 7181 - protein, 9 aa, Homo sapiens
RAKDDIKRV

SEQ ID NO: 7182 - protein, 13 aa, Homo sapiens
RIYKWVPVTEPKV

SEQ ID NO: 7183 - protein, 13 aa, Homo sapiens
RIYKWVPVTEPKV

SEQ ID NO: 7184 - protein, 13 aa, Homo sapiens
RIYKWVPVTEPKV

SEQ ID NO: 7185 - protein, 13 aa, Homo sapiens
RIYKWVPVTEPKV

SEQ ID NO: 7186 - protein, 13 aa, Homo sapiens
RIYKWVPVTEPKV

SEQ ID NO: 7187 - protein, 13 aa, Homo sapiens
KKWVTVGDTSLRI

SEQ ID NO: 7188 - protein, 13 aa, Homo sapiens
KKWVTVGDTSLRI

SEQ ID NO: 7189 - protein, 16 aa, Homo sapiens
KWVPVTEPKVDDKNKN

SEQ ID NO: 7190 - protein, 16 aa, Homo sapiens
KWVPVTEPKVDDKNKN

SEQ ID NO: 7191 - protein, 11 aa, Homo sapiens
RVMAAIEKVRK

SEQ ID NO: 7192 - protein, 11 aa, Homo sapiens
RVMAAIEKVRK

SEQ ID NO: 7193 - protein, 10 aa, Homo sapiens
KVDDKNKNKK

SEQ ID NO: 7194 - protein, 12 aa, Homo sapiens
RVMAAIEKVRKW

SEQ ID NO: 7195 - protein, 11 aa, Homo sapiens
RVMAAIEKVRK

SEQ ID NO: 7196 - protein, 13 aa, Homo sapiens
KKWVTVGDTSLRI

SEQ ID NO: 7197 - protein, 13 aa, Homo sapiens
KKWVTVGDTSLRI

SEQ ID NO: 7198 - protein, 11 aa, Homo sapiens
RVMAAIEKVRK

SEQ ID NO: 7199 - protein, 11 aa, Homo sapiens
RVMAAIEKVRK

SEQ ID NO: 7200 - protein, 11 aa, Homo sapiens
RVMAAIEKVRK

SEQ ID NO: 7201 - protein, 13 aa, Homo sapiens
RIYKWVPVTEPKV

SEQ ID NO: 7202 - protein, 11 aa, Homo sapiens
RVMAAIEKVRK

SEQ ID NO: 7203 - protein, 11 aa, Homo sapiens
RVMAAIEKVRK

SEQ ID NO: 7204 - protein, 13 aa, Homo sapiens
RIYKWVPVTEPKV

SEQ ID NO: 7205 - protein, 11 aa, Homo sapiens
RVMAAIEKVRK

SEQ ID NO: 7206 - protein, 7 aa, Homo sapiens
RKWEKKW

SEQ ID NO: 7207 - protein, 11 aa, Homo sapiens
RVMAAIEKVRK

SEQ ID NO: 7208 - protein, 6 aa, Homo sapiens
RKWEKK

SEQ ID NO: 7209 - protein, 11 aa, Homo sapiens
RVMAAIEKVRK

SEQ ID NO: 7210 - protein, 11 aa, Homo sapiens
RVMAAIEKVRK

SEQ ID NO: 7211 - protein, 11 aa, Homo sapiens
RVMAAIEKVRK

SEQ ID NO: 7212 - protein, 6 aa, Homo sapiens
RKWEKK

SEQ ID NO: 7213 - protein, 11 aa, Homo sapiens
RVMAAIEKVRK

SEQ ID NO: 7214 - protein, 11 aa, Homo sapiens
KIKIIAPPERK

SEQ ID NO: 7215 - protein, 42 aa, Homo sapiens
KSIIATIDDVLSARPGALPEDANPGPQTESSKFPFGIQQAKS

SEQ ID NO: 7216 - protein, 12 aa, Homo sapiens
KFDKLPIKIVKK

SEQ ID NO: 7217 - protein, 12 aa, Homo sapiens
KFDKLPIKIVKK

SEQ ID NO: 7218 - protein, 11 aa, Homo sapiens
KKNNLFVVDRS

SEQ ID NO: 7219 - protein, 12 aa, Homo sapiens
KFDKLPIKIVKK

SEQ ID NO: 7220 - protein, 12 aa, Homo sapiens
KFDKLPIKIVKK

SEQ ID NO: 7221 - protein, 9 aa, Homo sapiens
KLPIKIVKK

SEQ ID NO: 7222 - protein, 12 aa, Homo sapiens
KFDKLPIKIVKK

SEQ ID NO: 7223 - protein, 12 aa, Homo sapiens
KFDKLPIKIVKK

SEQ ID NO: 7224 - protein, 15 aa, Homo sapiens
KITKVYELGNEPERK

SEQ ID NO: 7225 - protein, 16 aa, Homo sapiens
RKLWVDRYLTFMEERG

SEQ ID NO: 7226 - protein, 15 aa, Homo sapiens
KITKVYELGNEPERK

SEQ ID NO: 7227 - protein, 15 aa, Homo sapiens
KITKVYELGNEPERK

SEQ ID NO: 7228 - protein, 15 aa, Homo sapiens
KITKVYELGNEPERK

SEQ ID NO: 7229 - protein, 16 aa, Homo sapiens
KITKVYELGNEPERKL

SEQ ID NO: 7230 - protein, 15 aa, Homo sapiens
KITKVYELGNEPERK

SEQ ID NO: 7231 - protein, 15 aa, Homo sapiens
KITKVYELGNEPERK

SEQ ID NO: 7232 - protein, 16 aa, Homo sapiens
RMPYEPNKDPFGGMRK

SEQ ID NO: 7233 - protein, 16 aa, Homo sapiens
RMPYEPNKDPFGGMRK

SEQ ID NO: 7234 - protein, 23 aa, Homo sapiens
RSSTISVHDPFSDVSDSSFPKRN

SEQ ID NO: 7235 - protein, 23 aa, Homo sapiens
RSSTISVHDPFSDVSDSSFPKRN

SEQ ID NO: 7236 - protein, 13 aa, Homo sapiens
KQASKFDKLPIKI

SEQ ID NO: 7237 - protein, 14 aa, Homo sapiens
KFPFGIQQAKSHRN

SEQ ID NO: 7238 - protein, 14 aa, Homo sapiens
KFPFGIQQAKSHRN

SEQ ID NO: 7239 - protein, 14 aa, Homo sapiens
KFPFGIQQAKSHRN

SEQ ID NO: 7240 - protein, 32 aa, Homo sapiens
RPGALPEDANPGPQTESSKFPFGIQQAKSHRN

SEQ ID NO: 7241 - protein, 14 aa, Homo sapiens
KFPFGIQQAKSHRN

SEQ ID NO: 7242 - protein, 14 aa, Homo sapiens
KFPFGIQQAKSHRN

SEQ ID NO: 7243 - protein, 32 aa, Homo sapiens; identical to SEQ ID NO: 7240

SEQ ID NO: 7244 - protein, 39 aa, Homo sapiens; identical to SEQ ID NO: 956

SEQ ID NO: 7245 - protein, 39 aa, Homo sapiens; identical to SEQ ID NO: 956

SEQ ID NO: 7246 - protein, 39 aa, Homo sapiens; identical to SEQ ID NO: 956

SEQ ID NO: 7247 - protein, 38 aa, Homo sapiens; identical to SEQ ID NO: 957

SEQ ID NO: 7248 - protein, 38 aa, Homo sapiens; identical to SEQ ID NO: 957

SEQ ID NO: 7249 - protein, 39 aa, Homo sapiens; identical to SEQ ID NO: 956

SEQ ID NO: 7250 - protein, 8 aa, Homo sapiens
RKNPVCRE

SEQ ID NO: 7251 - protein, 39 aa, Homo sapiens; identical to SEQ ID NO: 956

SEQ ID NO: 7252 - protein, 39 aa, Homo sapiens; identical to SEQ ID NO: 956

SEQ ID NO: 7253 - protein, 39 aa, Homo sapiens; identical to SEQ ID NO: 956

SEQ ID NO: 7254 - protein, 39 aa, Homo sapiens; identical to SEQ ID NO: 956

SEQ ID NO: 7255 - protein, 39 aa, Homo sapiens; identical to SEQ ID NO: 956

SEQ ID NO: 7256 - protein, 14 aa, Homo sapiens
RHMDGMYGPPAKRH

SEQ ID NO: 7257 - protein, 14 aa, Homo sapiens
RHMDGMYGPPAKRH

SEQ ID NO: 7258 - protein, 14 aa, Homo sapiens
RHMDGMYGPPAKRH

SEQ ID NO: 7259 - protein, 14 aa, Homo sapiens
RHMDGMYGPPAKRH

SEQ ID NO: 7260 - protein, 14 aa, Homo sapiens
RHMDGMYGPPAKRH

SEQ ID NO: 7261 - protein, 39 aa, Homo sapiens; identical to SEQ ID NO: 956

SEQ ID NO: 7262 - protein, 14 aa, Homo sapiens
RHMDGMYGPPAKRH

SEQ ID NO: 7263 - protein, 14 aa, Homo sapiens
RHMDGMYGPPAKRH

SEQ ID NO: 7264 - protein, 14 aa, Homo sapiens
RHMDGMYGPPAKRH

SEQ ID NO: 7265 - protein, 38 aa, Homo sapiens; identical to SEQ ID NO: 957

SEQ ID NO: 7266 - protein, 14 aa, Homo sapiens
RHMDGMYGPPAKRH

SEQ ID NO: 7267 - protein, 39 aa, Homo sapiens; identical to SEQ ID NO: 956

SEQ ID NO: 7268 - protein, 14 aa, Homo sapiens
RHMDGMYGPPAKRH

SEQ ID NO: 7269 - protein, 38 aa, Homo sapiens; identical to SEQ ID NO: 957

SEQ ID NO: 7270 - protein, 14 aa, Homo sapiens
RHMDGMYGPPAKRH

SEQ ID NO: 7271 - protein, 14 aa, Homo sapiens
RHMDGMYGPPAKRH

SEQ ID NO: 7272 - protein, 14 aa, Homo sapiens
RHMDGMYGPPAKRH

SEQ ID NO: 7273 - protein, 8 aa, Homo sapiens
RKNPVCRE

SEQ ID NO: 7274 - protein, 8 aa, Homo sapiens
RKNPVCRE

SEQ ID NO: 7275 - protein, 8 aa, Homo sapiens
RKNPVCRE

SEQ ID NO: 7276 - protein, 8 aa, Homo sapiens
RKNPVCRE

SEQ ID NO: 7277 - protein, 8 aa, Homo sapiens
RKNPVCRE

SEQ ID NO: 7278 - protein, 21 aa, Homo sapiens
RGEEPPPEVFSTGDTKKQPKL

SEQ ID NO: 7279 - protein, 16 aa, Homo sapiens
KRAPQTYEKEEDEDKG

SEQ ID NO: 7280 - protein, 20 aa, Homo sapiens
KGVACSKDEWWWDCLEVLRD

SEQ ID NO: 7281 - protein, 20 aa, Homo sapiens
KGVACSKDEWWWDCLEVLRD

SEQ ID NO: 7282 - protein, 16 aa, Homo sapiens
KRAPQTYEKEEDEDKG

SEQ ID NO: 7283 - protein, 16 aa, Homo sapiens
KRAPQTYEKEEDEDKG

SEQ ID NO: 7284 - protein, 15 aa, Homo sapiens
RAPQTYEKEEDEDKG

SEQ ID NO: 7285 - protein, 16 aa, Homo sapiens
KRAPQTYEKEEDEDKG

SEQ ID NO: 7286 - protein, 15 aa, Homo sapiens
RAPQTYEKEEDEDKG

SEQ ID NO: 7287 - protein, 16 aa, Homo sapiens
KRAPQTYEKEEDEDKG

SEQ ID NO: 7288 - protein, 20 aa, Homo sapiens
KGVACSKDEWWWDCLEVLRD

SEQ ID NO: 7289 - protein, 16 aa, Homo sapiens
KRAPQTYEKEEDEDKG

SEQ ID NO: 7290 - protein, 16 aa, Homo sapiens
KRAPQTYEKEEDEDKG

SEQ ID NO: 7291 - protein, 20 aa, Homo sapiens
KGVACSKDEWWWDCLEVLRD

SEQ ID NO: 7292 - protein, 20 aa, Homo sapiens
KGVACSKDEWWWDCLEVLRD

SEQ ID NO: 7293 - protein, 15 aa, Homo sapiens
RAPQTYEKEEDEDKG

SEQ ID NO: 7294 - protein, 15 aa, Homo sapiens
KSHRNIKLLEDEPRS

SEQ ID NO: 7295 - protein, 12 aa, Homo sapiens
RQEKFYATLVRY

SEQ ID NO: 7296 - protein, 12 aa, Homo sapiens
RQEKFYATLVRY

SEQ ID NO: 7297 - protein, 12 aa, Homo sapiens
RQEKFYATLVRY

SEQ ID NO: 7298 - protein, 12 aa, Homo sapiens
RQEKFYATLVRY

SEQ ID NO: 7299 - protein, 16 aa, Homo sapiens
RMPYEPNKDPFGGMRK

SEQ ID NO: 7300 - protein, 22 aa, Homo sapiens
RKAQEAAAAVMQAAANSAQSRQ

SEQ ID NO: 7301 - protein, 30 aa, Homo sapiens
KCLIDIFGILMEYEVGDPSQKALDHNAARK

SEQ ID NO: 7302 - protein, 22 aa, Homo sapiens
RSRDETPLCTIAHWQDSLAKRC

SEQ ID NO: 7303 - protein, 21 aa, Homo sapiens
REITFPPGSVEASQPVLKQRR

SEQ ID NO: 7304 - protein, 21 aa, Homo sapiens
REITFPPGSVEASQPVLKQRR

SEQ ID NO: 7305 - protein, 22 aa, Homo sapiens
RSRDETPLCTIAHWQDSLAKRC

SEQ ID NO: 7306 - protein, 22 aa, Homo sapiens
RSRDETPLCTIAHWQDSLAKRC

SEQ ID NO: 7307 - protein, 22 aa, Homo sapiens
RSRDETPLCTIAHWQDSLAKRC

SEQ ID NO: 7308 - protein, 22 aa, Homo sapiens
RSRDETPLCTIAHWQDSLAKRC

SEQ ID NO: 7309 - protein, 16 aa, Homo sapiens
RMPYEPNKDPFGGMRK

SEQ ID NO: 7310 - protein, 39 aa, Homo sapiens; identical to SEQ ID NO: 956

SEQ ID NO: 7311 - protein, 39 aa, Homo sapiens; identical to SEQ ID NO: 956

SEQ ID NO: 7312 - protein, 16 aa, Homo sapiens
RMPYEPNKDPFGGMRK

SEQ ID NO: 7313 - protein, 16 aa, Homo sapiens
RMPYEPNKDPFGGMRK

SEQ ID NO: 7314 - protein, 14 aa, Homo sapiens
RHMDGMYGPPAKRH

SEQ ID NO: 7315 - protein, 22 aa, Homo sapiens
RKAQEAAAAVMQAAANSAQSRQ

SEQ ID NO: 7316 - protein, 22 aa, Homo sapiens
RKAQEAAAAVMQAAANSAQSRQ

SEQ ID NO: 7317 - protein, 21 aa, Homo sapiens
KINKKTGQPEELVSCSDCGRS

SEQ ID NO: 7318 - protein, 23 aa, Homo sapiens
RSGHPSCLQFTPVMMAAVKTYRW

SEQ ID NO: 7319 - protein, 21 aa, Homo sapiens
KINKKTGQPEELVSCSDCGRS

SEQ ID NO: 7320 - protein, 18 aa, Homo sapiens
KKTGQPEELVSCSDCGRS

SEQ ID NO: 7321 - protein, 23 aa, Homo sapiens
RSGHPSCLQFTPVMMAAVKTYRW

SEQ ID NO: 7322 - protein, 23 aa, Homo sapiens
RSGHPSCLQFTPVMMAAVKTYRW

SEQ ID NO: 7323 - protein, 18 aa, Homo sapiens
KKTGQPEELVSCSDCGRS

SEQ ID NO: 7324 - protein, 18 aa, Homo sapiens
KKTGQPEELVSCSDCGRS

SEQ ID NO: 7325 - protein, 23 aa, Homo sapiens
RSGHPSCLQFTPVMMAAVKTYRW

SEQ ID NO: 7326 - protein, 23 aa, Homo sapiens
RSGHPSCLQFTPVMMAAVKTYRW

SEQ ID NO: 7327 - protein, 23 aa, Homo sapiens
RSGHPSCLQFTPVMMAAVKTYRW

SEQ ID NO: 7328 - protein, 23 aa, Homo sapiens
RSGHPSCLQFTPVMMAAVKTYRW

SEQ ID NO: 7329 - protein, 18 aa, Homo sapiens
KKTGQPEELVSCSDCGRS

SEQ ID NO: 7330 - protein, 23 aa, Homo sapiens
RSGHPSCLQFTPVMMAAVKTYRW

SEQ ID NO: 7331 - protein, 23 aa, Homo sapiens
RSGHPSCLQFTPVMMAAVKTYRW

SEQ ID NO: 7332 - protein, 23 aa, Homo sapiens
RSGHPSCLQFTPVMMAAVKTYRW

SEQ ID NO: 7333 - protein, 18 aa, Homo sapiens
KKTGQPEELVSCSDCGRS

SEQ ID NO: 7334 - protein, 18 aa, Homo sapiens
KKTGQPEELVSCSDCGRS

SEQ ID NO: 7335 - protein, 18 aa, Homo sapiens
KKTGQPEELVSCSDCGRS

SEQ ID NO: 7336 - protein, 18 aa, Homo sapiens
KKTGQPEELVSCSDCGRS

SEQ ID NO: 7337 - protein, 23 aa, Homo sapiens
RSGHPSCLQFTPVMMAAVKTYRW

SEQ ID NO: 7338 - protein, 18 aa, Homo sapiens
KKTGQPEELVSCSDCGRS

SEQ ID NO: 7339 - protein, 23 aa, Homo sapiens
RSGHPSCLQFTPVMMAAVKTYRW

SEQ ID NO: 7340 - protein, 9 aa, Homo sapiens
RTDPLEKRG

SEQ ID NO: 7341 - protein, 25 aa, Homo sapiens
RAHPPEDPRLSFPSIKPDTDQTLKK

SEQ ID NO: 7342 - protein, 9 aa, Homo sapiens
RTDPLEKRG

SEQ ID NO: 7343 - protein, 9 aa, Homo sapiens
RTDPLEKRG

SEQ ID NO: 7344 - protein, 9 aa, Homo sapiens
RTDPLEKRG

SEQ ID NO: 7345 - protein, 9 aa, Homo sapiens
RTDPLEKRG

SEQ ID NO: 7346 - protein, 12 aa, Homo sapiens
KSKGKGVGSARK

SEQ ID NO: 7347 - protein, 9 aa, Homo sapiens
RTDPLEKRG

SEQ ID NO: 7348 - protein, 9 aa, Homo sapiens
RTDPLEKRG

SEQ ID NO: 7349 - protein, 23 aa, Homo sapiens
KKGPDGLALPNNYCDFCLGDSKI

SEQ ID NO: 7350 - protein, 18 aa, Homo sapiens
KKTGQPEELVSCSDCGRS

SEQ ID NO: 7351 - protein, 36 aa, Homo sapiens; identical to SEQ ID NO: 963

SEQ ID NO: 7352 - protein, 36 aa, Homo sapiens; identical to SEQ ID NO: 963

SEQ ID NO: 7353 - protein, 18 aa, Homo sapiens
KKTGQPEELVSCSDCGRS

SEQ ID NO: 7354 - protein, 18 aa, Homo sapiens
KKTGQPEELVSCSDCGRS

SEQ ID NO: 7355 - protein, 10 aa, Homo sapiens
KGKGVGSARK

SEQ ID NO: 7356 - protein, 18 aa, Homo sapiens
KKTGQPEELVSCSDCGRS

SEQ ID NO: 7357 - protein, 36 aa, Homo sapiens; identical to SEQ ID NO: 963

SEQ ID NO: 7358 - protein, 36 aa, Homo sapiens; identical to SEQ ID NO: 963

SEQ ID NO: 7359 - protein, 10 aa, Homo sapiens
KGKGVGSARK

SEQ ID NO: 7360 - protein, 36 aa, Homo sapiens; identical to SEQ ID NO: 963

SEQ ID NO: 7361 - protein, 10 aa, Homo sapiens
KGKGVGSARK

SEQ ID NO: 7362 - protein, 13 aa, Homo sapiens
RKKLDASILEDRD

SEQ ID NO: 7363 - protein, 12 aa, Homo sapiens
KSKGKGVGSARK

SEQ ID NO: 7364 - protein, 13 aa, Homo sapiens
RKKLDASILEDRD

SEQ ID NO: 7365 - protein, 13 aa, Homo sapiens
RKKLDASILEDRD

SEQ ID NO: 7366 - protein, 13 aa, Homo sapiens
RKKLDASILEDRD

SEQ ID NO: 7367 - protein, 13 aa, Homo sapiens
RKKLDASILEDRD

SEQ ID NO: 7368 - protein, 13 aa, Homo sapiens
RKKLDASILEDRD

SEQ ID NO: 7369 - protein, 18 aa, Homo sapiens
RLSFPSIKPDTDQTLKKE

SEQ ID NO: 7370 - protein, 18 aa, Homo sapiens
RLSFPSIKPDTDQTLKKE

SEQ ID NO: 7371 - protein, 18 aa, Homo sapiens
RLSFPSIKPDTDQTLKKE

SEQ ID NO: 7372 - protein, 27 aa, Homo sapiens
KPDTDQTLKKEGLISQDGSSLEALLRT

SEQ ID NO: 7373 - protein, 27 aa, Homo sapiens
KPDTDQTLKKEGLISQDGSSLEALLRT

SEQ ID NO: 7374 - protein, 19 aa, Homo sapiens
KKEGLISQDGSSLEALLRT

SEQ ID NO: 7375 - protein, 17 aa, Homo sapiens
RLSFPSIKPDTDQTLKK

SEQ ID NO: 7376 - protein, 17 aa, Homo sapiens
RLSFPSIKPDTDQTLKK

SEQ ID NO: 7377 - protein, 25 aa, Homo sapiens
RAHPPEDPRLSFPSIKPDTDQTLKK

SEQ ID NO: 7378 - protein, 17 aa, Homo sapiens
RLSFPSIKPDTDQTLKK

SEQ ID NO: 7379 - protein, 17 aa, Homo sapiens
RLSFPSIKPDTDQTLKK

SEQ ID NO: 7380 - protein, 26 aa, Homo sapiens
KKGPDGLALPNNYCDFCLGDSKINKK

SEQ ID NO: 7381 - protein, 26 aa, Homo sapiens
KKGPDGLALPNNYCDFCLGDSKINKK

SEQ ID NO: 7382 - protein, 25 aa, Homo sapiens
KGPDGLALPNNYCDFCLGDSKINKK

SEQ ID NO: 7383 - protein, 26 aa, Homo sapiens
KKGPDGLALPNNYCDFCLGDSKINKK

SEQ ID NO: 7384 - protein, 26 aa, Homo sapiens
KKGPDGLALPNNYCDFCLGDSKINKK

SEQ ID NO: 7385 - protein, 36 aa, Homo sapiens; identical to SEQ ID NO: 963

SEQ ID NO: 7386 - protein, 36 aa, Homo sapiens; identical to SEQ ID NO: 963

SEQ ID NO: 7387 - protein, 9 aa, Homo sapiens
RSEEQKSKK

SEQ ID NO: 7388 - protein, 10 aa, Homo sapiens
RSEEQKSKKG

SEQ ID NO: 7389 - protein, 36 aa, Homo sapiens; identical to SEQ ID NO: 963

SEQ ID NO: 7390 - protein, 36 aa, Homo sapiens; identical to SEQ ID NO: 963

SEQ ID NO: 7391 - protein, 36 aa, Homo sapiens; identical to SEQ ID NO: 963

SEQ ID NO: 7392 - protein, 36 aa, Homo sapiens; identical to SEQ ID NO: 963

SEQ ID NO: 7393 - protein, 36 aa, Homo sapiens; identical to SEQ ID NO: 963

SEQ ID NO: 7394 - protein, 23 aa, Homo sapiens
RSGHPSCLQFTPVMMAAVKTYRW

SEQ ID NO: 7395 - protein, 23 aa, Homo sapiens
RSGHPSCLQFTPVMMAAVKTYRW

SEQ ID NO: 7396 - protein, 23 aa, Homo sapiens
RSGHPSCLQFTPVMMAAVKTYRW

SEQ ID NO: 7397 - protein, 23 aa, Homo sapiens
KKGPDGLALPNNYCDFCLGDSKI

SEQ ID NO: 7398 - protein, 23 aa, Homo sapiens
KKGPDGLALPNNYCDFCLGDSKI

SEQ ID NO: 7399 - protein, 23 aa, Homo sapiens
KKGPDGLALPNNYCDFCLGDSKI

SEQ ID NO: 7400 - protein, 23 aa, Homo sapiens
KKGPDGLALPNNYCDFCLGDSKI

SEQ ID NO: 7401 - protein, 23 aa, Homo sapiens
KKGPDGLALPNNYCDFCLGDSKI

SEQ ID NO: 7402 - protein, 23 aa, Homo sapiens
KKGPDGLALPNNYCDFCLGDSKI

SEQ ID NO: 7403 - protein, 9 aa, Homo sapiens
RSEEQKSKK

SEQ ID NO: 7404 - protein, 23 aa, Homo sapiens
KKGPDGLALPNNYCDFCLGDSKI

SEQ ID NO: 7405 - protein, 9 aa, Homo sapiens
RSEEQKSKK

SEQ ID NO: 7406 - protein, 23 aa, Homo sapiens
KKGPDGLALPNNYCDFCLGDSKI

SEQ ID NO: 7407 - protein, 9 aa, Homo sapiens
RSEEQKSKK

SEQ ID NO: 7408 - protein, 23 aa, Homo sapiens
KKGPDGLALPNNYCDFCLGDSKI

SEQ ID NO: 7409 - protein, 26 aa, Homo sapiens
RILEPDDFLDDLDDEDYEEDTPKRRG

SEQ ID NO: 7410 - protein, 25 aa, Homo sapiens
RILEPDDFLDDLDDEDYEEDTPKRR

SEQ ID NO: 7411 - protein, 26 aa, Homo sapiens
RILEPDDFLDDLDDEDYEEDTPKRRG

SEQ ID NO: 7412 - protein, 26 aa, Homo sapiens
RILEPDDFLDDLDDEDYEEDTPKRRG

SEQ ID NO: 7413 - protein, 26 aa, Homo sapiens
RILEPDDFLDDLDDEDYEEDTPKRRG

SEQ ID NO: 7414 - protein, 26 aa, Homo sapiens
RILEPDDFLDDLDDEDYEEDTPKRRG

SEQ ID NO: 7415 - protein, 26 aa, Homo sapiens
RILEPDDFLDDLDDEDYEEDTPKRRG

SEQ ID NO: 7416 - protein, 26 aa, Homo sapiens
RILEPDDFLDDLDDEDYEEDTPKRRG

SEQ ID NO: 7417 - protein, 10 aa, Homo sapiens
KGKGVGSARK

SEQ ID NO: 7418 - protein, 25 aa, Homo sapiens
RILEPDDFLDDLDDEDYEEDTPKRR

SEQ ID NO: 7419 - protein, 26 aa, Homo sapiens
RILEPDDFLDDLDDEDYEEDTPKRRG

SEQ ID NO: 7420 - protein, 12 aa, Homo sapiens
KSKGKGVGSARK

SEQ ID NO: 7421 - protein, 12 aa, Homo sapiens
KSKGKGVGSARK

SEQ ID NO: 7422 - protein, 26 aa, Homo sapiens
RILEPDDFLDDLDDEDYEEDTPKRRG

SEQ ID NO: 7423 - protein, 26 aa, Homo sapiens
RILEPDDFLDDLDDEDYEEDTPKRRG

SEQ ID NO: 7424 - protein, 13 aa, Homo sapiens
RKKLDASILEDRD

SEQ ID NO: 7425 - protein, 25 aa, Homo sapiens
RILEPDDFLDDLDDEDYEEDTPKRR

SEQ ID NO: 7426 - protein, 25 aa, Homo sapiens
RILEPDDFLDDLDDEDYEEDTPKRR

SEQ ID NO: 7427 - protein, 25 aa, Homo sapiens
RILEPDDFLDDLDDEDYEEDTPKRR

SEQ ID NO: 7428 - protein, 25 aa, Homo sapiens
RILEPDDFLDDLDDEDYEEDTPKRR

SEQ ID NO: 7429 - protein, 26 aa, Homo sapiens
RILEPDDFLDDLDDEDYEEDTPKRRG

SEQ ID NO: 7430 - protein, 26 aa, Homo sapiens
RILEPDDFLDDLDDEDYEEDTPKRRG

SEQ ID NO: 7431 - protein, 26 aa, Homo sapiens
RILEPDDFLDDLDDEDYEEDTPKRRG

SEQ ID NO: 7432 - protein, 26 aa, Homo sapiens
RILEPDDFLDDLDDEDYEEDTPKRRG

SEQ ID NO: 7433 - protein, 25 aa, Homo sapiens
RILEPDDFLDDLDDEDYEEDTPKRR

SEQ ID NO: 7434 - protein, 19 aa, Homo sapiens
KKEGLISQDGSSLEALLRT

SEQ ID NO: 7435 - protein, 19 aa, Homo sapiens
KKEGLISQDGSSLEALLRT

SEQ ID NO: 7436 - protein, 19 aa, Homo sapiens
KKEGLISQDGSSLEALLRT

SEQ ID NO: 7437 - protein, 19 aa, Homo sapiens
KKEGLISQDGSSLEALLRT

SEQ ID NO: 7438 - protein, 19 aa, Homo sapiens
KKEGLISQDGSSLEALLRT

SEQ ID NO: 7439 - protein, 19 aa, Homo sapiens
KKEGLISQDGSSLEALLRT

SEQ ID NO: 7440 - protein, 19 aa, Homo sapiens
KKEGLISQDGSSLEALLRT

SEQ ID NO: 7441 - protein, 19 aa, Homo sapiens
KKEGLISQDGSSLEALLRT

SEQ ID NO: 7442 - protein, 19 aa, Homo sapiens
KKEGLISQDGSSLEALLRT

SEQ ID NO: 7443 - protein, 19 aa, Homo sapiens
KKEGLISQDGSSLEALLRT

SEQ ID NO: 7444 - protein, 25 aa, Homo sapiens
RAHPPEDPRLSFPSIKPDTDQTLKK

SEQ ID NO: 7445 - protein, 19 aa, Homo sapiens
KKEGLISQDGSSLEALLRT

SEQ ID NO: 7446 - protein, 19 aa, Homo sapiens
KKEGLISQDGSSLEALLRT

SEQ ID NO: 7447 - protein, 25 aa, Homo sapiens
RAHPPEDPRLSFPSIKPDTDQTLKK

SEQ ID NO: 7448 - protein, 25 aa, Homo sapiens
RAHPPEDPRLSFPSIKPDTDQTLKK

SEQ ID NO: 7449 - protein, 19 aa, Homo sapiens
KKEGLISQDGSSLEALLRT

SEQ ID NO: 7450 - protein, 17 aa, Homo sapiens
RLSFPSIKPDTDQTLKK

SEQ ID NO: 7451 - protein, 19 aa, Homo sapiens
KKEGLISQDGSSLEALLRT

SEQ ID NO: 7452 - protein, 19 aa, Homo sapiens
KKEGLISQDGSSLEALLRT

SEQ ID NO: 7453 - protein, 25 aa, Homo sapiens
RAHPPEDPRLSFPSIKPDTDQTLKK

SEQ ID NO: 7454 - protein, 25 aa, Homo sapiens
RAHPPEDPRLSFPSIKPDTDQTLKK

SEQ ID NO: 7455 - protein, 25 aa, Homo sapiens
RAHPPEDPRLSFPSIKPDTDQTLKK

SEQ ID NO: 7456 - protein, 19 aa, Homo sapiens
KKEGLISQDGSSLEALLRT

SEQ ID NO: 7457 - protein, 17 aa, Homo sapiens
RLSFPSIKPDTDQTLKK

SEQ ID NO: 7458 - protein, 25 aa, Homo sapiens
RAHPPEDPRLSFPSIKPDTDQTLKK

SEQ ID NO: 7459 - protein, 25 aa, Homo sapiens
RAHPPEDPRLSFPSIKPDTDQTLKK

SEQ ID NO: 7460 - protein, 17 aa, Homo sapiens
RLSFPSIKPDTDQTLKK

SEQ ID NO: 7461 - protein, 19 aa, Homo sapiens
KKEGLISQDGSSLEALLRT

SEQ ID NO: 7462 - protein, 25 aa, Homo sapiens
RAHPPEDPRLSFPSIKPDTDQTLKK

SEQ ID NO: 7463 - protein, 25 aa, Homo sapiens
RAHPPEDPRLSFPSIKPDTDQTLKK

SEQ ID NO: 7464 - protein, 25 aa, Homo sapiens
RAHPPEDPRLSFPSIKPDTDQTLKK

SEQ ID NO: 7465 - protein, 19 aa, Homo sapiens
KKEGLISQDGSSLEALLRT

SEQ ID NO: 7466 - protein, 26 aa, Homo sapiens
RILEPDDFLDDLDDEDYEEDTPKRRG

SEQ ID NO: 7467 - protein, 19 aa, Homo sapiens
KKEGLISQDGSSLEALLRT

SEQ ID NO: 7468 - protein, 19 aa, Homo sapiens
KKEGLISQDGSSLEALLRT

SEQ ID NO: 7469 - protein, 19 aa, Homo sapiens
KKEGLISQDGSSLEALLRT

SEQ ID NO: 7470 - protein, 19 aa, Homo sapiens
KKEGLISQDGSSLEALLRT

SEQ ID NO: 7471 - protein, 19 aa, Homo sapiens
KKEGLISQDGSSLEALLRT

SEQ ID NO: 7472 - protein, 19 aa, Homo sapiens
KKEGLISQDGSSLEALLRT

SEQ ID NO: 7473 - protein, 19 aa, Homo sapiens
KKEGLISQDGSSLEALLRT

SEQ ID NO: 7474 - protein, 19 aa, Homo sapiens
KKEGLISQDGSSLEALLRT

SEQ ID NO: 7475 - protein, 9 aa, Homo sapiens
RTDPLEKRG

SEQ ID NO: 7476 - protein, 19 aa, Homo sapiens
KKEGLISQDGSSLEALLRT

SEQ ID NO: 7477 - protein, 8 aa, Homo sapiens
KRPMKQKR

SEQ ID NO: 7478 - protein, 5 aa, Homo sapiens
RKLRI

SEQ ID NO: 7479 - protein, 29 aa, Homo sapiens
RLYISNTFNPAKPDAEDSDGSIASWELRV

SEQ ID NO: 7480 - protein, 9 aa, Homo sapiens
RKPLDLYRL

SEQ ID NO: 7481 - protein, 22 aa, Homo sapiens
RYLAFTEEKAMGMTNLPAVGRK

SEQ ID NO: 7482 - protein, 16 aa, Homo sapiens
KITKLYELGGEPERKM

SEQ ID NO: 7483 - protein, 16 aa, Homo sapiens
KITKLYELGGEPERKM

SEQ ID NO: 7484 - protein, 16 aa, Homo sapiens
KITKLYELGGEPERKM

SEQ ID NO: 7485 - protein, 16 aa, Homo sapiens
KITKLYELGGEPERKM

SEQ ID NO: 7486 - protein, 16 aa, Homo sapiens
KITKLYELGGEPERKM

SEQ ID NO: 7487 - protein, 16 aa, Homo sapiens
KITKLYELGGEPERKM

SEQ ID NO: 7488 - protein, 15 aa, Homo sapiens
KITKLYELGGEPERK

SEQ ID NO: 7489 - protein, 16 aa, Homo sapiens
KITKLYELGGEPERKM

SEQ ID NO: 7490 - protein, 16 aa, Homo sapiens
KITKLYELGGEPERKM

SEQ ID NO: 7491 - protein, 16 aa, Homo sapiens
KITKLYELGGEPERKM

SEQ ID NO: 7492 - protein, 15 aa, Homo sapiens
KITKLYELGGEPERK

SEQ ID NO: 7493 - protein, 16 aa, Homo sapiens
KITKLYELGGEPERKM

SEQ ID NO: 7494 - protein, 16 aa, Homo sapiens
KITKLYELGGEPERKM

SEQ ID NO: 7495 - protein, 16 aa, Homo sapiens
KITKLYELGGEPERKM

SEQ ID NO: 7496 - protein, 15 aa, Homo sapiens
KITKLYELGGEPERK

SEQ ID NO: 7497 - protein, 15 aa, Homo sapiens
KITKLYELGGEPERK

SEQ ID NO: 7498 - protein, 15 aa, Homo sapiens
KITKLYELGGEPERK

SEQ ID NO: 7499 - protein, 15 aa, Homo sapiens
KITKLYELGGEPERK

SEQ ID NO: 7500 - protein, 15 aa, Homo sapiens
KITKLYELGGEPERK

SEQ ID NO: 7501 - protein, 15 aa, Homo sapiens
KITKLYELGGEPERK

SEQ ID NO: 7502 - protein, 8 aa, Homo sapiens
RKMWVDRY

SEQ ID NO: 7503 - protein, 15 aa, Homo sapiens
KITKLYELGGEPERK

SEQ ID NO: 7504 - protein, 29 aa, Homo sapiens
RKHVTTAEGTPGTTDQEGPPPDGPPEKRI

SEQ ID NO: 7505 - protein, 29 aa, Homo sapiens
RKHVTTAEGTPGTTDQEGPPPDGPPEKRI

SEQ ID NO: 7506 - protein, 29 aa, Homo sapiens
RKHVTTAEGTPGTTDQEGPPPDGPPEKRI

SEQ ID NO: 7507 - protein, 29 aa, Homo sapiens
RKHVTTAEGTPGTTDQEGPPPDGPPEKRI

SEQ ID NO: 7508 - protein, 29 aa, Homo sapiens
RKHVTTAEGTPGTTDQEGPPPDGPPEKRI

SEQ ID NO: 7509 - protein, 29 aa, Homo sapiens
RKHVTTAEGTPGTTDQEGPPPDGPPEKRI

SEQ ID NO: 7510 - protein, 13 aa, Homo sapiens
KLILLHHKHPERK

SEQ ID NO: 7511 - protein, 29 aa, Homo sapiens
RKHVTTAEGTPGTTDQEGPPPDGPPEKRI

SEQ ID NO: 7512 - protein, 13 aa, Homo sapiens
KLILLHHKHPERK

SEQ ID NO: 7513 - protein, 14 aa, Homo sapiens
KLILLHHKHPERKQ

SEQ ID NO: 7514 - protein, 29 aa, Homo sapiens
RKHVTTAEGTPGTTDQEGPPPDGPPEKRI

SEQ ID NO: 7515 - protein, 29 aa, Homo sapiens
RKHVTTAEGTPGTTDQEGPPPDGPPEKRI

SEQ ID NO: 7516 - protein, 31 aa, Homo sapiens; identical to SEQ ID NO: 424

SEQ ID NO: 7517 - protein, 14 aa, Homo sapiens
KLILLHHKHPERKQ

SEQ ID NO: 7518 - protein, 13 aa, Homo sapiens
KLILLHHKHPERK

SEQ ID NO: 7519 - protein, 23 aa, Homo sapiens
RRCLIEIFGILKEYEVGDPGQRT

SEQ ID NO: 7520 - protein, 22 aa, Homo sapiens
RCLIEIFGILKEYEVGDPGQRT

SEQ ID NO: 7521 - protein, 36 aa, Homo sapiens; identical to SEQ ID NO: 555

SEQ ID NO: 7522 - protein, 36 aa, Homo sapiens; identical to SEQ ID NO: 555

SEQ ID NO: 7523 - protein, 36 aa, Homo sapiens; identical to SEQ ID NO: 555

SEQ ID NO: 7524 - protein, 31 aa, Homo sapiens; identical to SEQ ID NO: 424

SEQ ID NO: 7525 - protein, 12 aa, Homo sapiens
RLEKLYSTMVRF

SEQ ID NO: 7526 - protein, 31 aa, Homo sapiens; identical to SEQ ID NO: 424

SEQ ID NO: 7527 - protein, 31 aa, Homo sapiens; identical to SEQ ID NO: 424

SEQ ID NO: 7528 - protein, 12 aa, Homo sapiens
RLEKLYSTMVRF

SEQ ID NO: 7529 - protein, 31 aa, Homo sapiens; identical to SEQ ID NO: 424

SEQ ID NO: 7530 - protein, 31 aa, Homo sapiens; identical to SEQ ID NO: 424

SEQ ID NO: 7531 - protein, 12 aa, Homo sapiens
RLEKLYSTMVRF

SEQ ID NO: 7532 - protein, 12 aa, Homo sapiens
RLEKLYSTMVRF

SEQ ID NO: 7533 - protein, 31 aa, Homo sapiens; identical to SEQ ID NO: 424

SEQ ID NO: 7534 - protein, 31 aa, Homo sapiens; identical to SEQ ID NO: 424

SEQ ID NO: 7535 - protein, 31 aa, Homo sapiens; identical to SEQ ID NO: 424

SEQ ID NO: 7536 - protein, 14 aa, Homo sapiens
RNIKILEDEPHSKD

SEQ ID NO: 7537 - protein, 31 aa, Homo sapiens; identical to SEQ ID NO: 424

SEQ ID NO: 7538 - protein, 12 aa, Homo sapiens
RLEKLYSTMVRF

SEQ ID NO: 7539 - protein, 14 aa, Homo sapiens
RNIKILEDEPHSKD

SEQ ID NO: 7540 - protein, 31 aa, Homo sapiens; identical to SEQ ID NO: 424

SEQ ID NO: 7541 - protein, 12 aa, Homo sapiens
RLEKLYSTMVRF

SEQ ID NO: 7542 - protein, 31 aa, Homo sapiens; identical to SEQ ID NO: 424

SEQ ID NO: 7543 - protein, 14 aa, Homo sapiens
RNIKILEDEPHSKD

SEQ ID NO: 7544 - protein, 31 aa, Homo sapiens; identical to SEQ ID NO: 424

SEQ ID NO: 7545 - protein, 31 aa, Homo sapiens; identical to SEQ ID NO: 424

SEQ ID NO: 7546 - protein, 31 aa, Homo sapiens; identical to SEQ ID NO: 424

SEQ ID NO: 7547 - protein, 31 aa, Homo sapiens; identical to SEQ ID NO: 424

SEQ ID NO: 7548 - protein, 31 aa, Homo sapiens; identical to SEQ ID NO: 424

SEQ ID NO: 7549 - protein, 14 aa, Homo sapiens
KLILLHHKHPERKQ

SEQ ID NO: 7550 - protein, 13 aa, Homo sapiens
KLILLHHKHPERK

SEQ ID NO: 7551 - protein, 13 aa, Homo sapiens
KLILLHHKHPERK

SEQ ID NO: 7552 - protein, 14 aa, Homo sapiens
RNIKILEDEPHSKD

SEQ ID NO: 7553 - protein, 14 aa, Homo sapiens
RNIKILEDEPHSKD

SEQ ID NO: 7554 - protein, 14 aa, Homo sapiens
KLILLHHKHPERKQ

SEQ ID NO: 7555 - protein, 31 aa, Homo sapiens; identical to SEQ ID NO: 424

SEQ ID NO: 7556 - protein, 31 aa, Homo sapiens; identical to SEQ ID NO: 424

SEQ ID NO: 7557 - protein, 17 aa, Homo sapiens
KDKPASENSEEKLISKF

SEQ ID NO: 7558 - protein, 17 aa, Homo sapiens
KDKPASENSEEKLISKF

SEQ ID NO: 7559 - protein, 17 aa, Homo sapiens
KDKPASENSEEKLISKF

SEQ ID NO: 7560 - protein, 27 aa, Homo sapiens
RKAPGSDPFMSSGQGPNGGMGDPYSRA

SEQ ID NO: 7561 - protein, 27 aa, Homo sapiens
RKAPGSDPFMSSGQGPNGGMGDPYSRA

SEQ ID NO: 7562 - protein, 23 aa, Homo sapiens
RSNSVGIQDAFNDGSDSTFQKRN

SEQ ID NO: 7563 - protein, 16 aa, Homo sapiens
RMSYEPNKDPYGSMRK

SEQ ID NO: 7564 - protein, 16 aa, Homo sapiens
RMSYEPNKDPYGSMRK

SEQ ID NO: 7565 - protein, 9 aa, Homo sapiens
RKPLDLYRL

SEQ ID NO: 7566 - protein, 13 aa, Homo sapiens
KKSSSSTTTNEKI

SEQ ID NO: 7567 - protein, 13 aa, Homo sapiens
KKSSSSTTTNEKI

SEQ ID NO: 7568 - protein, 13 aa, Homo sapiens
KKSSSSTTTNEKI

SEQ ID NO: 7569 - protein, 13 aa, Homo sapiens
KKSSSSTTTNEKI

SEQ ID NO: 7570 - protein, 29 aa, Homo sapiens
RKHVTTAEGTPGTTDQEGPPPDGPPEKRI

SEQ ID NO: 7571 - protein, 24 aa, Homo sapiens
KSSEAIKESSKFPFGISPAQSHRN

SEQ ID NO: 7572 - protein, 13 aa, Homo sapiens
KLILLHHKHPERK

SEQ ID NO: 7573 - protein, 29 aa, Homo sapiens
RKHVTTAEGTPGTTDQEGPPPDGPPEKRI

SEQ ID NO: 7574 - protein, 13 aa, Homo sapiens
KLILLHHKHPERK

SEQ ID NO: 7575 - protein, 29 aa, Homo sapiens
RKHVTTAEGTPGTTDQEGPPPDGPPEKRI

SEQ ID NO: 7576 - protein, 13 aa, Homo sapiens
KLILLHHKHPERK

SEQ ID NO: 7577 - protein, 29 aa, Homo sapiens
RKHVTTAEGTPGTTDQEGPPPDGPPEKRI

SEQ ID NO: 7578 - protein, 13 aa, Homo sapiens
KLILLHHKHPERK

SEQ ID NO: 7579 - protein, 14 aa, Homo sapiens
KLILLHHKHPERKQ

SEQ ID NO: 7580 - protein, 14 aa, Homo sapiens
KLILLHHKHPERKQ

SEQ ID NO: 7581 - protein, 13 aa, Homo sapiens
KLILLHHKHPERK

SEQ ID NO: 7582 - protein, 14 aa, Homo sapiens
KLILLHHKHPERKQ

SEQ ID NO: 7583 - protein, 29 aa, Homo sapiens
RKHVTTAEGTPGTTDQEGPPPDGPPEKRI

SEQ ID NO: 7584 - protein, 29 aa, Homo sapiens
RKHVTTAEGTPGTTDQEGPPPDGPPEKRI

SEQ ID NO: 7585 - protein, 29 aa, Homo sapiens
RKHVTTAEGTPGTTDQEGPPPDGPPEKRI

SEQ ID NO: 7586 - protein, 29 aa, Homo sapiens
RKHVTTAEGTPGTTDQEGPPPDGPPEKRI

SEQ ID NO: 7587 - protein, 12 aa, Homo sapiens
RLEKLYSTMVRF

SEQ ID NO: 7588 - protein, 29 aa, Homo sapiens
RKHVTTAEGTPGTTDQEGPPPDGPPEKRI

SEQ ID NO: 7589 - protein, 29 aa, Homo sapiens
RKHVTTAEGTPGTTDQEGPPPDGPPEKRI

SEQ ID NO: 7590 - protein, 29 aa, Homo sapiens
RKHVTTAEGTPGTTDQEGPPPDGPPEKRI

SEQ ID NO: 7591 - protein, 18 aa, Homo sapiens
RSSTLTEDGAKSSEAIKE

SEQ ID NO: 7592 - protein, 27 aa, Homo sapiens
RKAPGSDPFMSSGQGPNGGMGDPYSRA

SEQ ID NO: 7593 - protein, 16 aa, Homo sapiens
RMSYEPNKDPYGSMRK

SEQ ID NO: 7594 - protein, 16 aa, Homo sapiens
RMSYEPNKDPYGSMRK

SEQ ID NO: 7595 - protein, 27 aa, Homo sapiens
RKAPGSDPFMSSGQGPNGGMGDPYSRA

SEQ ID NO: 7596 - protein, 27 aa, Homo sapiens
RKAPGSDPFMSSGQGPNGGMGDPYSRA

SEQ ID NO: 7597 - protein, 16 aa, Homo sapiens
RMSYEPNKDPYGSMRK

SEQ ID NO: 7598 - protein, 16 aa, Homo sapiens
RMSYEPNKDPYGSMRK

SEQ ID NO: 7599 - protein, 16 aa, Homo sapiens
RMSYEPNKDPYGSMRK

SEQ ID NO: 7600 - protein, 16 aa, Homo sapiens
RMSYEPNKDPYGSMRK

SEQ ID NO: 7601 - protein, 16 aa, Homo sapiens
RMSYEPNKDPYGSMRK

SEQ ID NO: 7602 - protein, 16 aa, Homo sapiens
RMSYEPNKDPYGSMRK

SEQ ID NO: 7603 - protein, 16 aa, Homo sapiens
RMSYEPNKDPYGSMRK

SEQ ID NO: 7604 - protein, 16 aa, Homo sapiens
RMSYEPNKDPYGSMRK

SEQ ID NO: 7605 - protein, 16 aa, Homo sapiens
RMSYEPNKDPYGSMRK

SEQ ID NO: 7606 - protein, 16 aa, Homo sapiens
RMSYEPNKDPYGSMRK

SEQ ID NO: 7607 - protein, 27 aa, Homo sapiens
RKAPGSDPFMSSGQGPNGGMGDPYSRA

SEQ ID NO: 7608 - protein, 8 aa, Homo sapiens
RKNPVCRE

SEQ ID NO: 7609 - protein, 16 aa, Homo sapiens
RMSYEPNKDPYGSMRK

SEQ ID NO: 7610 - protein, 16 aa, Homo sapiens
RMSYEPNKDPYGSMRK

SEQ ID NO: 7611 - protein, 22 aa, Homo sapiens
RDITFPPGSVEATQPVLKQRRR

SEQ ID NO: 7612 - protein, 16 aa, Homo sapiens
KNDPFVVDCSDKLGRV

SEQ ID NO: 7613 - protein, 14 aa, Homo sapiens
KLILLHHKHPERKQ

SEQ ID NO: 7614 - protein, 28 aa, Homo sapiens
KILEDEPHSKDETPLCTLLDWQDSLAKR

SEQ ID NO: 7615 - protein, 12 aa, Homo sapiens
RLEKLYSTMVRF

SEQ ID NO: 7616 - protein, 31 aa, Homo sapiens; identical to SEQ ID NO: 424

SEQ ID NO: 7617 - protein, 31 aa, Homo sapiens; identical to SEQ ID NO: 424

SEQ ID NO: 7618 - protein, 12 aa, Homo sapiens
RLEKLYSTMVRF

SEQ ID NO: 7619 - protein, 13 aa, Homo sapiens
KLILLHHKHPERK

SEQ ID NO: 7620 - protein, 15 aa, Homo sapiens
RLTMKDIGTPEAWRV

SEQ ID NO: 7621 - protein, 18 aa, Homo sapiens
KESSKFPFGISPAQSHRN

SEQ ID NO: 7622 - protein, 18 aa, Homo sapiens
KESSKFPFGISPAQSHRN

SEQ ID NO: 7623 - protein, 18 aa, Homo sapiens
RSSTLTEDGAKSSEAIKE

SEQ ID NO: 7624 - protein, 18 aa, Homo sapiens
RSSTLTEDGAKSSEAIKE

SEQ ID NO: 7625 - protein, 18 aa, Homo sapiens
KESSKFPFGISPAQSHRN

SEQ ID NO: 7626 - protein, 18 aa, Homo sapiens
RSSTLTEDGAKSSEAIKE

SEQ ID NO: 7627 - protein, 18 aa, Homo sapiens
RSSTLTEDGAKSSEAIKE

SEQ ID NO: 7628 - protein, 18 aa, Homo sapiens
KESSKFPFGISPAQSHRN

SEQ ID NO: 7629 - protein, 18 aa, Homo sapiens
RSSTLTEDGAKSSEAIKE

SEQ ID NO: 7630 - protein, 18 aa, Homo sapiens
KESSKFPFGISPAQSHRN

SEQ ID NO: 7631 - protein, 18 aa, Homo sapiens
KESSKFPFGISPAQSHRN

SEQ ID NO: 7632 - protein, 18 aa, Homo sapiens
KESSKFPFGISPAQSHRN

SEQ ID NO: 7633 - protein, 23 aa, Homo sapiens
RSNSVGIQDAFNDGSDSTFQKRN

SEQ ID NO: 7634 - protein, 23 aa, Homo sapiens
RSNSVGIQDAFNDGSDSTFQKRN

SEQ ID NO: 7635 - protein, 23 aa, Homo sapiens
RSNSVGIQDAFNDGSDSTFQKRN

SEQ ID NO: 7636 - protein, 23 aa, Homo sapiens
RSNSVGIQDAFNDGSDSTFQKRN

SEQ ID NO: 7637 - protein, 16 aa, Homo sapiens
RMSYEPNKDPYGSMRK

SEQ ID NO: 7638 - protein, 23 aa, Homo sapiens
RSNSVGIQDAFNDGSDSTFQKRN

SEQ ID NO: 7639 - protein, 23 aa, Homo sapiens
RSNSVGIQDAFNDGSDSTFQKRN

SEQ ID NO: 7640 - protein, 16 aa, Homo sapiens
RMSYEPNKDPYGSMRK

SEQ ID NO: 7641 - protein, 23 aa, Homo sapiens
RSNSVGIQDAFNDGSDSTFQKRN

SEQ ID NO: 7642 - protein, 23 aa, Homo sapiens
RSNSVGIQDAFNDGSDSTFQKRN

SEQ ID NO: 7643 - protein, 23 aa, Homo sapiens
RSNSVGIQDAFNDGSDSTFQKRN

SEQ ID NO: 7644 - protein, 27 aa, Homo sapiens
RKAPGSDPFMSSGQGPNGGMGDPYSRA

SEQ ID NO: 7645 - protein, 22 aa, Homo sapiens
RYLAFTEEKAMGMTNLPAVGRK

SEQ ID NO: 7646 - protein, 9 aa, Homo sapiens
RKPLDLYRL

SEQ ID NO: 7647 - protein, 14 aa, Homo sapiens
KLILLHHKHPERKQ

SEQ ID NO: 7648 - protein, 13 aa, Homo sapiens
KLILLHHKHPERK

SEQ ID NO: 7649 - protein, 26 aa, Homo sapiens
RSLSFVPGNDFEMSKHPGLLLILGKL

SEQ ID NO: 7650 - protein, 26 aa, Homo sapiens
RSLSFVPGNDFEMSKHPGLLLILGKL

SEQ ID NO: 7651 - protein, 13 aa, Homo sapiens
KLILLHHKHPERK

SEQ ID NO: 7652 - protein, 26 aa, Homo sapiens
RSLSFVPGNDFEMSKHPGLLLILGKL

SEQ ID NO: 7653 - protein, 26 aa, Homo sapiens
RSLSFVPGNDFEMSKHPGLLLILGKL

SEQ ID NO: 7654 - protein, 26 aa, Homo sapiens
RSLSFVPGNDFEMSKHPGLLLILGKL

SEQ ID NO: 7655 - protein, 26 aa, Homo sapiens
RSLSFVPGNDFEMSKHPGLLLILGKL

SEQ ID NO: 7656 - protein, 26 aa, Homo sapiens
RSLSFVPGNDFEMSKHPGLLLILGKL

SEQ ID NO: 7657 - protein, 14 aa, Homo sapiens
KLILLHHKHPERKQ

SEQ ID NO: 7658 - protein, 26 aa, Homo sapiens
RSLSFVPGNDFEMSKHPGLLLILGKL

SEQ ID NO: 7659 - protein, 26 aa, Homo sapiens
RSLSFVPGNDFEMSKHPGLLLILGKL

SEQ ID NO: 7660 - protein, 26 aa, Homo sapiens
RSLSFVPGNDFEMSKHPGLLLILGKL

SEQ ID NO: 7661 - protein, 26 aa, Homo sapiens
RSLSFVPGNDFEMSKHPGLLLILGKL

SEQ ID NO: 7662 - protein, 26 aa, Homo sapiens
RSLSFVPGNDFEMSKHPGLLLILGKL

SEQ ID NO: 7663 - protein, 12 aa, Homo sapiens
KLTPATKMNNKA

SEQ ID NO: 7664 - protein, 8 aa, Homo sapiens
RKNPVCRE

SEQ ID NO: 7665 - protein, 15 aa, Homo sapiens
KSSSSTTTNEKITKL

SEQ ID NO: 7666 - protein, 15 aa, Homo sapiens
KSSSSTTTNEKITKL

SEQ ID NO: 7667 - protein, 18 aa, Homo sapiens
KESSKFPFGISPAQSHRN

SEQ ID NO: 7668 - protein, 12 aa, Homo sapiens
RLEKLYSTMVRF

SEQ ID NO: 7669 - protein, 18 aa, Homo sapiens
KESSKFPFGISPAQSHRN

SEQ ID NO: 7670 - protein, 25 aa, Homo sapiens
RFSKVSSPAPMEGGEEEEELLGPKL

SEQ ID NO: 7671 - protein, 25 aa, Homo sapiens
RFSKVSSPAPMEGGEEEEELLGPKL

SEQ ID NO: 7672 - protein, 25 aa, Homo sapiens
RFSKVSSPAPMEGGEEEEELLGPKL

SEQ ID NO: 7673 - protein, 32 aa, Homo sapiens
RTLLDPGRFSKVSSPAPMEGGEEEEELLGPKL

SEQ ID NO: 7674 - protein, 32 aa, Homo sapiens; identical to SEQ ID NO: 7673

SEQ ID NO: 7675 - protein, 29 aa, Homo sapiens
RKHVTTAEGTPGTTDQEGPPPDGPPEKRI

SEQ ID NO: 7676 - protein, 36 aa, Homo sapiens; identical to SEQ ID NO: 555

SEQ ID NO: 7677 - protein, 36 aa, Homo sapiens; identical to SEQ ID NO: 555

SEQ ID NO: 7678 - protein, 26 aa, Homo sapiens
RGEMKAAAGQESEGPAVGPPQPLGKE

SEQ ID NO: 7679 - protein, 26 aa, Homo sapiens
RGEMKAAAGQESEGPAVGPPQPLGKE

SEQ ID NO: 7680 - protein, 24 aa, Homo sapiens
KKAEQQQREEAGGEAAAAAAAERG

SEQ ID NO: 7681 - protein, 26 aa, Homo sapiens
RGEMKAAAGQESEGPAVGPPQPLGKE

SEQ ID NO: 7682 - protein, 26 aa, Homo sapiens
RGEMKAAAGQESEGPAVGPPQPLGKE

SEQ ID NO: 7683 - protein, 24 aa, Homo sapiens
KKAEQQQREEAGGEAAAAAAAERG

SEQ ID NO: 7684 - protein, 41 aa, Homo sapiens
REEAGGEAAAAAAAERGEMKAAAGQESEGPAVGPPQPLGKE

SEQ ID NO: 7685 - protein, 26 aa, Homo sapiens
RGEMKAAAGQESEGPAVGPPQPLGKE

SEQ ID NO: 7686 - protein, 4 aa, Homo sapiens
RKCF

SEQ ID NO: 7687 - protein, 4 aa, Homo sapiens
RKCF

SEQ ID NO: 7688 - protein, 4 aa, Homo sapiens
RKCF

SEQ ID NO: 7689 - protein, 4 aa, Homo sapiens
RKCF

SEQ ID NO: 7690 - protein, 4 aa, Homo sapiens
RKCF

SEQ ID NO: 7691 - protein, 4 aa, Homo sapiens
RKCF

SEQ ID NO: 7692 - protein, 23 aa, Homo sapiens
RVAPEEHPVLLTEAPLNPKANRE

SEQ ID NO: 7693 - protein, 23 aa, Homo sapiens
RVAPEEHPVLLTEAPLNPKANRE

SEQ ID NO: 7694 - protein, 33 aa, Homo sapiens
REKMTQIMFETFNTPAMYVAIQAVLSLYASGRT

SEQ ID NO: 7695 - protein, 12 aa, Homo sapiens
KIKIIAPPERKY

SEQ ID NO: 7696 - protein, 11 aa, Homo sapiens
KIKIIAPPERK

SEQ ID NO: 7697 - protein, 12 aa, Homo sapiens
KIKIIAPPERKY

SEQ ID NO: 7698 - protein, 12 aa, Homo sapiens
KIKIIAPPERKY

SEQ ID NO: 7699 - protein, 11 aa, Homo sapiens
KIKIIAPPERK

SEQ ID NO: 7700 - protein, 11 aa, Homo sapiens
KIKIIAPPERK

SEQ ID NO: 7701 - protein, 22 aa, Homo sapiens
KEITALAPSTMKIKIIAPPERK

SEQ ID NO: 7702 - protein, 11 aa, Homo sapiens
KIKIIAPPERK

SEQ ID NO: 7703 - protein, 11 aa, Homo sapiens
KIKIIAPPERK

SEQ ID NO: 7704 - protein, 11 aa, Homo sapiens
KIKIIAPPERK

SEQ ID NO: 7705 - protein, 22 aa, Homo sapiens
KEITALAPSTMKIKIIAPPERK

SEQ ID NO: 7706 - protein, 22 aa, Homo sapiens
KEITALAPSTMKIKIIAPPERK

SEQ ID NO: 7707 - protein, 22 aa, Homo sapiens
KEITALAPSTMKIKIIAPPERK

SEQ ID NO: 7708 - protein, 22 aa, Homo sapiens
KEITALAPSTMKIKIIAPPERK

SEQ ID NO: 7709 - protein, 22 aa, Homo sapiens
KEITALAPSTMKIKIIAPPERK

SEQ ID NO: 7710 - protein, 11 aa, Homo sapiens
KIKIIAPPERK

SEQ ID NO: 7711 - protein, 11 aa, Homo sapiens
KIKIIAPPERK

SEQ ID NO: 7712 - protein, 11 aa, Homo sapiens
KIKIIAPPERK

SEQ ID NO: 7713 - protein, 22 aa, Homo sapiens
KEITALAPSTMKIKIIAPPERK

SEQ ID NO: 7714 - protein, 11 aa, Homo sapiens
KIKIIAPPERK

SEQ ID NO: 7715 - protein, 12 aa, Homo sapiens
KIKIIAPPERKY

SEQ ID NO: 7716 - protein, 11 aa, Homo sapiens
KIKIIAPPERK

SEQ ID NO: 7717 - protein, 11 aa, Homo sapiens
KIKIIAPPERK

SEQ ID NO: 7718 - protein, 22 aa, Homo sapiens
KEITALAPSTMKIKIIAPPERK

SEQ ID NO: 7719 - protein, 11 aa, Homo sapiens
KIKIIAPPERK

SEQ ID NO: 7720 - protein, 22 aa, Homo sapiens
KEITALAPSTMKIKIIAPPERK

SEQ ID NO: 7721 - protein, 22 aa, Homo sapiens
KEITALAPSTMKIKIIAPPERK

SEQ ID NO: 7722 - protein, 11 aa, Homo sapiens
KIKIIAPPERK

SEQ ID NO: 7723 - protein, 11 aa, Homo sapiens
KIKIIAPPERK

SEQ ID NO: 7724 - protein, 11 aa, Homo sapiens
KIKIIAPPERK

SEQ ID NO: 7725 - protein, 22 aa, Homo sapiens
KEITALAPSTMKIKIIAPPERK

SEQ ID NO: 7726 - protein, 11 aa, Homo sapiens
KIKIIAPPERK

SEQ ID NO: 7727 - protein, 11 aa, Homo sapiens
KIKIIAPPERK

SEQ ID NO: 7728 - protein, 22 aa, Homo sapiens
KEITALAPSTMKIKIIAPPERK

SEQ ID NO: 7729 - protein, 11 aa, Homo sapiens
KIKIIAPPERK

SEQ ID NO: 7730 - protein, 22 aa, Homo sapiens
KEITALAPSTMKIKIIAPPERK

SEQ ID NO: 7731 - protein, 22 aa, Homo sapiens
KEITALAPSTMKIKIIAPPERK

SEQ ID NO: 7732 - protein, 22 aa, Homo sapiens
KEITALAPSTMKIKIIAPPERK

SEQ ID NO: 7733 - protein, 22 aa, Homo sapiens
KEITALAPSTMKIKIIAPPERK

SEQ ID NO: 7734 - protein, 22 aa, Homo sapiens
KEITALAPSTMKIKIIAPPERK

SEQ ID NO: 7735 - protein, 24 aa, Homo sapiens
RKDLYANTVLSGGTTMYPGIADRM

SEQ ID NO: 7736 - protein, 22 aa, Homo sapiens
KEITALAPSTMKIKIIAPPERK

SEQ ID NO: 7737 - protein, 22 aa, Homo sapiens
KEITALAPSTMKIKIIAPPERK

SEQ ID NO: 7738 - protein, 22 aa, Homo sapiens
KEITALAPSTMKIKIIAPPERK

SEQ ID NO: 7739 - protein, 22 aa, Homo sapiens
KEITALAPSTMKIKIIAPPERK

SEQ ID NO: 7740 - protein, 22 aa, Homo sapiens
KEITALAPSTMKIKIIAPPERK

SEQ ID NO: 7741 - protein, 22 aa, Homo sapiens
KEITALAPSTMKIKIIAPPERK

SEQ ID NO: 7742 - protein, 22 aa, Homo sapiens
KEITALAPSTMKIKIIAPPERK

SEQ ID NO: 7743 - protein, 15 aa, Homo sapiens
KEITALAPSTMKIKI

SEQ ID NO: 7744 - protein, 24 aa, Homo sapiens
RKDLYANTVLSGGTTMYPGIADRM

SEQ ID NO: 7745 - protein, 22 aa, Homo sapiens
KEITALAPSTMKIKIIAPPERK

SEQ ID NO: 7746 - protein, 22 aa, Homo sapiens
KEITALAPSTMKIKIIAPPERK

SEQ ID NO: 7747 - protein, 24 aa, Homo sapiens
RKDLYANTVLSGGTTMYPGIADRM

SEQ ID NO: 7748 - protein, 22 aa, Homo sapiens
KEITALAPSTMKIKIIAPPERK

SEQ ID NO: 7749 - protein, 24 aa, Homo sapiens
RKDLYANTVLSGGTTMYPGIADRM

SEQ ID NO: 7750 - protein, 24 aa, Homo sapiens
RKDLYANTVLSGGTTMYPGIADRM

SEQ ID NO: 7751 - protein, 22 aa, Homo sapiens
KEITALAPSTMKIKIIAPPERK

SEQ ID NO: 7752 - protein, 15 aa, Homo sapiens
KEITALAPSTMKIKI

SEQ ID NO: 7753 - protein, 22 aa, Homo sapiens
KEITALAPSTMKIKIIAPPERK

SEQ ID NO: 7754 - protein, 22 aa, Homo sapiens
KEITALAPSTMKIKIIAPPERK

SEQ ID NO: 7755 - protein, 15 aa, Homo sapiens
KEITALAPSTMKIKI

SEQ ID NO: 7756 - protein, 24 aa, Homo sapiens
RKDLYANTVLSGGTTMYPGIADRM

SEQ ID NO: 7757 - protein, 22 aa, Homo sapiens
KEITALAPSTMKIKIIAPPERK

SEQ ID NO: 7758 - protein, 15 aa, Homo sapiens
KEITALAPSTMKIKI

SEQ ID NO: 7759 - protein, 24 aa, Homo sapiens
RKDLYANTVLSGGTTMYPGIADRM

SEQ ID NO: 7760 - protein, 24 aa, Homo sapiens
RKDLYANTVLSGGTTMYPGIADRM

SEQ ID NO: 7761 - protein, 15 aa, Homo sapiens
KEITALAPSTMKIKI

SEQ ID NO: 7762 - protein, 15 aa, Homo sapiens
KEITALAPSTMKIKI

SEQ ID NO: 7763 - protein, 22 aa, Homo sapiens
KEITALAPSTMKIKIIAPPERK

SEQ ID NO: 7764 - protein, 24 aa, Homo sapiens
RKDLYANTVLSGGTTMYPGIADRM

SEQ ID NO: 7765 - protein, 22 aa, Homo sapiens
KEITALAPSTMKIKIIAPPERK

SEQ ID NO: 7766 - protein, 22 aa, Homo sapiens
KEITALAPSTMKIKIIAPPERK

SEQ ID NO: 7767 - protein, 22 aa, Homo sapiens
KEITALAPSTMKIKIIAPPERK

SEQ ID NO: 7768 - protein, 15 aa, Homo sapiens
KEITALAPSTMKIKI

SEQ ID NO: 7769 - protein, 15 aa, Homo sapiens
KEITALAPSTMKIKI

SEQ ID NO: 7770 - protein, 15 aa, Homo sapiens
KEITALAPSTMKIKI

SEQ ID NO: 7771 - protein, 22 aa, Homo sapiens
KEITALAPSTMKIKIIAPPERK

SEQ ID NO: 7772 - protein, 24 aa, Homo sapiens
RKDLYANTVLSGGTTMYPGIADRM

SEQ ID NO: 7773 - protein, 24 aa, Homo sapiens
RKDLYANTVLSGGTTMYPGIADRM

SEQ ID NO: 7774 - protein, 22 aa, Homo sapiens
KEITALAPSTMKIKIIAPPERK

SEQ ID NO: 7775 - protein, 22 aa, Homo sapiens
KEITALAPSTMKIKIIAPPERK

SEQ ID NO: 7776 - protein, 15 aa, Homo sapiens
KEITALAPSTMKIKI

SEQ ID NO: 7777 - protein, 22 aa, Homo sapiens
KEITALAPSTMKIKIIAPPERK

SEQ ID NO: 7778 - protein, 22 aa, Homo sapiens
KEITALAPSTMKIKIIAPPERK

SEQ ID NO: 7779 - protein, 15 aa, Homo sapiens
KEITALAPSTMKIKI

SEQ ID NO: 7780 - protein, 15 aa, Homo sapiens
KEITALAPSTMKIKI

SEQ ID NO: 7781 - protein, 22 aa, Homo sapiens
KEITALAPSTMKIKIIAPPERK

SEQ ID NO: 7782 - protein, 14 aa, Homo sapiens
KDSYVGDEAQSKRG

SEQ ID NO: 7783 - protein, 25 aa, Homo sapiens
RHQGVMVGMGQKDSYVGDEAQSKRG

SEQ ID NO: 7784 - protein, 25 aa, Homo sapiens
RHQGVMVGMGQKDSYVGDEAQSKRG

SEQ ID NO: 7785 - protein, 25 aa, Homo sapiens
RHQGVMVGMGQKDSYVGDEAQSKRG

SEQ ID NO: 7786 - protein, 25 aa, Homo sapiens
RHQGVMVGMGQKDSYVGDEAQSKRG

SEQ ID NO: 7787 - protein, 25 aa, Homo sapiens
RHQGVMVGMGQKDSYVGDEAQSKRG

SEQ ID NO: 7788 - protein, 25 aa, Homo sapiens
RHQGVMVGMGQKDSYVGDEAQSKRG

SEQ ID NO: 7789 - protein, 25 aa, Homo sapiens
RHQGVMVGMGQKDSYVGDEAQSKRG

SEQ ID NO: 7790 - protein, 25 aa, Homo sapiens
RHQGVMVGMGQKDSYVGDEAQSKRG

SEQ ID NO: 7791 - protein, 25 aa, Homo sapiens
RHQGVMVGMGQKDSYVGDEAQSKRG

SEQ ID NO: 7792 - protein, 25 aa, Homo sapiens
RHQGVMVGMGQKDSYVGDEAQSKRG

SEQ ID NO: 7793 - protein, 25 aa, Homo sapiens
RHQGVMVGMGQKDSYVGDEAQSKRG

SEQ ID NO: 7794 - protein, 25 aa, Homo sapiens
RHQGVMVGMGQKDSYVGDEAQSKRG

SEQ ID NO: 7795 - protein, 24 aa, Homo sapiens
RGILTLKYPIEHGIVTNWDDMEKI

SEQ ID NO: 7796 - protein, 25 aa, Homo sapiens
RHQGVMVGMGQKDSYVGDEAQSKRG

SEQ ID NO: 7797 - protein, 25 aa, Homo sapiens
RHQGVMVGMGQKDSYVGDEAQSKRG

SEQ ID NO: 7798 - protein, 24 aa, Homo sapiens
RGILTLKYPIEHGIVTNWDDMEKI

SEQ ID NO: 7799 - protein, 25 aa, Homo sapiens
RHQGVMVGMGQKDSYVGDEAQSKRG

SEQ ID NO: 7800 - protein, 25 aa, Homo sapiens
RHQGVMVGMGQKDSYVGDEAQSKRG

SEQ ID NO: 7801 - protein, 25 aa, Homo sapiens
RHQGVMVGMGQKDSYVGDEAQSKRG

SEQ ID NO: 7802 - protein, 25 aa, Homo sapiens
RHQGVMVGMGQKDSYVGDEAQSKRG

SEQ ID NO: 7803 - protein, 25 aa, Homo sapiens
RHQGVMVGMGQKDSYVGDEAQSKRG

SEQ ID NO: 7804 - protein, 24 aa, Homo sapiens
RGILTLKYPIEHGIVTNWDDMEKI

SEQ ID NO: 7805 - protein, 25 aa, Homo sapiens
RHQGVMVGMGQKDSYVGDEAQSKRG

SEQ ID NO: 7806 - protein, 24 aa, Homo sapiens
RGILTLKYPIEHGIVTNWDDMEKI

SEQ ID NO: 7807 - protein, 24 aa, Homo sapiens
RGILTLKYPIEHGIVTNWDDMEKI

SEQ ID NO: 7808 - protein, 25 aa, Homo sapiens
RHQGVMVGMGQKDSYVGDEAQSKRG

SEQ ID NO: 7809 - protein, 25 aa, Homo sapiens
RHQGVMVGMGQKDSYVGDEAQSKRG

SEQ ID NO: 7810 - protein, 24 aa, Homo sapiens
RGILTLKYPIEHGIVTNWDDMEKI

SEQ ID NO: 7811 - protein, 24 aa, Homo sapiens
RGILTLKYPIEHGIVTNWDDMEKI

SEQ ID NO: 7812 - protein, 25 aa, Homo sapiens
RHQGVMVGMGQKDSYVGDEAQSKRG

SEQ ID NO: 7813 - protein, 25 aa, Homo sapiens
RHQGVMVGMGQKDSYVGDEAQSKRG

SEQ ID NO: 7814 - protein, 24 aa, Homo sapiens
RGILTLKYPIEHGIVTNWDDMEKI

SEQ ID NO: 7815 - protein, 25 aa, Homo sapiens
RHQGVMVGMGQKDSYVGDEAQSKRG

SEQ ID NO: 7816 - protein, 25 aa, Homo sapiens
RHQGVMVGMGQKDSYVGDEAQSKRG

SEQ ID NO: 7817 - protein, 24 aa, Homo sapiens
RGILTLKYPIEHGIVTNWDDMEKI

SEQ ID NO: 7818 - protein, 25 aa, Homo sapiens
RHQGVMVGMGQKDSYVGDEAQSKRG

SEQ ID NO: 7819 - protein, 25 aa, Homo sapiens
RHQGVMVGMGQKDSYVGDEAQSKRG

SEQ ID NO: 7820 - protein, 24 aa, Homo sapiens
RGILTLKYPIEHGIVTNWDDMEKI

SEQ ID NO: 7821 - protein, 25 aa, Homo sapiens
RHQGVMVGMGQKDSYVGDEAQSKRG

SEQ ID NO: 7822 - protein, 24 aa, Homo sapiens
RGILTLKYPIEHGIVTNWDDMEKI

SEQ ID NO: 7823 - protein, 24 aa, Homo sapiens
RGILTLKYPIEHGIVTNWDDMEKI

SEQ ID NO: 7824 - protein, 24 aa, Homo sapiens
RGILTLKYPIEHGIVTNWDDMEKI

SEQ ID NO: 7825 - protein, 25 aa, Homo sapiens
RHQGVMVGMGQKDSYVGDEAQSKRG

SEQ ID NO: 7826 - protein, 25 aa, Homo sapiens
RHQGVMVGMGQKDSYVGDEAQSKRG

SEQ ID NO: 7827 - protein, 24 aa, Homo sapiens
RGILTLKYPIEHGIVTNWDDMEKI

SEQ ID NO: 7828 - protein, 24 aa, Homo sapiens
RGILTLKYPIEHGIVTNWDDMEKI

SEQ ID NO: 7829 - protein, 25 aa, Homo sapiens
RHQGVMVGMGQKDSYVGDEAQSKRG

SEQ ID NO: 7830 - protein, 24 aa, Homo sapiens
RGILTLKYPIEHGIVTNWDDMEKI

SEQ ID NO: 7831 - protein, 24 aa, Homo sapiens
RGILTLKYPIEHGIVTNWDDMEKI

SEQ ID NO: 7832 - protein, 24 aa, Homo sapiens
RGILTLKYPIEHGIVTNWDDMEKI

SEQ ID NO: 7833 - protein, 24 aa, Homo sapiens
RGILTLKYPIEHGIVTNWDDMEKI

SEQ ID NO: 7834 - protein, 25 aa, Homo sapiens
RHQGVMVGMGQKDSYVGDEAQSKRG

SEQ ID NO: 7835 - protein, 25 aa, Homo sapiens
RHQGVMVGMGQKDSYVGDEAQSKRG

SEQ ID NO: 7836 - protein, 24 aa, Homo sapiens
RGILTLKYPIEHGIVTNWDDMEKI

SEQ ID NO: 7837 - protein, 24 aa, Homo sapiens
RGILTLKYPIEHGIVTNWDDMEKI

SEQ ID NO: 7838 - protein, 24 aa, Homo sapiens
RGILTLKYPIEHGIVTNWDDMEKI

SEQ ID NO: 7839 - protein, 24 aa, Homo sapiens
RGILTLKYPIEHGIVTNWDDMEKI

SEQ ID NO: 7840 - protein, 24 aa, Homo sapiens
RGILTLKYPIEHGIVTNWDDMEKI

SEQ ID NO: 7841 - protein, 24 aa, Homo sapiens
RGILTLKYPIEHGIVTNWDDMEKI

SEQ ID NO: 7842 - protein, 25 aa, Homo sapiens
RHQGVMVGMGQKDSYVGDEAQSKRG

SEQ ID NO: 7843 - protein, 24 aa, Homo sapiens
RGILTLKYPIEHGIVTNWDDMEKI

SEQ ID NO: 7844 - protein, 24 aa, Homo sapiens
RGILTLKYPIEHGIVTNWDDMEKI

SEQ ID NO: 7845 - protein, 24 aa, Homo sapiens
RGILTLKYPIEHGIVTNWDDMEKI

SEQ ID NO: 7846 - protein, 24 aa, Homo sapiens
RGILTLKYPIEHGIVTNWDDMEKI

SEQ ID NO: 7847 - protein, 24 aa, Homo sapiens
RGILTLKYPIEHGIVTNWDDMEKI

SEQ ID NO: 7848 - protein, 25 aa, Homo sapiens
RHQGVMVGMGQKDSYVGDEAQSKRG

SEQ ID NO: 7849 - protein, 24 aa, Homo sapiens
RGILTLKYPIEHGIVTNWDDMEKI

SEQ ID NO: 7850 - protein, 24 aa, Homo sapiens
RGILTLKYPIEHGIVTNWDDMEKI

SEQ ID NO: 7851 - protein, 16 aa, Homo sapiens
RVTASSGITIPKPPKP

SEQ ID NO: 7852 - protein, 16 aa, Homo sapiens
RVTASSGITIPKPPKP

SEQ ID NO: 7853 - protein, 16 aa, Homo sapiens
RVTASSGITIPKPPKP

SEQ ID NO: 7854 - protein, 16 aa, Homo sapiens
RVTASSGITIPKPPKP

SEQ ID NO: 7855 - protein, 13 aa, Homo sapiens
KPPDKPLMPYMRY

SEQ ID NO: 7856 - protein, 16 aa, Homo sapiens
RVTASSGITIPKPPKP

SEQ ID NO: 7857 - protein, 15 aa, Homo sapiens
KVWDQVKASNPDLKL

SEQ ID NO: 7858 - protein, 14 aa, Homo sapiens
RKLEAELLQIEERH

SEQ ID NO: 7859 - protein, 8 aa, Homo sapiens
RHQEKKRK

SEQ ID NO: 7860 - protein, 14 aa, Homo sapiens
RKLEAELLQIEERH

SEQ ID NO: 7861 - protein, 14 aa, Homo sapiens
RKLEAELLQIEERH

SEQ ID NO: 7862 - protein, 8 aa, Homo sapiens
RMQVLKRQ

SEQ ID NO: 7863 - protein, 15 aa, Homo sapiens
KLWEIGKIIGGMWRD

SEQ ID NO: 7864 - protein, 15 aa, Homo sapiens
KLWEIGKIIGGMWRD

SEQ ID NO: 7865 - protein, 8 aa, Homo sapiens
RMQVLKRQ

SEQ ID NO: 7866 - protein, 8 aa, Homo sapiens
RMQVLKRQ

SEQ ID NO: 7867 - protein, 8 aa, Homo sapiens
RMQVLKRQ

SEQ ID NO: 7868 - protein, 8 aa, Homo sapiens
RKRQEERE

SEQ ID NO: 7869 - protein, 14 aa, Homo sapiens
RKLEAELLQIEERH

SEQ ID NO: 7870 - protein, 14 aa, Homo sapiens
RKLEAELLQIEERH

SEQ ID NO: 7871 - protein, 14 aa, Homo sapiens
RKLEAELLQIEERH

SEQ ID NO: 7872 - protein, 8 aa, Homo sapiens
RMQVLKRQ

SEQ ID NO: 7873 - protein, 16 aa, Homo sapiens
RKFLESTDSFNNELKR

SEQ ID NO: 7874 - protein, 20 aa, Homo sapiens
RVTASSGITIPKPPKPPDKP

SEQ ID NO: 7875 - protein, 19 aa, Homo sapiens
KAYHNSPAYLAYINAKSRA

SEQ ID NO: 7876 - protein, 19 aa, Homo sapiens
KAYHNSPAYLAYINAKSRA

SEQ ID NO: 7877 - protein, 19 aa, Homo sapiens
KAYHNSPAYLAYINAKSRA

SEQ ID NO: 7878 - protein, 19 aa, Homo sapiens
KAYHNSPAYLAYINAKSRA

SEQ ID NO: 7879 - protein, 25 aa, Homo sapiens
KIEYNESMKAYHNSPAYLAYINAKS

SEQ ID NO: 7880 - protein, 25 aa, Homo sapiens
KIEYNESMKAYHNSPAYLAYINAKS

SEQ ID NO: 7881 - protein, 27 aa, Homo sapiens
RLCGLKVEVDMEKIAAEIAQAEEQARK

SEQ ID NO: 7882 - protein, 16 aa, Homo sapiens
KFLESTDSFNNELKRL

SEQ ID NO: 7883 - protein, 27 aa, Homo sapiens
RLCGLKVEVDMEKIAAEIAQAEEQARK

SEQ ID NO: 7884 - protein, 14 aa, Homo sapiens
RLCGLKVEVDMEKI

SEQ ID NO: 7885 - protein, 27 aa, Homo sapiens
RLCGLKVEVDMEKIAAEIAQAEEQARK

SEQ ID NO: 7886 - protein, 27 aa, Homo sapiens
RLCGLKVEVDMEKIAAEIAQAEEQARK

SEQ ID NO: 7887 - protein, 14 aa, Homo sapiens
RLCGLKVEVDMEKI

SEQ ID NO: 7888 - protein, 17 aa, Homo sapiens
RKFLESTDSFNNELKRL

SEQ ID NO: 7889 - protein, 27 aa, Homo sapiens
RLCGLKVEVDMEKIAAEIAQAEEQARK

SEQ ID NO: 7890 - protein, 27 aa, Homo sapiens
RLCGLKVEVDMEKIAAEIAQAEEQARK

SEQ ID NO: 7891 - protein, 14 aa, Homo sapiens
RLCGLKVEVDMEKI

SEQ ID NO: 7892 - protein, 27 aa, Homo sapiens
RLCGLKVEVDMEKIAAEIAQAEEQARK

SEQ ID NO: 7893 - protein, 14 aa, Homo sapiens
RLCGLKVEVDMEKI

SEQ ID NO: 7894 - protein, 27 aa, Homo sapiens
RLCGLKVEVDMEKIAAEIAQAEEQARK

SEQ ID NO: 7895 - protein, 17 aa, Homo sapiens
RKFLESTDSFNNELKRL

SEQ ID NO: 7896 - protein, 16 aa, Homo sapiens
KFLESTDSFNNELKRL

SEQ ID NO: 7897 - protein, 14 aa, Homo sapiens
RLCGLKVEVDMEKI

SEQ ID NO: 7898 - protein, 27 aa, Homo sapiens
RLCGLKVEVDMEKIAAEIAQAEEQARK

SEQ ID NO: 7899 - protein, 14 aa, Homo sapiens
RLCGLKVEVDMEKI

SEQ ID NO: 7900 - protein, 16 aa, Homo sapiens
KFLESTDSFNNELKRL

SEQ ID NO: 7901 - protein, 17 aa, Homo sapiens
RKFLESTDSFNNELKRL

SEQ ID NO: 7902 - protein, 16 aa, Homo sapiens
KFLESTDSFNNELKRL

SEQ ID NO: 7903 - protein, 16 aa, Homo sapiens
KFLESTDSFNNELKRL

SEQ ID NO: 7904 - protein, 14 aa, Homo sapiens
RLCGLKVEVDMEKI

SEQ ID NO: 7905 - protein, 14 aa, Homo sapiens
RLCGLKVEVDMEKI

SEQ ID NO: 7906 - protein, 17 aa, Homo sapiens
RKFLESTDSFNNELKRL

SEQ ID NO: 7907 - protein, 16 aa, Homo sapiens
KFLESTDSFNNELKRL

SEQ ID NO: 7908 - protein, 14 aa, Homo sapiens
RLCGLKVEVDMEKI

SEQ ID NO: 7909 - protein, 14 aa, Homo sapiens
RLCGLKVEVDMEKI

SEQ ID NO: 7910 - protein, 14 aa, Homo sapiens
RLCGLKVEVDMEKI

SEQ ID NO: 7911 - protein, 17 aa, Homo sapiens
RKFLESTDSFNNELKRL

SEQ ID NO: 7912 - protein, 27 aa, Homo sapiens
RLCGLKVEVDMEKIAAEIAQAEEQARK

SEQ ID NO: 7913 - protein, 14 aa, Homo sapiens
RLCGLKVEVDMEKI

SEQ ID NO: 7914 - protein, 14 aa, Homo sapiens
RLCGLKVEVDMEKI

SEQ ID NO: 7915 - protein, 16 aa, Homo sapiens
KFLESTDSFNNELKRL

SEQ ID NO: 7916 - protein, 17 aa, Homo sapiens
RKFLESTDSFNNELKRL

SEQ ID NO: 7917 - protein, 27 aa, Homo sapiens
RLCGLKVEVDMEKIAAEIAQAEEQARK

SEQ ID NO: 7918 - protein, 14 aa, Homo sapiens
RLCGLKVEVDMEKI

SEQ ID NO: 7919 - protein, 14 aa, Homo sapiens
RLCGLKVEVDMEKI

SEQ ID NO: 7920 - protein, 17 aa, Homo sapiens
RKFLESTDSFNNELKRL

SEQ ID NO: 7921 - protein, 16 aa, Homo sapiens
KFLESTDSFNNELKRL

SEQ ID NO: 7922 - protein, 14 aa, Homo sapiens
RLCGLKVEVDMEKI

SEQ ID NO: 7923 - protein, 14 aa, Homo sapiens
RLCGLKVEVDMEKI

SEQ ID NO: 7924 - protein, 14 aa, Homo sapiens
RLCGLKVEVDMEKI

SEQ ID NO: 7925 - protein, 14 aa, Homo sapiens
RLCGLKVEVDMEKI

SEQ ID NO: 7926 - protein, 14 aa, Homo sapiens
RLCGLKVEVDMEKI

SEQ ID NO: 7927 - protein, 17 aa, Homo sapiens
RKFLESTDSFNNELKRL

SEQ ID NO: 7928 - protein, 14 aa, Homo sapiens
RLCGLKVEVDMEKI

SEQ ID NO: 7929 - protein, 17 aa, Homo sapiens
RKFLESTDSFNNELKRL

SEQ ID NO: 7930 - protein, 14 aa, Homo sapiens
RLCGLKVEVDMEKI

SEQ ID NO: 7931 - protein, 14 aa, Homo sapiens
RLCGLKVEVDMEKI

SEQ ID NO: 7932 - protein, 14 aa, Homo sapiens
RLCGLKVEVDMEKI

SEQ ID NO: 7933 - protein, 14 aa, Homo sapiens
RLCGLKVEVDMEKI

SEQ ID NO: 7934 - protein, 14 aa, Homo sapiens
RLCGLKVEVDMEKI

SEQ ID NO: 7935 - protein, 14 aa, Homo sapiens
RLCGLKVEVDMEKI

SEQ ID NO: 7936 - protein, 14 aa, Homo sapiens
RLCGLKVEVDMEKI

SEQ ID NO: 7937 - protein, 16 aa, Homo sapiens
KFLESTDSFNNELKRL

SEQ ID NO: 7938 - protein, 17 aa, Homo sapiens
RKFLESTDSFNNELKRL

SEQ ID NO: 7939 - protein, 22 aa, Homo sapiens
KVEVDMEKIAAEIAQAEEQARK

SEQ ID NO: 7940 - protein, 22 aa, Homo sapiens
KVEVDMEKIAAEIAQAEEQARK

SEQ ID NO: 7941 - protein, 22 aa, Homo sapiens
KVEVDMEKIAAEIAQAEEQARK

SEQ ID NO: 7942 - protein, 16 aa, Homo sapiens
RQEEREKEAAEQAERS

SEQ ID NO: 7943 - protein, 16 aa, Homo sapiens
RQEEREKEAAEQAERS

SEQ ID NO: 7944 - protein, 8 aa, Homo sapiens
RMQVLKRQ

SEQ ID NO: 7945 - protein, 12 aa, Homo sapiens
REKEAAEQAERS

SEQ ID NO: 7946 - protein, 12 aa, Homo sapiens
REKEAAEQAERS

SEQ ID NO: 7947 - protein, 12 aa, Homo sapiens
REKEAAEQAERS

SEQ ID NO: 7948 - protein, 16 aa, Homo sapiens
KFLESTDSFNNELKRL

SEQ ID NO: 7949 - protein, 8 aa, Homo sapiens
RHQEKKRK

SEQ ID NO: 7950 - protein, 8 aa, Homo sapiens
RHQEKKRK

SEQ ID NO: 7951 - protein, 17 aa, Homo sapiens
RKFLESTDSFNNELKRL

SEQ ID NO: 7952 - protein, 17 aa, Homo sapiens
RKFLESTDSFNNELKRL

SEQ ID NO: 7953 - protein, 8 aa, Homo sapiens
RHQEKKRK

SEQ ID NO: 7954 - protein, 7 aa, Homo sapiens
RHQEKKR

SEQ ID NO: 7955 - protein, 8 aa, Homo sapiens
RHQEKKRK

SEQ ID NO: 7956 - protein, 8 aa, Homo sapiens
RHQEKKRK

SEQ ID NO: 7957 - protein, 17 aa, Homo sapiens
RKFLESTDSFNNELKRL

SEQ ID NO: 7958 - protein, 17 aa, Homo sapiens
RKFLESTDSFNNELKRL

SEQ ID NO: 7959 - protein, 8 aa, Homo sapiens
RHQEKKRK

SEQ ID NO: 7960 - protein, 16 aa, Homo sapiens
RKFLESTDSFNNELKR

SEQ ID NO: 7961 - protein, 17 aa, Homo sapiens
RKFLESTDSFNNELKRL

SEQ ID NO: 7962 - protein, 17 aa, Homo sapiens
RKFLESTDSFNNELKRL

SEQ ID NO: 7963 - protein, 8 aa, Homo sapiens
RHQEKKRK

SEQ ID NO: 7964 - protein, 17 aa, Homo sapiens
RKFLESTDSFNNELKRL

SEQ ID NO: 7965 - protein, 17 aa, Homo sapiens
RKFLESTDSFNNELKRL

SEQ ID NO: 7966 - protein, 17 aa, Homo sapiens
RKFLESTDSFNNELKRL

SEQ ID NO: 7967 - protein, 17 aa, Homo sapiens
RKFLESTDSFNNELKRL

SEQ ID NO: 7968 - protein, 17 aa, Homo sapiens
RKFLESTDSFNNELKRL

SEQ ID NO: 7969 - protein, 17 aa, Homo sapiens
RKFLESTDSFNNELKRL

SEQ ID NO: 7970 - protein, 8 aa, Homo sapiens
RHQEKKRK

SEQ ID NO: 7971 - protein, 16 aa, Homo sapiens
RQEEREKEAAEQAERS

SEQ ID NO: 7972 - protein, 16 aa, Homo sapiens
RQEEREKEAAEQAERS

SEQ ID NO: 7973 - protein, 27 aa, Homo sapiens
RLCGLKVEVDMEKIAAEIAQAEEQARK

SEQ ID NO: 7974 - protein, 16 aa, Homo sapiens
RQEEREKEAAEQAERS

SEQ ID NO: 7975 - protein, 16 aa, Homo sapiens
RQEEREKEAAEQAERS

SEQ ID NO: 7976 - protein, 8 aa, Homo sapiens
RKPVDFKK

SEQ ID NO: 7977 - protein, 8 aa, Homo sapiens
RKPVDFKK

SEQ ID NO: 7978 - protein, 8 aa, Homo sapiens
RKPVDFKK

SEQ ID NO: 7979 - protein, 7 aa, Homo sapiens
RNHKYRS

SEQ ID NO: 7980 - protein, 9 aa, Homo sapiens
RIRNHKYRS

SEQ ID NO: 7981 - protein, 9 aa, Homo sapiens
RIRNHKYRS

SEQ ID NO: 7982 - protein, 9 aa, Homo sapiens
RIRNHKYRS

SEQ ID NO: 7983 - protein, 9 aa, Homo sapiens
RIRNHKYRS

SEQ ID NO: 7984 - protein, 7 aa, Homo sapiens
RNHKYRS

SEQ ID NO: 7985 - protein, 9 aa, Homo sapiens
RIRNHKYRS

SEQ ID NO: 7986 - protein, 9 aa, Homo sapiens
RIRNHKYRS

SEQ ID NO: 7987 - protein, 8 aa, Homo sapiens
RKPVDFKK

SEQ ID NO: 7988 - protein, 9 aa, Homo sapiens
RIRNHKYRS

SEQ ID NO: 7989 - protein, 9 aa, Homo sapiens
RIRNHKYRS

SEQ ID NO: 7990 - protein, 9 aa, Homo sapiens
RIRNHKYRS

SEQ ID NO: 7991 - protein, 6 aa, Homo sapiens
KIKERI

SEQ ID NO: 7992 - protein, 7 aa, Homo sapiens
RIEKERM

SEQ ID NO: 7993 - protein, 7 aa, Homo sapiens
RIEKERM

SEQ ID NO: 7994 - protein, 7 aa, Homo sapiens
RIEKERM

SEQ ID NO: 7995 - protein, 7 aa, Homo sapiens
RIEKERM

SEQ ID NO: 7996 - protein, 9 aa, Homo sapiens
RKLIDQKKD

SEQ ID NO: 7997 - protein, 7 aa, Homo sapiens
RIEKERM

SEQ ID NO: 7998 - protein, 22 aa, Homo sapiens
RLMEEDELPSWIIKDDAEVERL

SEQ ID NO: 7999 - protein, 22 aa, Homo sapiens
RLMEEDELPSWIIKDDAEVERL

SEQ ID NO: 8000 - protein, 13 aa, Homo sapiens
RKELPEYYELIRK

SEQ ID NO: 8001 - protein, 15 aa, Homo sapiens
RLTCEEEEEKIFGRG

SEQ ID NO: 8002 - protein, 15 aa, Homo sapiens
RLTCEEEEEKIFGRG

SEQ ID NO: 8003 - protein, 13 aa, Homo sapiens
RKELPEYYELIRK

SEQ ID NO: 8004 - protein, 22 aa, Homo sapiens
RLMEEDELPSWIIKDDAEVERL

SEQ ID NO: 8005 - protein, 15 aa, Homo sapiens
RLTCEEEEEKIFGRG

SEQ ID NO: 8006 - protein, 15 aa, Homo sapiens
RLTCEEEEEKIFGRG

SEQ ID NO: 8007 - protein, 15 aa, Homo sapiens
RLTCEEEEEKIFGRG

SEQ ID NO: 8008 - protein, 15 aa, Homo sapiens
RLTCEEEEEKIFGRG

SEQ ID NO: 8009 - protein, 15 aa, Homo sapiens
RLTCEEEEEKIFGRG

SEQ ID NO: 8010 - protein, 15 aa, Homo sapiens
RLTCEEEEEKIFGRG

SEQ ID NO: 8011 - protein, 15 aa, Homo sapiens
RLTCEEEEEKIFGRG

SEQ ID NO: 8012 - protein, 15 aa, Homo sapiens
RLTCEEEEEKIFGRG

SEQ ID NO: 8013 - protein, 15 aa, Homo sapiens
RLTCEEEEEKIFGRG

SEQ ID NO: 8014 - protein, 15 aa, Homo sapiens
RLTCEEEEEKIFGRG

SEQ ID NO: 8015 - protein, 15 aa, Homo sapiens
RLTCEEEEEKIFGRG

SEQ ID NO: 8016 - protein, 15 aa, Homo sapiens
RLTCEEEEEKIFGRG

SEQ ID NO: 8017 - protein, 15 aa, Homo sapiens
RLTCEEEEEKIFGRG

SEQ ID NO: 8018 - protein, 18 aa, Homo sapiens
KVIQAGMFDQKSSSHERR

SEQ ID NO: 8019 - protein, 13 aa, Homo sapiens
RKELPEYYELIRK

SEQ ID NO: 8020 - protein, 18 aa, Homo sapiens
KHQEYLNSILQHAKDFKE

SEQ ID NO: 8021 - protein, 18 aa, Homo sapiens
KHQEYLNSILQHAKDFKE

SEQ ID NO: 8022 - protein, 8 aa, Homo sapiens
KLIDQKKD

SEQ ID NO: 8023 - protein, 9 aa, Homo sapiens
RKLIDQKKD

SEQ ID NO: 8024 - protein, 10 aa, Homo sapiens
REQKKETERI

SEQ ID NO: 8025 - protein, 17 aa, Homo sapiens
KAVATWHANTEREQKKE

SEQ ID NO: 8026 - protein, 17 aa, Homo sapiens
KAVATWHANTEREQKKE

SEQ ID NO: 8027 - protein, 17 aa, Homo sapiens
KAVATWHANTEREQKKE

SEQ ID NO: 8028 - protein, 17 aa, Homo sapiens
RDVDYSDALTEKQWLRA

SEQ ID NO: 8029 - protein, 12 aa, Homo sapiens
KISYKGTPAMRR

SEQ ID NO: 8030 - protein, 12 aa, Homo sapiens
KISYKGTPAMRR

SEQ ID NO: 8031 - protein, 20 aa, Homo sapiens
KNHHCKLTQVLNTHYVAPRR

SEQ ID NO: 8032 - protein, 20 aa, Homo sapiens
KNHHCKLTQVLNTHYVAPRR

SEQ ID NO: 8033 - protein, 20 aa, Homo sapiens
KNHHCKLTQVLNTHYVAPRR

SEQ ID NO: 8034 - protein, 20 aa, Homo sapiens
KNHHCKLTQVLNTHYVAPRR

SEQ ID NO: 8035 - protein, 22 aa, Homo sapiens
RMKNHHCKLTQVLNTHYVAPRR

SEQ ID NO: 8036 - protein, 20 aa, Homo sapiens
KNHHCKLTQVLNTHYVAPRR

SEQ ID NO: 8037 - protein, 11 aa, Homo sapiens
KDKHILAKIRW

SEQ ID NO: 8038 - protein, 22 aa, Homo sapiens
RMKNHHCKLTQVLNTHYVAPRR

SEQ ID NO: 8039 - protein, 11 aa, Homo sapiens
KDKHILAKIRW

SEQ ID NO: 8040 - protein, 20 aa, Homo sapiens
KNHHCKLTQVLNTHYVAPRR

SEQ ID NO: 8041 - protein, 11 aa, Homo sapiens
KDKHILAKIRW

SEQ ID NO: 8042 - protein, 11 aa, Homo sapiens
KDKHILAKIRW

SEQ ID NO: 8043 - protein, 20 aa, Homo sapiens
KNHHCKLTQVLNTHYVAPRR

SEQ ID NO: 8044 - protein, 9 aa, Homo sapiens
KDKHILAKI

SEQ ID NO: 8045 - protein, 11 aa, Homo sapiens
KDKHILAKIRW

SEQ ID NO: 8046 - protein, 11 aa, Homo sapiens
KDKHILAKIRW

SEQ ID NO: 8047 - protein, 9 aa, Homo sapiens
KDKHILAKI

SEQ ID NO: 8048 - protein, 11 aa, Homo sapiens
KDKHILAKIRW

SEQ ID NO: 8049 - protein, 9 aa, Homo sapiens
KDKHILAKI

SEQ ID NO: 8050 - protein, 9 aa, Homo sapiens
KDKHILAKI

SEQ ID NO: 8051 - protein, 11 aa, Homo sapiens
KDKHILAKIRW

SEQ ID NO: 8052 - protein, 9 aa, Homo sapiens
KDKHILAKI

SEQ ID NO: 8053 - protein, 9 aa, Homo sapiens
KDKHILAKI

SEQ ID NO: 8054 - protein, 9 aa, Homo sapiens
KDKHILAKI

SEQ ID NO: 8055 - protein, 9 aa, Homo sapiens
KDKHILAKI

SEQ ID NO: 8056 - protein, 11 aa, Homo sapiens
KDKHILAKIRW

SEQ ID NO: 8057 - protein, 9 aa, Homo sapiens
KDKHILAKI

SEQ ID NO: 8058 - protein, 22 aa, Homo sapiens
RMKNHHCKLTQVLNTHYVAPRR

SEQ ID NO: 8059 - protein, 11 aa, Homo sapiens
KDKHILAKIRW

SEQ ID NO: 8060 - protein, 9 aa, Homo sapiens
KDKHILAKI

SEQ ID NO: 8061 - protein, 9 aa, Homo sapiens
KDKHILAKI

SEQ ID NO: 8062 - protein, 11 aa, Homo sapiens
KDKHILAKIRW

SEQ ID NO: 8063 - protein, 10 aa, Homo sapiens
RSVAGKIQKL

SEQ ID NO: 8064 - protein, 18 aa, Homo sapiens
RLCTVNSVEEKILAAAKY

SEQ ID NO: 8065 - protein, 18 aa, Homo sapiens
RLCTVNSVEEKILAAAKY

SEQ ID NO: 8066 - protein, 12 aa, Homo sapiens
KISYKGTPAMRR

SEQ ID NO: 8067 - protein, 18 aa, Homo sapiens
RSGKFNVLLTTYEYIIKD

SEQ ID NO: 8068 - protein, 18 aa, Homo sapiens
RSGKFNVLLTTYEYIIKD

SEQ ID NO: 8069 - protein, 13 aa, Homo sapiens
RWKYMIVDEGHRM

SEQ ID NO: 8070 - protein, 18 aa, Homo sapiens
KILLDPNSEEVSEKDAKQ

SEQ ID NO: 8071 - protein, 18 aa, Homo sapiens
KILLDPNSEEVSEKDAKQ

SEQ ID NO: 8072 - protein, 18 aa, Homo sapiens
KILLDPNSEEVSEKDAKQ

SEQ ID NO: 8073 - protein, 18 aa, Homo sapiens
KILLDPNSEEVSEKDAKQ

SEQ ID NO: 8074 - protein, 18 aa, Homo sapiens
KILLDPNSEEVSEKDAKQ

SEQ ID NO: 8075 - protein, 18 aa, Homo sapiens
KILLDPNSEEVSEKDAKQ

SEQ ID NO: 8076 - protein, 18 aa, Homo sapiens
KILLDPNSEEVSEKDAKQ

SEQ ID NO: 8077 - protein, 18 aa, Homo sapiens
KILLDPNSEEVSEKDAKQ

SEQ ID NO: 8078 - protein, 18 aa, Homo sapiens
KILLDPNSEEVSEKDAKQ

SEQ ID NO: 8079 - protein, 23 aa, Homo sapiens
KQIIETAKQDVDDEYSMQYSARG

SEQ ID NO: 8080 - protein, 18 aa, Homo sapiens
KILLDPNSEEVSEKDAKQ

SEQ ID NO: 8081 - protein, 23 aa, Homo sapiens
KQIIETAKQDVDDEYSMQYSARG

SEQ ID NO: 8082 - protein, 23 aa, Homo sapiens
KQIIETAKQDVDDEYSMQYSARG

SEQ ID NO: 8083 - protein, 23 aa, Homo sapiens
KQIIETAKQDVDDEYSMQYSARG

SEQ ID NO: 8084 - protein, 23 aa, Homo sapiens
KQIIETAKQDVDDEYSMQYSARG

SEQ ID NO: 8085 - protein, 23 aa, Homo sapiens
KQIIETAKQDVDDEYSMQYSARG

SEQ ID NO: 8086 - protein, 7 aa, Homo sapiens
RIEKERM

SEQ ID NO: 8087 - protein, 10 aa, Homo sapiens
KLIDQKKDRR

SEQ ID NO: 8088 - protein, 10 aa, Homo sapiens
KLIDQKKDRR

SEQ ID NO: 8089 - protein, 13 aa, Homo sapiens
RKELPEYYELIRK

SEQ ID NO: 8090 - protein, 13 aa, Homo sapiens
RKELPEYYELIRK

SEQ ID NO: 8091 - protein, 13 aa, Homo sapiens
RKELPEYYELIRK

SEQ ID NO: 8092 - protein, 13 aa, Homo sapiens
RKELPEYYELIRK

SEQ ID NO: 8093 - protein, 13 aa, Homo sapiens
RKELPEYYELIRK

SEQ ID NO: 8094 - protein, 13 aa, Homo sapiens
RKELPEYYELIRK

SEQ ID NO: 8095 - protein, 13 aa, Homo sapiens
RKELPEYYELIRK

SEQ ID NO: 8096 - protein, 13 aa, Homo sapiens
RKELPEYYELIRK

SEQ ID NO: 8097 - protein, 13 aa, Homo sapiens
RKELPEYYELIRK

SEQ ID NO: 8098 - protein, 13 aa, Homo sapiens
RKELPEYYELIRK

SEQ ID NO: 8099 - protein, 13 aa, Homo sapiens
RKELPEYYELIRK

SEQ ID NO: 8100 - protein, 13 aa, Homo sapiens
RKELPEYYELIRK

SEQ ID NO: 8101 - protein, 7 aa, Homo sapiens
RNHKYRS

SEQ ID NO: 8102 - protein, 17 aa, Homo sapiens
RDVDYSDALTEKQWLRA

SEQ ID NO: 8103 - protein, 9 aa, Homo sapiens
RIRNHKYRS

SEQ ID NO: 8104 - protein, 12 aa, Homo sapiens
KISYKGTPAMRR

SEQ ID NO: 8105 - protein, 15 aa, Homo sapiens
RLTCEEEEEKIFGRG

SEQ ID NO: 8106 - protein, 8 aa, Homo sapiens
RILPKLRA

SEQ ID NO: 8107 - protein, 12 aa, Homo sapiens
RASGKFELLDRI

SEQ ID NO: 8108 - protein, 18 aa, Homo sapiens
KVIQAGMFDQKSSSHERR

SEQ ID NO: 8109 - protein, 18 aa, Homo sapiens
KVIQAGMFDQKSSSHERR

SEQ ID NO: 8110 - protein, 10 aa, Homo sapiens
KYKLNVDQKV

SEQ ID NO: 8111 - protein, 18 aa, Homo sapiens
KVIQAGMFDQKSSSHERR

SEQ ID NO: 8112 - protein, 19 aa, Homo sapiens
KVIQAGMFDQKSSSHERRA

SEQ ID NO: 8113 - protein, 16 aa, Homo sapiens
KILAAAKYKLNVDQKV

SEQ ID NO: 8114 - protein, 19 aa, Homo sapiens
KVIQAGMFDQKSSSHERRA

SEQ ID NO: 8115 - protein, 18 aa, Homo sapiens
KVIQAGMFDQKSSSHERR

SEQ ID NO: 8116 - protein, 16 aa, Homo sapiens
KILAAAKYKLNVDQKV

SEQ ID NO: 8117 - protein, 10 aa, Homo sapiens
KYKLNVDQKV

SEQ ID NO: 8118 - protein, 19 aa, Homo sapiens
KVIQAGMFDQKSSSHERRA

SEQ ID NO: 8119 - protein, 10 aa, Homo sapiens
KYKLNVDQKV

SEQ ID NO: 8120 - protein, 10 aa, Homo sapiens
KYKLNVDQKV

SEQ ID NO: 8121 - protein, 19 aa, Homo sapiens
KVIQAGMFDQKSSSHERRA

SEQ ID NO: 8122 - protein, 19 aa, Homo sapiens
KVIQAGMFDQKSSSHERRA

SEQ ID NO: 8123 - protein, 18 aa, Homo sapiens
KVIQAGMFDQKSSSHERR

SEQ ID NO: 8124 - protein, 13 aa, Homo sapiens
RKELPEYYELIRK

SEQ ID NO: 8125 - protein, 7 aa, Homo sapiens
KKIKERI

SEQ ID NO: 8126 - protein, 7 aa, Homo sapiens
KKIKERI

SEQ ID NO: 8127 - protein, 7 aa, Homo sapiens
RNHKYRS

SEQ ID NO: 8128 - protein, 7 aa, Homo sapiens
RNHKYRS

SEQ ID NO: 8129 - protein, 7 aa, Homo sapiens
RNHKYRS

SEQ ID NO: 8130 - protein, 7 aa, Homo sapiens
RNHKYRS

SEQ ID NO: 8131 - protein, 13 aa, Homo sapiens
RLHKVLRPFLLRR

SEQ ID NO: 8132 - protein, 13 aa, Homo sapiens
RLHKVLRPFLLRR

SEQ ID NO: 8133 - protein, 13 aa, Homo sapiens
RLHKVLRPFLLRR

SEQ ID NO: 8134 - protein, 8 aa, Homo sapiens
KLIDQKKD

SEQ ID NO: 8135 - protein, 13 aa, Homo sapiens
RLHKVLRPFLLRR

SEQ ID NO: 8136 - protein, 18 aa, Homo sapiens
KTIQTIALITYLMEHKRI

SEQ ID NO: 8137 - protein, 18 aa, Homo sapiens
KTIQTIALITYLMEHKRI

SEQ ID NO: 8138 - protein, 18 aa, Homo sapiens
KTIQTIALITYLMEHKRI

SEQ ID NO: 8139 - protein, 18 aa, Homo sapiens
KTIQTIALITYLMEHKRI

SEQ ID NO: 8140 - protein, 13 aa, Homo sapiens
RWKYMIVDEGHRM

SEQ ID NO: 8141 - protein, 13 aa, Homo sapiens
RWKYMIVDEGHRM

SEQ ID NO: 8142 - protein, 13 aa, Homo sapiens
RWKYMIVDEGHRM

SEQ ID NO: 8143 - protein, 13 aa, Homo sapiens
RWKYMIVDEGHRM

SEQ ID NO: 8144 - protein, 13 aa, Homo sapiens
RWKYMIVDEGHRM

SEQ ID NO: 8145 - protein, 13 aa, Homo sapiens
RWKYMIVDEGHRM

SEQ ID NO: 8146 - protein, 23 aa, Homo sapiens
RPGDLNVKCTLLLMLDHQPPQYK

SEQ ID NO: 8147 - protein, 23 aa, Homo sapiens
RPGDLNVKCTLLLMLDHQPPQYK

SEQ ID NO: 8148 - protein, 23 aa, Homo sapiens
RPGDLNVKCTLLLMLDHQPPQYK

SEQ ID NO: 8149 - protein, 14 aa, Homo sapiens
MPTTQETDGFQVKR

SEQ ID NO: 8150 - protein, 14 aa, Homo sapiens
MPTTQETDGFQVKR

SEQ ID NO: 8151 - protein, 14 aa, Homo sapiens
MPTTQETDGFQVKR

SEQ ID NO: 8152 - protein, 23 aa, Homo sapiens
RPGDLNVKCTLLLMLDHQPPQYK

SEQ ID NO: 8153 - protein, 14 aa, Homo sapiens
MPTTQETDGFQVKR

SEQ ID NO: 8154 - protein, 14 aa, Homo sapiens
MPTTQETDGFQVKR

SEQ ID NO: 8155 - protein, 14 aa, Homo sapiens
MPTTQETDGFQVKR

SEQ ID NO: 8156 - protein, 14 aa, Homo sapiens
MPTTQETDGFQVKR

SEQ ID NO: 8157 - protein, 23 aa, Homo sapiens
RPGDLNVKCTLLLMLDHQPPQYK

SEQ ID NO: 8158 - protein, 14 aa, Homo sapiens
MPTTQETDGFQVKR

SEQ ID NO: 8159 - protein, 14 aa, Homo sapiens
MPTTQETDGFQVKR

SEQ ID NO: 8160 - protein, 23 aa, Homo sapiens
RPGDLNVKCTLLLMLDHQPPQYK

SEQ ID NO: 8161 - protein, 26 aa, Homo sapiens
LAGLLQHPDPIVINHVISVDPNDQKK

SEQ ID NO: 8162 - protein, 26 aa, Homo sapiens
LAGLLQHPDPIVINHVISVDPNDQKK

SEQ ID NO: 8163 - protein, 21 aa, Homo sapiens
MPTTQETDGFQVKRPGDLNVK

SEQ ID NO: 8164 - protein, 10 aa, Homo sapiens
KMADKVLPQR

SEQ ID NO: 8165 - protein, 15 aa, Homo sapiens
IHETIESINQLKTQR

SEQ ID NO: 8166 - protein, 9 aa, Homo sapiens
MEIQEAIKK

SEQ ID NO: 8167 - protein, 9 aa, Homo sapiens
MEIQEAIKK

SEQ ID NO: 8168 - protein, 10 aa, Homo sapiens
RMEIQEAIKK

SEQ ID NO: 8169 - protein, 9 aa, Homo sapiens
MEIQEAIKK

SEQ ID NO: 8170 - protein, 10 aa, Homo sapiens
RMEIQEAIKK

SEQ ID NO: 8171 - protein, 9 aa, Homo sapiens
MEIQEAIKK

SEQ ID NO: 8172 - protein, 9 aa, Homo sapiens
MEIQEAIKK

SEQ ID NO: 8173 - protein, 9 aa, Homo sapiens
MEIQEAIKK

SEQ ID NO: 8174 - protein, 10 aa, Homo sapiens
RMEIQEAIKK

SEQ ID NO: 8175 - protein, 3 aa, Homo sapiens
KLR

SEQ ID NO: 8176 - protein, 10 aa, Homo sapiens
RMEIQEAIKK

SEQ ID NO: 8177 - protein, 9 aa, Homo sapiens
MEIQEAIKK

SEQ ID NO: 8178 - protein, 7 aa, Homo sapiens
KPLTQKR

SEQ ID NO: 8179 - protein, 38 aa, Homo sapiens
IYISNTFSPSKAEGDSAGTAGTPGGTPAGDKVASWELR

SEQ ID NO: 8180 - protein, 38 aa, Homo sapiens; identical to SEQ ID NO: 8179

SEQ ID NO: 8181 - protein, 38 aa, Homo sapiens; identical to SEQ ID NO: 8179

SEQ ID NO: 8182 - protein, 31 aa, Homo sapiens
IYISNTFSPSKAEGDSAGTAGTPGGTPAGDK

SEQ ID NO: 8183 - protein, 31 aa, Homo sapiens; identical to SEQ ID NO: 8182

SEQ ID NO: 8184 - protein, 31 aa, Homo sapiens; identical to SEQ ID NO: 8182

SEQ ID NO: 8185 - protein, 31 aa, Homo sapiens; identical to SEQ ID NO: 8182

SEQ ID NO: 8186 - protein, 31 aa, Homo sapiens; identical to SEQ ID NO: 8182

SEQ ID NO: 8187 - protein, 17 aa, Homo sapiens
DLKIITDVIGNPEEERR

SEQ ID NO: 8188 - protein, 38 aa, Homo sapiens; identical to SEQ ID NO: 8179

SEQ ID NO: 8189 - protein, 27 aa, Homo sapiens
AEGDSAGTAGTPGGTPAGDKVASWELR

SEQ ID NO: 8190 - protein, 38 aa, Homo sapiens; identical to SEQ ID NO: 8179

SEQ ID NO: 8191 - protein, 26 aa, Homo sapiens
LAGLLQHPDPIVINHVISVDPNDQKK

SEQ ID NO: 8192 - protein, 26 aa, Homo sapiens
LAGLLQHPDPIVINHVISVDPNDQKK

SEQ ID NO: 8193 - protein, 11 aa, Homo sapiens
VEGKLLDDPSK

SEQ ID NO: 8194 - protein, 11 aa, Homo sapiens
VEGKLLDDPSK

SEQ ID NO: 8195 - protein, 10 aa, Homo sapiens
KRMEIQEAIK

SEQ ID NO: 8196 - protein, 9 aa, Homo sapiens
HIFAKVQQR

SEQ ID NO: 8197 - protein, 31 aa, Homo sapiens; identical to SEQ ID NO: 1672

SEQ ID NO: 8198 - protein, 31 aa, Homo sapiens; identical to SEQ ID NO: 1672

SEQ ID NO: 8199 - protein, 31 aa, Homo sapiens; identical to SEQ ID NO: 1672

SEQ ID NO: 8200 - protein, 15 aa, Homo sapiens
VASAAAKSALEEFSK

SEQ ID NO: 8201 - protein, 15 aa, Homo sapiens
VASAAAKSALEEFSK

SEQ ID NO: 8202 - protein, 31 aa, Homo sapiens; identical to SEQ ID NO: 1672

SEQ ID NO: 8203 - protein, 31 aa, Homo sapiens; identical to SEQ ID NO: 1672

SEQ ID NO: 8204 - protein, 13 aa, Homo sapiens
DDWNKVSEHVGSR

SEQ ID NO: 8205 - protein, 31 aa, Homo sapiens; identical to SEQ ID NO: 1672

SEQ ID NO: 8206 - protein, 31 aa, Homo sapiens; identical to SEQ ID NO: 1672

SEQ ID NO: 8207 - protein, 23 aa, Homo sapiens
DMDEPSPVPNVEEVTLPKTVNTK

SEQ ID NO: 8208 - protein, 8 aa, Homo sapiens
LWLGKNYK

SEQ ID NO: 8209 - protein, 10 aa, Homo sapiens
AKHLAAVEER

SEQ ID NO: 8210 - protein, 6 aa, Homo sapiens
KTKVER

SEQ ID NO: 8211 - protein, 6 aa, Homo sapiens
KTKVER

SEQ ID NO: 8212 - protein, 6 aa, Homo sapiens
KTKVER

SEQ ID NO: 8213 - protein, 23 aa, Homo sapiens
DIGEGNLSTAAAAALAAAAVKAK

SEQ ID NO: 8214 - protein, 23 aa, Homo sapiens
DIGEGNLSTAAAAALAAAAVKAK

SEQ ID NO: 8215 - protein, 23 aa, Homo sapiens
DIGEGNLSTAAAAALAAAAVKAK

SEQ ID NO: 8216 - protein, 12 aa, Homo sapiens
EKPTDMQNFGLR

SEQ ID NO: 8217 - protein, 12 aa, Homo sapiens
EKPTDMQNFGLR

SEQ ID NO: 8218 - protein, 19 aa, Homo sapiens
TPQQTSASQQMLNFPDKGK

SEQ ID NO: 8219 - protein, 12 aa, Homo sapiens
EKPTDMQNFGLR

SEQ ID NO: 8220 - protein, 12 aa, Homo sapiens
EKPTDMQNFGLR

SEQ ID NO: 8221 - protein, 12 aa, Homo sapiens
EKPTDMQNFGLR

SEQ ID NO: 8222 - protein, 19 aa, Homo sapiens
TPQQTSASQQMLNFPDKGK

SEQ ID NO: 8223 - protein, 12 aa, Homo sapiens
TDMYTKKNVPSK

SEQ ID NO: 8224 - protein, 7 aa, Homo sapiens
KVEEAAK

SEQ ID NO: 8225 - protein, 15 aa, Homo sapiens
MKEEVPTALVEAHVR

SEQ ID NO: 8226 - protein, 9 aa, Homo sapiens
SKAAASATR

SEQ ID NO: 8227 - protein, 9 aa, Homo sapiens
SKAAASATR

SEQ ID NO: 8228 - protein, 9 aa, Homo sapiens
SKAAASATR

SEQ ID NO: 8229 - protein, 9 aa, Homo sapiens
SKAAASATR

SEQ ID NO: 8230 - protein, 15 aa, Homo sapiens
VASAAAKSALEEFSK

SEQ ID NO: 8231 - protein, 26 aa, Homo sapiens
TKVERDIGEGNLSTAAAAALAAAAVK

SEQ ID NO: 8232 - protein, 15 aa, Homo sapiens
VASAAAKSALEEFSK

SEQ ID NO: 8233 - protein, 15 aa, Homo sapiens
VASAAAKSALEEFSK

SEQ ID NO: 8234 - protein, 15 aa, Homo sapiens
MKEEVPTALVEAHVR

SEQ ID NO: 8235 - protein, 15 aa, Homo sapiens
MKEEVPTALVEAHVR

SEQ ID NO: 8236 - protein, 15 aa, Homo sapiens
VASAAAKSALEEFSK

SEQ ID NO: 8237 - protein, 15 aa, Homo sapiens
MKEEVPTALVEAHVR

SEQ ID NO: 8238 - protein, 15 aa, Homo sapiens
VASAAAKSALEEFSK

SEQ ID NO: 8239 - protein, 23 aa, Homo sapiens
SALEEFSKMKEEVPTALVEAHVR

SEQ ID NO: 8240 - protein, 15 aa, Homo sapiens
MKEEVPTALVEAHVR

SEQ ID NO: 8241 - protein, 15 aa, Homo sapiens
VASAAAKSALEEFSK

SEQ ID NO: 8242 - protein, 15 aa, Homo sapiens
MKEEVPTALVEAHVR

SEQ ID NO: 8243 - protein, 15 aa, Homo sapiens
VASAAAKSALEEFSK

SEQ ID NO: 8244 - protein, 15 aa, Homo sapiens
VASAAAKSALEEFSK

SEQ ID NO: 8245 - protein, 15 aa, Homo sapiens
VASAAAKSALEEFSK

SEQ ID NO: 8246 - protein, 15 aa, Homo sapiens
VASAAAKSALEEFSK

SEQ ID NO: 8247 - protein, 15 aa, Homo sapiens
VASAAAKSALEEFSK

SEQ ID NO: 8248 - protein, 15 aa, Homo sapiens
VASAAAKSALEEFSK

SEQ ID NO: 8249 - protein, 15 aa, Homo sapiens
VASAAAKSALEEFSK

SEQ ID NO: 8250 - protein, 15 aa, Homo sapiens
VASAAAKSALEEFSK

SEQ ID NO: 8251 - protein, 15 aa, Homo sapiens
VASAAAKSALEEFSK

SEQ ID NO: 8252 - protein, 15 aa, Homo sapiens
VASAAAKSALEEFSK

SEQ ID NO: 8253 - protein, 15 aa, Homo sapiens
VASAAAKSALEEFSK

SEQ ID NO: 8254 - protein, 15 aa, Homo sapiens
VASAAAKSALEEFSK

SEQ ID NO: 8255 - protein, 23 aa, Homo sapiens
SALEEFSKMKEEVPTALVEAHVR

SEQ ID NO: 8256 - protein, 23 aa, Homo sapiens
SALEEFSKMKEEVPTALVEAHVR

SEQ ID NO: 8257 - protein, 23 aa, Homo sapiens
SALEEFSKMKEEVPTALVEAHVR

SEQ ID NO: 8258 - protein, 23 aa, Homo sapiens
SALEEFSKMKEEVPTALVEAHVR

SEQ ID NO: 8259 - protein, 23 aa, Homo sapiens
SALEEFSKMKEEVPTALVEAHVR

SEQ ID NO: 8260 - protein, 23 aa, Homo sapiens
SALEEFSKMKEEVPTALVEAHVR

SEQ ID NO: 8261 - protein, 23 aa, Homo sapiens
SALEEFSKMKEEVPTALVEAHVR

SEQ ID NO: 8262 - protein, 23 aa, Homo sapiens
SALEEFSKMKEEVPTALVEAHVR

SEQ ID NO: 8263 - protein, 23 aa, Homo sapiens
SALEEFSKMKEEVPTALVEAHVR

SEQ ID NO: 8264 - protein, 15 aa, Homo sapiens
VASAAAKSALEEFSK

SEQ ID NO: 8265 - protein, 15 aa, Homo sapiens
VASAAAKSALEEFSK

SEQ ID NO: 8266 - protein, 15 aa, Homo sapiens
VASAAAKSALEEFSK

SEQ ID NO: 8267 - protein, 15 aa, Homo sapiens
VASAAAKSALEEFSK

SEQ ID NO: 8268 - protein, 15 aa, Homo sapiens
VASAAAKSALEEFSK

SEQ ID NO: 8269 - protein, 23 aa, Homo sapiens
SALEEFSKMKEEVPTALVEAHVR

SEQ ID NO: 8270 - protein, 15 aa, Homo sapiens
VASAAAKSALEEFSK

SEQ ID NO: 8271 - protein, 15 aa, Homo sapiens
VASAAAKSALEEFSK

SEQ ID NO: 8272 - protein, 15 aa, Homo sapiens
VASAAAKSALEEFSK

SEQ ID NO: 8273 - protein, 15 aa, Homo sapiens
VASAAAKSALEEFSK

SEQ ID NO: 8274 - protein, 15 aa, Homo sapiens
VASAAAKSALEEFSK

SEQ ID NO: 8275 - protein, 15 aa, Homo sapiens
VASAAAKSALEEFSK

SEQ ID NO: 8276 - protein, 12 aa, Homo sapiens
EKPTDMQNFGLR

SEQ ID NO: 8277 - protein, 12 aa, Homo sapiens
EKPTDMQNFGLR

SEQ ID NO: 8278 - protein, 12 aa, Homo sapiens
EKPTDMQNFGLR

SEQ ID NO: 8279 - protein, 20 aa, Homo sapiens
EPKEGQEEVLKEVVESEGER

SEQ ID NO: 8280 - protein, 20 aa, Homo sapiens
EPKEGQEEVLKEVVESEGER

SEQ ID NO: 8281 - protein, 17 aa, Homo sapiens
EGQEEVLKEVVESEGER

SEQ ID NO: 8282 - protein, 10 aa, Homo sapiens
AKHLAAVEER

SEQ ID NO: 8283 - protein, 10 aa, Homo sapiens
AKHLAAVEER

SEQ ID NO: 8284 - protein, 10 aa, Homo sapiens
AKHLAAVEER

SEQ ID NO: 8285 - protein, 10 aa, Homo sapiens
AKHLAAVEER

SEQ ID NO: 8286 - protein, 15 aa, Homo sapiens
KIKSLVALLVETQMK

SEQ ID NO: 8287 - protein, 10 aa, Homo sapiens
AKHLAAVEER

SEQ ID NO: 8288 - protein, 10 aa, Homo sapiens
AKHLAAVEER

SEQ ID NO: 8289 - protein, 10 aa, Homo sapiens
AKHLAAVEER

SEQ ID NO: 8290 - protein, 10 aa, Homo sapiens
AKHLAAVEER

SEQ ID NO: 8291 - protein, 10 aa, Homo sapiens
AKHLAAVEER

SEQ ID NO: 8292 - protein, 10 aa, Homo sapiens
AKHLAAVEER

SEQ ID NO: 8293 - protein, 10 aa, Homo sapiens
AKHLAAVEER

SEQ ID NO: 8294 - protein, 10 aa, Homo sapiens
AKHLAAVEER

SEQ ID NO: 8295 - protein, 15 aa, Homo sapiens
KIKSLVALLVETQMK

SEQ ID NO: 8296 - protein, 10 aa, Homo sapiens
AKHLAAVEER

SEQ ID NO: 8297 - protein, 10 aa, Homo sapiens
AKHLAAVEER

SEQ ID NO: 8298 - protein, 15 aa, Homo sapiens
KIKSLVALLVETQMK

SEQ ID NO: 8299 - protein, 10 aa, Homo sapiens
AKHLAAVEER

SEQ ID NO: 8300 - protein, 15 aa, Homo sapiens
KIKSLVALLVETQMK

SEQ ID NO: 8301 - protein, 10 aa, Homo sapiens
AKHLAAVEER

SEQ ID NO: 8302 - protein, 10 aa, Homo sapiens
AKHLAAVEER

SEQ ID NO: 8303 - protein, 10 aa, Homo sapiens
AKHLAAVEER

SEQ ID NO: 8304 - protein, 10 aa, Homo sapiens
AKHLAAVEER

SEQ ID NO: 8305 - protein, 10 aa, Homo sapiens
AKHLAAVEER

SEQ ID NO: 8306 - protein, 10 aa, Homo sapiens
AKHLAAVEER

SEQ ID NO: 8307 - protein, 15 aa, Homo sapiens
KIKSLVALLVETQMK

SEQ ID NO: 8308 - protein, 10 aa, Homo sapiens
AKHLAAVEER

SEQ ID NO: 8309 - protein, 9 aa, Homo sapiens
KKDGGPNVK

SEQ ID NO: 8310 - protein, 9 aa, Homo sapiens
KDSESAPVK

SEQ ID NO: 8311 - protein, 7 aa, Homo sapiens
TDMYTKK

SEQ ID NO: 8312 - protein, 7 aa, Homo sapiens
TDMYTKK

SEQ ID NO: 8313 - protein, 9 aa, Homo sapiens
SKAAASATR

SEQ ID NO: 8314 - protein, 7 aa, Homo sapiens
TDMYTKK

SEQ ID NO: 8315 - protein, 7 aa, Homo sapiens
TDMYTKK

SEQ ID NO: 8316 - protein, 9 aa, Homo sapiens
SKAAASATR

SEQ ID NO: 8317 - protein, 9 aa, Homo sapiens
SKAAASATR

SEQ ID NO: 8318 - protein, 9 aa, Homo sapiens
SKAAASATR

SEQ ID NO: 8319 - protein, 9 aa, Homo sapiens
SKAAASATR

SEQ ID NO: 8320 - protein, 9 aa, Homo sapiens
SKAAASATR

SEQ ID NO: 8321 - protein, 9 aa, Homo sapiens
SKAAASATR

SEQ ID NO: 8322 - protein, 9 aa, Homo sapiens
SKAAASATR

SEQ ID NO: 8323 - protein, 9 aa, Homo sapiens
SKAAASATR

SEQ ID NO: 8324 - protein, 9 aa, Homo sapiens
SKAAASATR

SEQ ID NO: 8325 - protein, 9 aa, Homo sapiens
SKAAASATR

SEQ ID NO: 8326 - protein, 10 aa, Homo sapiens
VEGQATDEKK

SEQ ID NO: 8327 - protein, 10 aa, Homo sapiens
VEGQATDEKK

SEQ ID NO: 8328 - protein, 10 aa, Homo sapiens
VEGQATDEKK

SEQ ID NO: 8329 - protein, 10 aa, Homo sapiens
VEGQATDEKK

SEQ ID NO: 8330 - protein, 6 aa, Homo sapiens
EPKEPR

SEQ ID NO: 8331 - protein, 15 aa, Homo sapiens
MKEEVPTALVEAHVR

SEQ ID NO: 8332 - protein, 15 aa, Homo sapiens
MKEEVPTALVEAHVR

SEQ ID NO: 8333 - protein, 9 aa, Homo sapiens
SKAAASATR

SEQ ID NO: 8334 - protein, 9 aa, Homo sapiens
SKAAASATR

SEQ ID NO: 8335 - protein, 9 aa, Homo sapiens
SKAAASATR

SEQ ID NO: 8336 - protein, 9 aa, Homo sapiens
SKAAASATR

SEQ ID NO: 8337 - protein, 9 aa, Homo sapiens
SKAAASATR

SEQ ID NO: 8338 - protein, 28 aa, Homo sapiens
SLSSLVVQLLQFQEEVFGKHVSNAPLTK

SEQ ID NO: 8339 - protein, 28 aa, Homo sapiens
SLSSLVVQLLQFQEEVFGKHVSNAPLTK

SEQ ID NO: 8340 - protein, 28 aa, Homo sapiens
SLSSLVVQLLQFQEEVFGKHVSNAPLTK

SEQ ID NO: 8341 - protein, 28 aa, Homo sapiens
SLSSLVVQLLQFQEEVFGKHVSNAPLTK

SEQ ID NO: 8342 - protein, 28 aa, Homo sapiens
SLSSLVVQLLQFQEEVFGKHVSNAPLTK

SEQ ID NO: 8343 - protein, 30 aa, Homo sapiens
GHREEEQEDLTKDMDEPSPVPNVEEVTLPK

SEQ ID NO: 8344 - protein, 14 aa, Homo sapiens
TVNTKKDSESAPVK

SEQ ID NO: 8345 - protein, 30 aa, Homo sapiens; identical to SEQ ID NO: 8343

SEQ ID NO: 8346 - protein, 14 aa, Homo sapiens
TVNTKKDSESAPVK

SEQ ID NO: 8347 - protein, 30 aa, Homo sapiens; identical to SEQ ID NO: 8343

SEQ ID NO: 8348 - protein, 30 aa, Homo sapiens; identical to SEQ ID NO: 8343

SEQ ID NO: 8349 - protein, 14 aa, Homo sapiens
TVNTKKDSESAPVK

SEQ ID NO: 8350 - protein, 30 aa, Homo sapiens; identical to SEQ ID NO: 8343

SEQ ID NO: 8351 - protein, 30 aa, Homo sapiens; identical to SEQ ID NO: 8343

SEQ ID NO: 8352 - protein, 19 aa, Homo sapiens
EGGGAIEEEAKEKTSEAPK

SEQ ID NO: 8353 - protein, 19 aa, Homo sapiens
EGGGAIEEEAKEKTSEAPK

SEQ ID NO: 8354 - protein, 8 aa, Homo sapiens
EKTSEAPK

SEQ ID NO: 8355 - protein, 17 aa, Homo sapiens
EGQEEVLKEVVESEGER

SEQ ID NO: 8356 - protein, 7 aa, Homo sapiens
NVPSKSK

SEQ ID NO: 8357 - protein, 6 aa, Homo sapiens
KTKVER

SEQ ID NO: 8358 - protein, 17 aa, Homo sapiens
ESEKSDGDPIVDPEKEK

SEQ ID NO: 8359 - protein, 17 aa, Homo sapiens
ESEKSDGDPIVDPEKEK

SEQ ID NO: 8360 - protein, 17 aa, Homo sapiens
ESEKSDGDPIVDPEKEK

SEQ ID NO: 8361 - protein, 28 aa, Homo sapiens
WILDTDTFNEWMNEEDYEVNDDKNPVSR

SEQ ID NO: 8362 - protein, 28 aa, Homo sapiens
WILDTDTFNEWMNEEDYEVNDDKNPVSR

SEQ ID NO: 8363 - protein, 28 aa, Homo sapiens
WILDTDTFNEWMNEEDYEVNDDKNPVSR

SEQ ID NO: 8364 - protein, 28 aa, Homo sapiens
WILDTDTFNEWMNEEDYEVNDDKNPVSR

SEQ ID NO: 8365 - protein, 17 aa, Homo sapiens
EGQEEVLKEVVESEGER

SEQ ID NO: 8366 - protein, 6 aa, Homo sapiens
KTKVER

SEQ ID NO: 8367 - protein, 6 aa, Homo sapiens
KTKVER

SEQ ID NO: 8368 - protein, 6 aa, Homo sapiens
KTKVER

SEQ ID NO: 8369 - protein, 17 aa, Homo sapiens
EGQEEVLKEVVESEGER

SEQ ID NO: 8370 - protein, 6 aa, Homo sapiens
KTKVER

SEQ ID NO: 8371 - protein, 17 aa, Homo sapiens
EGQEEVLKEVVESEGER

SEQ ID NO: 8372 - protein, 17 aa, Homo sapiens
EGQEEVLKEVVESEGER

SEQ ID NO: 8373 - protein, 6 aa, Homo sapiens
KTKVER

SEQ ID NO: 8374 - protein, 17 aa, Homo sapiens
EGQEEVLKEVVESEGER

SEQ ID NO: 8375 - protein, 17 aa, Homo sapiens
EGQEEVLKEVVESEGER

SEQ ID NO: 8376 - protein, 17 aa, Homo sapiens
EGQEEVLKEVVESEGER

SEQ ID NO: 8377 - protein, 6 aa, Homo sapiens
KTKVER

SEQ ID NO: 8378 - protein, 6 aa, Homo sapiens
KTKVER

SEQ ID NO: 8379 - protein, 17 aa, Homo sapiens
EGQEEVLKEVVESEGER

SEQ ID NO: 8380 - protein, 17 aa, Homo sapiens
EGQEEVLKEVVESEGER

SEQ ID NO: 8381 - protein, 5 aa, Homo sapiens
TKVER

SEQ ID NO: 8382 - protein, 17 aa, Homo sapiens
EGQEEVLKEVVESEGER

SEQ ID NO: 8383 - protein, 17 aa, Homo sapiens
EGQEEVLKEVVESEGER

SEQ ID NO: 8384 - protein, 17 aa, Homo sapiens
EGQEEVLKEVVESEGER

SEQ ID NO: 8385 - protein, 6 aa, Homo sapiens
KTKVER

SEQ ID NO: 8386 - protein, 17 aa, Homo sapiens
EGQEEVLKEVVESEGER

SEQ ID NO: 8387 - protein, 17 aa, Homo sapiens
EGQEEVLKEVVESEGER

SEQ ID NO: 8388 - protein, 17 aa, Homo sapiens
EGQEEVLKEVVESEGER

SEQ ID NO: 8389 - protein, 17 aa, Homo sapiens
EGQEEVLKEVVESEGER

SEQ ID NO: 8390 - protein, 17 aa, Homo sapiens
EGQEEVLKEVVESEGER

SEQ ID NO: 8391 - protein, 6 aa, Homo sapiens
KTKVER

SEQ ID NO: 8392 - protein, 6 aa, Homo sapiens
KTKVER

SEQ ID NO: 8393 - protein, 6 aa, Homo sapiens
KTKVER

SEQ ID NO: 8394 - protein, 6 aa, Homo sapiens
KTKVER

SEQ ID NO: 8395 - protein, 11 aa, Homo sapiens
KVEEAAKVTGK

SEQ ID NO: 8396 - protein, 11 aa, Homo sapiens
KVEEAAKVTGK

SEQ ID NO: 8397 - protein, 6 aa, Homo sapiens
KTKVER

SEQ ID NO: 8398 - protein, 6 aa, Homo sapiens
KTKVER

SEQ ID NO: 8399 - protein, 11 aa, Homo sapiens
KVEEAAKVTGK

SEQ ID NO: 8400 - protein, 6 aa, Homo sapiens
KTKVER

SEQ ID NO: 8401 - protein, 6 aa, Homo sapiens
KTKVER

SEQ ID NO: 8402 - protein, 6 aa, Homo sapiens
KTKVER

SEQ ID NO: 8403 - protein, 11 aa, Homo sapiens
KVEEAAKVTGK

SEQ ID NO: 8404 - protein, 11 aa, Homo sapiens
KVEEAAKVTGK

SEQ ID NO: 8405 - protein, 11 aa, Homo sapiens
KVEEAAKVTGK

SEQ ID NO: 8406 - protein, 11 aa, Homo sapiens
KVEEAAKVTGK

SEQ ID NO: 8407 - protein, 11 aa, Homo sapiens
KVEEAAKVTGK

SEQ ID NO: 8408 - protein, 10 aa, Homo sapiens
VEEAAKVTGK

SEQ ID NO: 8409 - protein, 6 aa, Homo sapiens
KTKVER

SEQ ID NO: 8410 - protein, 13 aa, Homo sapiens
VEGQATDEKKEPK

SEQ ID NO: 8411 - protein, 6 aa, Homo sapiens
KTKVER

SEQ ID NO: 8412 - protein, 6 aa, Homo sapiens
KTKVER

SEQ ID NO: 8413 - protein, 6 aa, Homo sapiens
KTKVER

SEQ ID NO: 8414 - protein, 11 aa, Homo sapiens
KVEEAAKVTGK

SEQ ID NO: 8415 - protein, 6 aa, Homo sapiens
KTKVER

SEQ ID NO: 8416 - protein, 11 aa, Homo sapiens
KVEEAAKVTGK

SEQ ID NO: 8417 - protein, 11 aa, Homo sapiens
KVEEAAKVTGK

SEQ ID NO: 8418 - protein, 5 aa, Homo sapiens
TKVER

SEQ ID NO: 8419 - protein, 11 aa, Homo sapiens
KVEEAAKVTGK

SEQ ID NO: 8420 - protein, 11 aa, Homo sapiens
KVEEAAKVTGK

SEQ ID NO: 8421 - protein, 6 aa, Homo sapiens
KTKVER

SEQ ID NO: 8422 - protein, 6 aa, Homo sapiens
KTKVER

SEQ ID NO: 8423 - protein, 6 aa, Homo sapiens
KTKVER

SEQ ID NO: 8424 - protein, 6 aa, Homo sapiens
KTKVER

SEQ ID NO: 8425 - protein, 6 aa, Homo sapiens
KTKVER

SEQ ID NO: 8426 - protein, 10 aa, Homo sapiens
AKHLAAVEER

SEQ ID NO: 8427 - protein, 10 aa, Homo sapiens
AKHLAAVEER

SEQ ID NO: 8428 - protein, 10 aa, Homo sapiens
AKHLAAVEER

SEQ ID NO: 8429 - protein, 6 aa, Homo sapiens
KGGNYK

SEQ ID NO: 8430 - protein, 18 aa, Homo sapiens
ISAKTLTDEVNSPDSDRR

SEQ ID NO: 8431 - protein, 18 aa, Homo sapiens
ISAKTLTDEVNSPDSDRR

SEQ ID NO: 8432 - protein, 18 aa, Homo sapiens
ISAKTLTDEVNSPDSDRR

SEQ ID NO: 8433 - protein, 7 aa, Homo sapiens
GGNYKKR

SEQ ID NO: 8434 - protein, 7 aa, Homo sapiens
GGNYKKR

SEQ ID NO: 8435 - protein, 18 aa, Homo sapiens
ISAKTLTDEVNSPDSDRR

SEQ ID NO: 8436 - protein, 18 aa, Homo sapiens
ISAKTLTDEVNSPDSDRR

SEQ ID NO: 8437 - protein, 18 aa, Homo sapiens
ISAKTLTDEVNSPDSDRR

SEQ ID NO: 8438 - protein, 9 aa, Homo sapiens
KKDGGPNVK

SEQ ID NO: 8439 - protein, 18 aa, Homo sapiens
ISAKTLTDEVNSPDSDRR

SEQ ID NO: 8440 - protein, 18 aa, Homo sapiens
ISAKTLTDEVNSPDSDRR

SEQ ID NO: 8441 - protein, 18 aa, Homo sapiens
ISAKTLTDEVNSPDSDRR

SEQ ID NO: 8442 - protein, 18 aa, Homo sapiens
ISAKTLTDEVNSPDSDRR

SEQ ID NO: 8443 - protein, 18 aa, Homo sapiens
ISAKTLTDEVNSPDSDRR

SEQ ID NO: 8444 - protein, 5 aa, Homo sapiens
KVHAK

SEQ ID NO: 8445 - protein, 34 aa, Homo sapiens
HQGTVTEDKNNASHVVYPVPGNLEEEEWVRPVMK

SEQ ID NO: 8446 - protein, 34 aa, Homo sapiens; identical to SEQ ID NO: 8445

SEQ ID NO: 8447 - protein, 34 aa, Homo sapiens; identical to SEQ ID NO: 8445

SEQ ID NO: 8448 - protein, 34 aa, Homo sapiens; identical to SEQ ID NO: 8445

SEQ ID NO: 8449 - protein, 34 aa, Homo sapiens; identical to SEQ ID NO: 8445

SEQ ID NO: 8450 - protein, 15 aa, Homo sapiens
MKEEVPTALVEAHVR

SEQ ID NO: 8451 - protein, 23 aa, Homo sapiens
SALEEFSKMKEEVPTALVEAHVR

SEQ ID NO: 8452 - protein, 5 aa, Homo sapiens
TKVER

SEQ ID NO: 8453 - protein, 23 aa, Homo sapiens
SALEEFSKMKEEVPTALVEAHVR

SEQ ID NO: 8454 - protein, 10 aa, Homo sapiens
AKHLAAVEER

SEQ ID NO: 8455 - protein, 23 aa, Homo sapiens
SALEEFSKMKEEVPTALVEAHVR

SEQ ID NO: 8456 - protein, 23 aa, Homo sapiens
SALEEFSKMKEEVPTALVEAHVR

SEQ ID NO: 8457 - protein, 23 aa, Homo sapiens
SALEEFSKMKEEVPTALVEAHVR

SEQ ID NO: 8458 - protein, 23 aa, Homo sapiens
SALEEFSKMKEEVPTALVEAHVR

SEQ ID NO: 8459 - protein, 23 aa, Homo sapiens
SALEEFSKMKEEVPTALVEAHVR

SEQ ID NO: 8460 - protein, 26 aa, Homo sapiens
SLVQNNCLSRPNIFLCPEIEPKLLGK

SEQ ID NO: 8461 - protein, 26 aa, Homo sapiens
SLVQNNCLSRPNIFLCPEIEPKLLGK

SEQ ID NO: 8462 - protein, 26 aa, Homo sapiens
SLVQNNCLSRPNIFLCPEIEPKLLGK

SEQ ID NO: 8463 - protein, 7 aa, Homo sapiens
LKDIIKR

SEQ ID NO: 8464 - protein, 26 aa, Homo sapiens
SLVQNNCLSRPNIFLCPEIEPKLLGK

SEQ ID NO: 8465 - protein, 16 aa, Homo sapiens
PNIFLCPEIEPKLLGK

SEQ ID NO: 8466 - protein, 26 aa, Homo sapiens
SLVQNNCLSRPNIFLCPEIEPKLLGK

SEQ ID NO: 8467 - protein, 16 aa, Homo sapiens
PNIFLCPEIEPKLLGK

SEQ ID NO: 8468 - protein, 26 aa, Homo sapiens
SLVQNNCLSRPNIFLCPEIEPKLLGK

SEQ ID NO: 8469 - protein, 28 aa, Homo sapiens
SLSSLVVQLLQFQEEVFGKHVSNAPLTK

SEQ ID NO: 8470 - protein, 28 aa, Homo sapiens
SLSSLVVQLLQFQEEVFGKHVSNAPLTK

SEQ ID NO: 8471 - protein, 28 aa, Homo sapiens
SLSSLVVQLLQFQEEVFGKHVSNAPLTK

SEQ ID NO: 8472 - protein, 28 aa, Homo sapiens
SLSSLVVQLLQFQEEVFGKHVSNAPLTK

SEQ ID NO: 8473 - protein, 28 aa, Homo sapiens
SLSSLVVQLLQFQEEVFGKHVSNAPLTK

SEQ ID NO: 8474 - protein, 9 aa, Homo sapiens
KKDGGPNVK

SEQ ID NO: 8475 - protein, 28 aa, Homo sapiens
SLSSLVVQLLQFQEEVFGKHVSNAPLTK

SEQ ID NO: 8476 - protein, 12 aa, Homo sapiens
DEEKGKEGDSEK

SEQ ID NO: 8477 - protein, 7 aa, Homo sapiens
TSEAPKK

SEQ ID NO: 8478 - protein, 8 aa, Homo sapiens
FKSDQGWR

SEQ ID NO: 8479 - protein, 8 aa, Homo sapiens
FKSDQGWR

SEQ ID NO: 8480 - protein, 36 aa, Homo sapiens
VTGKADPAFGLESSGIAGTTSDEPERIEESGNDEAR

SEQ ID NO: 8481 - protein, 36 aa, Homo sapiens; identical to SEQ ID NO: 8480

SEQ ID NO: 8482 - protein, 36 aa, Homo sapiens; identical to SEQ ID NO: 8480

SEQ ID NO: 8483 - protein, 36 aa, Homo sapiens; identical to SEQ ID NO: 8480

SEQ ID NO: 8484 - protein, 36 aa, Homo sapiens; identical to SEQ ID NO: 8480

SEQ ID NO: 8485 - protein, 36 aa, Homo sapiens; identical to SEQ ID NO: 8480

SEQ ID NO: 8486 - protein, 36 aa, Homo sapiens; identical to SEQ ID NO: 8480

SEQ ID NO: 8487 - protein, 36 aa, Homo sapiens; identical to SEQ ID NO: 8480

SEQ ID NO: 8488 - protein, 36 aa, Homo sapiens; identical to SEQ ID NO: 8480

SEQ ID NO: 8489 - protein, 5 aa, Homo sapiens
TKVER

SEQ ID NO: 8490 - protein, 36 aa, Homo sapiens; identical to SEQ ID NO: 8480

SEQ ID NO: 8491 - protein, 26 aa, Homo sapiens
VTGKADPAFGLESSGIAGTTSDEPER

SEQ ID NO: 8492 - protein, 36 aa, Homo sapiens; identical to SEQ ID NO: 8480

SEQ ID NO: 8493 - protein, 36 aa, Homo sapiens; identical to SEQ ID NO: 8480

SEQ ID NO: 8494 - protein, 16 aa, Homo sapiens
AGGSLCHILAAAYKFK

SEQ ID NO: 8495 - protein, 16 aa, Homo sapiens
AGGSLCHILAAAYKFK

SEQ ID NO: 8496 - protein, 15 aa, Homo sapiens
MKEEVPTALVEAHVR

SEQ ID NO: 8497 - protein, 15 aa, Homo sapiens
MKEEVPTALVEAHVR

SEQ ID NO: 8498 - protein, 15 aa, Homo sapiens
MKEEVPTALVEAHVR

SEQ ID NO: 8499 - protein, 15 aa, Homo sapiens
MKEEVPTALVEAHVR

SEQ ID NO: 8500 - protein, 5 aa, Homo sapiens
TKVER

SEQ ID NO: 8501 - protein, 15 aa, Homo sapiens
MKEEVPTALVEAHVR

SEQ ID NO: 8502 - protein, 15 aa, Homo sapiens
MKEEVPTALVEAHVR

SEQ ID NO: 8503 - protein, 15 aa, Homo sapiens
MKEEVPTALVEAHVR

SEQ ID NO: 8504 - protein, 15 aa, Homo sapiens
MKEEVPTALVEAHVR

SEQ ID NO: 8505 - protein, 15 aa, Homo sapiens
MKEEVPTALVEAHVR

SEQ ID NO: 8506 - protein, 15 aa, Homo sapiens
MKEEVPTALVEAHVR

SEQ ID NO: 8507 - protein, 10 aa, Homo sapiens
AKHLAAVEER

SEQ ID NO: 8508 - protein, 15 aa, Homo sapiens
MKEEVPTALVEAHVR

SEQ ID NO: 8509 - protein, 10 aa, Homo sapiens
AKHLAAVEER

SEQ ID NO: 8510 - protein, 15 aa, Homo sapiens
MKEEVPTALVEAHVR

SEQ ID NO: 8511 - protein, 15 aa, Homo sapiens
MKEEVPTALVEAHVR

SEQ ID NO: 8512 - protein, 15 aa, Homo sapiens
MKEEVPTALVEAHVR

SEQ ID NO: 8513 - protein, 10 aa, Homo sapiens
AKHLAAVEER

SEQ ID NO: 8514 - protein, 15 aa, Homo sapiens
MKEEVPTALVEAHVR

SEQ ID NO: 8515 - protein, 10 aa, Homo sapiens
AKHLAAVEER

SEQ ID NO: 8516 - protein, 15 aa, Homo sapiens
MKEEVPTALVEAHVR

SEQ ID NO: 8517 - protein, 15 aa, Homo sapiens
MKEEVPTALVEAHVR

SEQ ID NO: 8518 - protein, 10 aa, Homo sapiens
AKHLAAVEER

SEQ ID NO: 8519 - protein, 10 aa, Homo sapiens
AKHLAAVEER

SEQ ID NO: 8520 - protein, 15 aa, Homo sapiens
MKEEVPTALVEAHVR

SEQ ID NO: 8521 - protein, 15 aa, Homo sapiens
MKEEVPTALVEAHVR

SEQ ID NO: 8522 - protein, 15 aa, Homo sapiens
MKEEVPTALVEAHVR

SEQ ID NO: 8523 - protein, 15 aa, Homo sapiens
MKEEVPTALVEAHVR

SEQ ID NO: 8524 - protein, 6 aa, Homo sapiens
KTKVER

SEQ ID NO: 8525 - protein, 15 aa, Homo sapiens
MKEEVPTALVEAHVR

SEQ ID NO: 8526 - protein, 15 aa, Homo sapiens
MKEEVPTALVEAHVR

SEQ ID NO: 8527 - protein, 15 aa, Homo sapiens
MKEEVPTALVEAHVR

SEQ ID NO: 8528 - protein, 15 aa, Homo sapiens
MKEEVPTALVEAHVR

SEQ ID NO: 8529 - protein, 15 aa, Homo sapiens
MKEEVPTALVEAHVR

SEQ ID NO: 8530 - protein, 15 aa, Homo sapiens
MKEEVPTALVEAHVR

SEQ ID NO: 8531 - protein, 15 aa, Homo sapiens
MKEEVPTALVEAHVR

SEQ ID NO: 8532 - protein, 15 aa, Homo sapiens
MKEEVPTALVEAHVR

SEQ ID NO: 8533 - protein, 15 aa, Homo sapiens
MKEEVPTALVEAHVR

SEQ ID NO: 8534 - protein, 11 aa, Homo sapiens
KVEEAAKVTGK

SEQ ID NO: 8535 - protein, 11 aa, Homo sapiens
KVEEAAKVTGK

SEQ ID NO: 8536 - protein, 15 aa, Homo sapiens
MKEEVPTALVEAHVR

SEQ ID NO: 8537 - protein, 15 aa, Homo sapiens
MKEEVPTALVEAHVR

SEQ ID NO: 8538 - protein, 15 aa, Homo sapiens
MKEEVPTALVEAHVR

SEQ ID NO: 8539 - protein, 15 aa, Homo sapiens
MKEEVPTALVEAHVR

SEQ ID NO: 8540 - protein, 7 aa, Homo sapiens
KVEEAAK

SEQ ID NO: 8541 - protein, 15 aa, Homo sapiens
MKEEVPTALVEAHVR

SEQ ID NO: 8542 - protein, 15 aa, Homo sapiens
MKEEVPTALVEAHVR

SEQ ID NO: 8543 - protein, 7 aa, Homo sapiens
KVEEAAK

SEQ ID NO: 8544 - protein, 7 aa, Homo sapiens
KVEEAAK

SEQ ID NO: 8545 - protein, 15 aa, Homo sapiens
MKEEVPTALVEAHVR

SEQ ID NO: 8546 - protein, 15 aa, Homo sapiens
MKEEVPTALVEAHVR

SEQ ID NO: 8547 - protein, 15 aa, Homo sapiens
MKEEVPTALVEAHVR

SEQ ID NO: 8548 - protein, 7 aa, Homo sapiens
KVEEAAK

SEQ ID NO: 8549 - protein, 15 aa, Homo sapiens
MKEEVPTALVEAHVR

SEQ ID NO: 8550 - protein, 38 aa, Homo sapiens
DKQVLLHWGYYPDSYDTWIPASEIEASVEDAPTPEKPR

SEQ ID NO: 8551 - protein, 38 aa, Homo sapiens; identical to SEQ ID NO: 8550

SEQ ID NO: 8552 - protein, 38 aa, Homo sapiens; identical to SEQ ID NO: 8550

SEQ ID NO: 8553 - protein, 38 aa, Homo sapiens; identical to SEQ ID NO: 8550

SEQ ID NO: 8554 - protein, 38 aa, Homo sapiens; identical to SEQ ID NO: 8550

SEQ ID NO: 8555 - protein, 38 aa, Homo sapiens; identical to SEQ ID NO: 8550

SEQ ID NO: 8556 - protein, 38 aa, Homo sapiens; identical to SEQ ID NO: 8550

SEQ ID NO: 8557 - protein, 10 aa, Homo sapiens
AKHLAAVEER

SEQ ID NO: 8558 - protein, 7 aa, Homo sapiens
KVEEAAK

SEQ ID NO: 8559 - protein, 7 aa, Homo sapiens
KVEEAAK

SEQ ID NO: 8560 - protein, 7 aa, Homo sapiens
KVEEAAK

SEQ ID NO: 8561 - protein, 7 aa, Homo sapiens
KVEEAAK

SEQ ID NO: 8562 - protein, 7 aa, Homo sapiens
KVEEAAK

SEQ ID NO: 8563 - protein, 36 aa, Homo sapiens; identical to SEQ ID NO: 8480

SEQ ID NO: 8564 - protein, 36 aa, Homo sapiens; identical to SEQ ID NO: 8480

SEQ ID NO: 8565 - protein, 36 aa, Homo sapiens; identical to SEQ ID NO: 8480

SEQ ID NO: 8566 - protein, 36 aa, Homo sapiens; identical to SEQ ID NO: 8480

SEQ ID NO: 8567 - protein, 7 aa, Homo sapiens
KVEEAAK

SEQ ID NO: 8568 - protein, 36 aa, Homo sapiens; identical to SEQ ID NO: 8480

SEQ ID NO: 8569 - protein, 7 aa, Homo sapiens
KVEEAAK

SEQ ID NO: 8570 - protein, 7 aa, Homo sapiens
KVEEAAK

SEQ ID NO: 8571 - protein, 7 aa, Homo sapiens
KVEEAAK

SEQ ID NO: 8572 - protein, 7 aa, Homo sapiens
KVEEAAK

SEQ ID NO: 8573 - protein, 7 aa, Homo sapiens
KVEEAAK

SEQ ID NO: 8574 - protein, 16 aa, Homo sapiens
LLEDSALSKYDATKQK

SEQ ID NO: 8575 - protein, 16 aa, Homo sapiens
LLEDSALSKYDATKQK

SEQ ID NO: 8576 - protein, 16 aa, Homo sapiens
LLEDSALSKYDATKQK

SEQ ID NO: 8577 - protein, 16 aa, Homo sapiens
LLEDSALSKYDATKQK

SEQ ID NO: 8578 - protein, 7 aa, Homo sapiens
KFSSFFK

SEQ ID NO: 8579 - protein, 17 aa, Homo sapiens
EFVICDKYLQQIFESQR

SEQ ID NO: 8580 - protein, 17 aa, Homo sapiens
EFVICDKYLQQIFESQR

SEQ ID NO: 8581 - protein, 17 aa, Homo sapiens
EFVICDKYLQQIFESQR

SEQ ID NO: 8582 - protein, 17 aa, Homo sapiens
EFVICDKYLQQIFESQR

SEQ ID NO: 8583 - protein, 17 aa, Homo sapiens
EFVICDKYLQQIFESQR

SEQ ID NO: 8584 - protein, 10 aa, Homo sapiens
THKLQDPHER

SEQ ID NO: 8585 - protein, 17 aa, Homo sapiens
EFVICDKYLQQIFESQR

SEQ ID NO: 8586 - protein, 17 aa, Homo sapiens
EFVICDKYLQQIFESQR

SEQ ID NO: 8587 - protein, 17 aa, Homo sapiens
EFVICDKYLQQIFESQR

SEQ ID NO: 8588 - protein, 8 aa, Homo sapiens
KLDQTIMR

SEQ ID NO: 8589 - protein, 7 aa, Homo sapiens
NHNAKKK

SEQ ID NO: 8590 - protein, 7 aa, Homo sapiens
NHNAKKK

SEQ ID NO: 8591 - protein, 7 aa, Homo sapiens
NHNAKKK

SEQ ID NO: 8592 - protein, 9 aa, Homo sapiens
MADKILPQR

SEQ ID NO: 8593 - protein, 9 aa, Homo sapiens
MADKILPQR

SEQ ID NO: 8594 - protein, 10 aa, Homo sapiens
KMADKILPQR

SEQ ID NO: 8595 - protein, 27 aa, Homo sapiens
IFISNTFNPAKSDAEDGEGTVASWELR

SEQ ID NO: 8596 - protein, 27 aa, Homo sapiens
IFISNTFNPAKSDAEDGEGTVASWELR

SEQ ID NO: 8597 - protein, 27 aa, Homo sapiens
IFISNTFNPAKSDAEDGEGTVASWELR

SEQ ID NO: 8598 - protein, 27 aa, Homo sapiens
IFISNTFNPAKSDAEDGEGTVASWELR

SEQ ID NO: 8599 - protein, 27 aa, Homo sapiens
IFISNTFNPAKSDAEDGEGTVASWELR

SEQ ID NO: 8600 - protein, 27 aa, Homo sapiens
IFISNTFNPAKSDAEDGEGTVASWELR

SEQ ID NO: 8601 - protein, 27 aa, Homo sapiens
IFISNTFNPAKSDAEDGEGTVASWELR

SEQ ID NO: 8602 - protein, 27 aa, Homo sapiens
IFISNTFNPAKSDAEDGEGTVASWELR

SEQ ID NO: 8603 - protein, 27 aa, Homo sapiens
IFISNTFNPAKSDAEDGEGTVASWELR

SEQ ID NO: 8604 - protein, 27 aa, Homo sapiens
IFISNTFNPAKSDAEDGEGTVASWELR

SEQ ID NO: 8605 - protein, 27 aa, Homo sapiens
IFISNTFNPAKSDAEDGEGTVASWELR

SEQ ID NO: 8606 - protein, 14 aa, Homo sapiens
TATTQETDGFQVKR

SEQ ID NO: 8607 - protein, 27 aa, Homo sapiens
IFISNTFNPAKSDAEDGEGTVASWELR

SEQ ID NO: 8608 - protein, 27 aa, Homo sapiens
IFISNTFNPAKSDAEDGEGTVASWELR

SEQ ID NO: 8609 - protein, 31 aa, Homo sapiens
IFISNTFNPAKSDAEDGEGTVASWELRVEGR

SEQ ID NO: 8610 - protein, 21 aa, Homo sapiens
TATTQETDGFQVKRPGDVNVR

SEQ ID NO: 8611 - protein, 21 aa, Homo sapiens
TATTQETDGFQVKRPGDVNVR

SEQ ID NO: 8612 - protein, 31 aa, Homo sapiens; identical to SEQ ID NO: 8609

SEQ ID NO: 8613 - protein, 27 aa, Homo sapiens
IFISNTFNPAKSDAEDGEGTVASWELR

SEQ ID NO: 8614 - protein, 31 aa, Homo sapiens; identical to SEQ ID NO: 8609

SEQ ID NO: 8615 - protein, 27 aa, Homo sapiens
IFISNTFNPAKSDAEDGEGTVASWELR

SEQ ID NO: 8616 - protein, 31 aa, Homo sapiens; identical to SEQ ID NO: 8609

SEQ ID NO: 8617 - protein, 31 aa, Homo sapiens; identical to SEQ ID NO: 8609

SEQ ID NO: 8618 - protein, 21 aa, Homo sapiens
TATTQETDGFQVKRPGDVNVR

SEQ ID NO: 8619 - protein, 31 aa, Homo sapiens; identical to SEQ ID NO: 8609

SEQ ID NO: 8620 - protein, 27 aa, Homo sapiens
IFISNTFNPAKSDAEDGEGTVASWELR

SEQ ID NO: 8621 - protein, 21 aa, Homo sapiens
TATTQETDGFQVKRPGDVNVR

SEQ ID NO: 8622 - protein, 27 aa, Homo sapiens
IFISNTFNPAKSDAEDGEGTVASWELR

SEQ ID NO: 8623 - protein, 21 aa, Homo sapiens
TATTQETDGFQVKRPGDVNVR

SEQ ID NO: 8624 - protein, 31 aa, Homo sapiens; identical to SEQ ID NO: 8609

SEQ ID NO: 8625 - protein, 31 aa, Homo sapiens; identical to SEQ ID NO: 8609

SEQ ID NO: 8626 - protein, 27 aa, Homo sapiens
IFISNTFNPAKSDAEDGEGTVASWELR

SEQ ID NO: 8627 - protein, 21 aa, Homo sapiens
TATTQETDGFQVKRPGDVNVR

SEQ ID NO: 8628 - protein, 31 aa, Homo sapiens; identical to SEQ ID NO: 8609

SEQ ID NO: 8629 - protein, 21 aa, Homo sapiens
TATTQETDGFQVKRPGDVNVR

SEQ ID NO: 8630 - protein, 27 aa, Homo sapiens
IFISNTFNPAKSDAEDGEGTVASWELR

SEQ ID NO: 8631 - protein, 31 aa, Homo sapiens; identical to SEQ ID NO: 8609

SEQ ID NO: 8632 - protein, 31 aa, Homo sapiens; identical to SEQ ID NO: 8609

SEQ ID NO: 8633 - protein, 27 aa, Homo sapiens
IFISNTFNPAKSDAEDGEGTVASWELR

SEQ ID NO: 8634 - protein, 26 aa, Homo sapiens
LHALLMPPEPIIINHVISVDPNDQKK

SEQ ID NO: 8635 - protein, 26 aa, Homo sapiens
LHALLMPPEPIIINHVISVDPNDQKK

SEQ ID NO: 8636 - protein, 26 aa, Homo sapiens
LHALLMPPEPIIINHVISVDPNDQKK

SEQ ID NO: 8637 - protein, 26 aa, Homo sapiens
LHALLMPPEPIIINHVISVDPNDQKK

SEQ ID NO: 8638 - protein, 7 aa, Homo sapiens
NHNAKKK

SEQ ID NO: 8639 - protein, 7 aa, Homo sapiens
NHNAKKK

SEQ ID NO: 8640 - protein, 7 aa, Homo sapiens
NHNAKKK

SEQ ID NO: 8641 - protein, 7 aa, Homo sapiens
NHNAKKK

SEQ ID NO: 8642 - protein, 7 aa, Homo sapiens
NHNAKKK

SEQ ID NO: 8643 - protein, 5 aa, Homo sapiens
KMADK

SEQ ID NO: 8644 - protein, 19 aa, Homo sapiens
KRPAPQQIQQVQQQAVQNR

SEQ ID NO: 8645 - protein, 19 aa, Homo sapiens
KRPAPQQIQQVQQQAVQNR

SEQ ID NO: 8646 - protein, 19 aa, Homo sapiens
KRPAPQQIQQVQQQAVQNR

SEQ ID NO: 8647 - protein, 19 aa, Homo sapiens
KRPAPQQIQQVQQQAVQNR

SEQ ID NO: 8648 - protein, 19 aa, Homo sapiens
KRPAPQQIQQVQQQAVQNR

SEQ ID NO: 8649 - protein, 19 aa, Homo sapiens
KRPAPQQIQQVQQQAVQNR

SEQ ID NO: 8650 - protein, 19 aa, Homo sapiens
KRPAPQQIQQVQQQAVQNR

SEQ ID NO: 8651 - protein, 19 aa, Homo sapiens
KRPAPQQIQQVQQQAVQNR

SEQ ID NO: 8652 - protein, 21 aa, Homo sapiens
TATTQETDGFQVKRPGDVNVR

SEQ ID NO: 8653 - protein, 21 aa, Homo sapiens
TATTQETDGFQVKRPGDVNVR

SEQ ID NO: 8654 - protein, 9 aa, Homo sapiens
MKFSEIPQR

SEQ ID NO: 8655 - protein, 9 aa, Homo sapiens
MKFSEIPQR

SEQ ID NO: 8656 - protein, 9 aa, Homo sapiens
MADKILPQR

SEQ ID NO: 8657 - protein, 9 aa, Homo sapiens
MADKILPQR

SEQ ID NO: 8658 - protein, 15 aa, Homo sapiens
VASAAAKAALEEFSR

SEQ ID NO: 8659 - protein, 15 aa, Homo sapiens
VASAAAKAALEEFSR

SEQ ID NO: 8660 - protein, 16 aa, Homo sapiens
VREEVPLELVEAHVKK

SEQ ID NO: 8661 - protein, 16 aa, Homo sapiens
VREEVPLELVEAHVKK

SEQ ID NO: 8662 - protein, 16 aa, Homo sapiens
VREEVPLELVEAHVKK

SEQ ID NO: 8663 - protein, 5 aa, Homo sapiens
KKSGK

SEQ ID NO: 8664 - protein, 10 aa, Homo sapiens
KGQASLYGKR

SEQ ID NO: 8665 - protein, 26 aa, Homo sapiens
KKVEHEISEGNVATAAAAALASAATK

SEQ ID NO: 8666 - protein, 16 aa, Homo sapiens
VREEVPLELVEAHVKK

SEQ ID NO: 8667 - protein, 7 aa, Homo sapiens
KVQEAAR

SEQ ID NO: 8668 - protein, 7 aa, Homo sapiens
KVQEAAR

SEQ ID NO: 8669 - protein, 8 aa, Homo sapiens
SKGASAGR

SEQ ID NO: 8670 - protein, 7 aa, Homo sapiens
TDIYSKK

SEQ ID NO: 8671 - protein, 7 aa, Homo sapiens
TDIYSKK

SEQ ID NO: 8672 - protein, 7 aa, Homo sapiens
TDIYSKK

SEQ ID NO: 8673 - protein, 7 aa, Homo sapiens
TDIYSKK

SEQ ID NO: 8674 - protein, 7 aa, Homo sapiens
TDIYSKK

SEQ ID NO: 8675 - protein, 7 aa, Homo sapiens
TDIYSKK

SEQ ID NO: 8676 - protein, 7 aa, Homo sapiens
TDIYSKK

SEQ ID NO: 8677 - protein, 7 aa, Homo sapiens
TDIYSKK

SEQ ID NO: 8678 - protein, 16 aa, Homo sapiens
VREEVPLELVEAHVKK

SEQ ID NO: 8679 - protein, 16 aa, Homo sapiens
VREEVPLELVEAHVKK

SEQ ID NO: 8680 - protein, 23 aa, Homo sapiens
DMEDPTPVPNIEEVVLPKNVNLK

SEQ ID NO: 8681 - protein, 7 aa, Homo sapiens
LKDIIKR

SEQ ID NO: 8682 - protein, 32 aa, Homo sapiens
NVEMFMNIEKTLVQNNCLTRPNIYLIPDIDLK

SEQ ID NO: 8683 - protein, 32 aa, Homo sapiens; identical to SEQ ID NO: 8682

SEQ ID NO: 8684 - protein, 16 aa, Homo sapiens
AGGALCHILGAAYKYK

SEQ ID NO: 8685 - protein, 16 aa, Homo sapiens
AGGALCHILGAAYKYK

SEQ ID NO: 8686 - protein, 15 aa, Homo sapiens
KHSPSPPPPTPTESR

SEQ ID NO: 8687 - protein, 15 aa, Homo sapiens
KHSPSPPPPTPTESR

SEQ ID NO: 8688 - protein, 15 aa, Homo sapiens
KHSPSPPPPTPTESR

SEQ ID NO: 8689 - protein, 29 aa, Homo sapiens
WILDTDIFNEWMNEEDYEVDENRKPVSFR

SEQ ID NO: 8690 - protein, 29 aa, Homo sapiens
WILDTDIFNEWMNEEDYEVDENRKPVSFR

SEQ ID NO: 8691 - protein, 29 aa, Homo sapiens
WILDTDIFNEWMNEEDYEVDENRKPVSFR

SEQ ID NO: 8692 - protein, 9 aa, Homo sapiens
DRKASANAR

SEQ ID NO: 8693 - protein, 6 aa, Homo sapiens
KPVSFR

SEQ ID NO: 8694 - protein, 11 aa, Homo sapiens
HQGTFTDEKSK

SEQ ID NO: 8695 - protein, 11 aa, Homo sapiens
HQGTFTDEKSK

SEQ ID NO: 8696 - protein, 11 aa, Homo sapiens
HQGTFTDEKSK

SEQ ID NO: 8697 - protein, 6 aa, Homo sapiens
KPVSFR

SEQ ID NO: 8698 - protein, 11 aa, Homo sapiens
HQGTFTDEKSK

SEQ ID NO: 8699 - protein, 37 aa, Homo sapiens
QVLVHWGFYPDSYDTWVHSNDVDAEIEDPPIPEKPWK

SEQ ID NO: 8700 - protein, 11 aa, Homo sapiens
HQGTFTDEKSK

SEQ ID NO: 8701 - protein, 39 aa, Homo sapiens
EKQVLVHWGFYPDSYDTWVHSNDVDAEIEDPPIPEKPWK

SEQ ID NO: 8702 - protein, 11 aa, Homo sapiens
HQGTFTDEKSK

SEQ ID NO: 8703 - protein, 11 aa, Homo sapiens
HQGTFTDEKSK

SEQ ID NO: 8704 - protein, 11 aa, Homo sapiens
HQGTFTDEKSK

SEQ ID NO: 8705 - protein, 11 aa, Homo sapiens
HQGTFTDEKSK

SEQ ID NO: 8706 - protein, 11 aa, Homo sapiens
HQGTFTDEKSK

SEQ ID NO: 8707 - protein, 12 aa, Homo sapiens
RHQGTFTDEKSK

SEQ ID NO: 8708 - protein, 11 aa, Homo sapiens
HQGTFTDEKSK

SEQ ID NO: 8709 - protein, 11 aa, Homo sapiens
HQGTFTDEKSK

SEQ ID NO: 8710 - protein, 11 aa, Homo sapiens
HQGTFTDEKSK

SEQ ID NO: 8711 - protein, 11 aa, Homo sapiens
HQGTFTDEKSK

SEQ ID NO: 8712 - protein, 11 aa, Homo sapiens
HQGTFTDEKSK

SEQ ID NO: 8713 - protein, 11 aa, Homo sapiens
HQGTFTDEKSK

SEQ ID NO: 8714 - protein, 11 aa, Homo sapiens
HQGTFTDEKSK

SEQ ID NO: 8715 - protein, 14 aa, Homo sapiens
ISTKNEEPVRSPER

SEQ ID NO: 8716 - protein, 14 aa, Homo sapiens
ISTKNEEPVRSPER

SEQ ID NO: 8717 - protein, 11 aa, Homo sapiens
HQGTFTDEKSK

SEQ ID NO: 8718 - protein, 9 aa, Homo sapiens
KGQASLYGK

SEQ ID NO: 8719 - protein, 9 aa, Homo sapiens
KGQASLYGK

SEQ ID NO: 8720 - protein, 9 aa, Homo sapiens
KGQASLYGK

SEQ ID NO: 8721 - protein, 9 aa, Homo sapiens
KGQASLYGK

SEQ ID NO: 8722 - protein, 10 aa, Homo sapiens
AKHLAAVEER

SEQ ID NO: 8723 - protein, 25 aa, Homo sapiens
KVEHEISEGNVATAAAAALASAATK

SEQ ID NO: 8724 - protein, 25 aa, Homo sapiens
KVEHEISEGNVATAAAAALASAATK

SEQ ID NO: 8725 - protein, 16 aa, Homo sapiens
VREEVPLELVEAHVKK

SEQ ID NO: 8726 - protein, 16 aa, Homo sapiens
VREEVPLELVEAHVKK

SEQ ID NO: 8727 - protein, 14 aa, Homo sapiens
ISTKNEEPVRSPER

SEQ ID NO: 8728 - protein, 14 aa, Homo sapiens
ISTKNEEPVRSPER

SEQ ID NO: 8729 - protein, 14 aa, Homo sapiens
ISTKNEEPVRSPER

SEQ ID NO: 8730 - protein, 14 aa, Homo sapiens
ISTKNEEPVRSPER

SEQ ID NO: 8731 - protein, 10 aa, Homo sapiens
ISTKNEEPVR

SEQ ID NO: 8732 - protein, 10 aa, Homo sapiens
ISTKNEEPVR

SEQ ID NO: 8733 - protein, 14 aa, Homo sapiens
ISTKNEEPVRSPER

SEQ ID NO: 8734 - protein, 7 aa, Homo sapiens
KASANAR

SEQ ID NO: 8735 - protein, 14 aa, Homo sapiens
ISTKNEEPVRSPER

SEQ ID NO: 8736 - protein, 14 aa, Homo sapiens
ISTKNEEPVRSPER

SEQ ID NO: 8737 - protein, 9 aa, Homo sapiens
DRKASANAR

SEQ ID NO: 8738 - protein, 7 aa, Homo sapiens
KASANAR

SEQ ID NO: 8739 - protein, 10 aa, Homo sapiens
ISTKNEEPVR

SEQ ID NO: 8740 - protein, 9 aa, Homo sapiens
DRKASANAR

SEQ ID NO: 8741 - protein, 14 aa, Homo sapiens
ISTKNEEPVRSPER

SEQ ID NO: 8742 - protein, 14 aa, Homo sapiens
ISTKNEEPVRSPER

SEQ ID NO: 8743 - protein, 14 aa, Homo sapiens
ISTKNEEPVRSPER

SEQ ID NO: 8744 - protein, 14 aa, Homo sapiens
ISTKNEEPVRSPER

SEQ ID NO: 8745 - protein, 14 aa, Homo sapiens
ISTKNEEPVRSPER

SEQ ID NO: 8746 - protein, 10 aa, Homo sapiens
ISTKNEEPVR

SEQ ID NO: 8747 - protein, 14 aa, Homo sapiens
ISTKNEEPVRSPER

SEQ ID NO: 8748 - protein, 7 aa, Homo sapiens
KASANAR

SEQ ID NO: 8749 - protein, 14 aa, Homo sapiens
ISTKNEEPVRSPER

SEQ ID NO: 8750 - protein, 10 aa, Homo sapiens
ISTKNEEPVR

SEQ ID NO: 8751 - protein, 14 aa, Homo sapiens
ISTKNEEPVRSPER

SEQ ID NO: 8752 - protein, 12 aa, Homo sapiens
EKPVDLQNFGLR

SEQ ID NO: 8753 - protein, 12 aa, Homo sapiens
EKPVDLQNFGLR

SEQ ID NO: 8754 - protein, 18 aa, Homo sapiens
SPQVPAAQQMLNFPEKNK

SEQ ID NO: 8755 - protein, 12 aa, Homo sapiens
EKPVDLQNFGLR

SEQ ID NO: 8756 - protein, 12 aa, Homo sapiens
EKPVDLQNFGLR

SEQ ID NO: 8757 - protein, 12 aa, Homo sapiens
EKPVDLQNFGLR

SEQ ID NO: 8758 - protein, 12 aa, Homo sapiens
EKPVDLQNFGLR

SEQ ID NO: 8759 - protein, 12 aa, Homo sapiens
EKPVDLQNFGLR

SEQ ID NO: 8760 - protein, 12 aa, Homo sapiens
EKPVDLQNFGLR

SEQ ID NO: 8761 - protein, 12 aa, Homo sapiens
EKPVDLQNFGLR

SEQ ID NO: 8762 - protein, 18 aa, Homo sapiens
SPQVPAAQQMLNFPEKNK

SEQ ID NO: 8763 - protein, 18 aa, Homo sapiens
SPQVPAAQQMLNFPEKNK

SEQ ID NO: 8764 - protein, 18 aa, Homo sapiens
SPQVPAAQQMLNFPEKNK

SEQ ID NO: 8765 - protein, 18 aa, Homo sapiens
SPQVPAAQQMLNFPEKNK

SEQ ID NO: 8766 - protein, 18 aa, Homo sapiens
SPQVPAAQQMLNFPEKNK

SEQ ID NO: 8767 - protein, 18 aa, Homo sapiens
SPQVPAAQQMLNFPEKNK

SEQ ID NO: 8768 - protein, 12 aa, Homo sapiens
EKPVDLQNFGLR

SEQ ID NO: 8769 - protein, 18 aa, Homo sapiens
SPQVPAAQQMLNFPEKNK

SEQ ID NO: 8770 - protein, 12 aa, Homo sapiens
EKPVDLQNFGLR

SEQ ID NO: 8771 - protein, 12 aa, Homo sapiens
EKPVDLQNFGLR

SEQ ID NO: 8772 - protein, 16 aa, Homo sapiens
VREEVPLELVEAHVKK

SEQ ID NO: 8773 - protein, 8 aa, Homo sapiens
VWLGKHYK

SEQ ID NO: 8774 - protein, 8 aa, Homo sapiens
SKGASAGR

SEQ ID NO: 8775 - protein, 8 aa, Homo sapiens
SKGASAGR

SEQ ID NO: 8776 - protein, 8 aa, Homo sapiens
SKGASAGR

SEQ ID NO: 8777 - protein, 8 aa, Homo sapiens
SKGASAGR

SEQ ID NO: 8778 - protein, 25 aa, Homo sapiens
KVEHEISEGNVATAAAAALASAATK

SEQ ID NO: 8779 - protein, 25 aa, Homo sapiens
KVEHEISEGNVATAAAAALASAATK

SEQ ID NO: 8780 - protein, 25 aa, Homo sapiens
KVEHEISEGNVATAAAAALASAATK

SEQ ID NO: 8781 - protein, 25 aa, Homo sapiens
KVEHEISEGNVATAAAAALASAATK

SEQ ID NO: 8782 - protein, 25 aa, Homo sapiens
KVEHEISEGNVATAAAAALASAATK

SEQ ID NO: 8783 - protein, 25 aa, Homo sapiens
KVEHEISEGNVATAAAAALASAATK

SEQ ID NO: 8784 - protein, 25 aa, Homo sapiens
KVEHEISEGNVATAAAAALASAATK

SEQ ID NO: 8785 - protein, 16 aa, Homo sapiens
VREEVPLELVEAHVKK

SEQ ID NO: 8786 - protein, 16 aa, Homo sapiens
VREEVPLELVEAHVKK

SEQ ID NO: 8787 - protein, 16 aa, Homo sapiens
VREEVPLELVEAHVKK

SEQ ID NO: 8788 - protein, 17 aa, Homo sapiens
VASAAAKAALEEFSRVR

SEQ ID NO: 8789 - protein, 17 aa, Homo sapiens
VASAAAKAALEEFSRVR

SEQ ID NO: 8790 - protein, 17 aa, Homo sapiens
VASAAAKAALEEFSRVR

SEQ ID NO: 8791 - protein, 17 aa, Homo sapiens
VASAAAKAALEEFSRVR

SEQ ID NO: 8792 - protein, 17 aa, Homo sapiens
VASAAAKAALEEFSRVR

SEQ ID NO: 8793 - protein, 17 aa, Homo sapiens
VASAAAKAALEEFSRVR

SEQ ID NO: 8794 - protein, 17 aa, Homo sapiens
VASAAAKAALEEFSRVR

SEQ ID NO: 8795 - protein, 17 aa, Homo sapiens
VASAAAKAALEEFSRVR

SEQ ID NO: 8796 - protein, 17 aa, Homo sapiens
VASAAAKAALEEFSRVR

SEQ ID NO: 8797 - protein, 17 aa, Homo sapiens
VASAAAKAALEEFSRVR

SEQ ID NO: 8798 - protein, 17 aa, Homo sapiens
VASAAAKAALEEFSRVR

SEQ ID NO: 8799 - protein, 16 aa, Homo sapiens
VREEVPLELVEAHVKK

SEQ ID NO: 8800 - protein, 7 aa, Homo sapiens
ESDTGKK

SEQ ID NO: 8801 - protein, 15 aa, Homo sapiens
VASAAAKAALEEFSR

SEQ ID NO: 8802 - protein, 15 aa, Homo sapiens
VASAAAKAALEEFSR

SEQ ID NO: 8803 - protein, 15 aa, Homo sapiens
VASAAAKAALEEFSR

SEQ ID NO: 8804 - protein, 15 aa, Homo sapiens
VASAAAKAALEEFSR

SEQ ID NO: 8805 - protein, 15 aa, Homo sapiens
VASAAAKAALEEFSR

SEQ ID NO: 8806 - protein, 15 aa, Homo sapiens
VASAAAKAALEEFSR

SEQ ID NO: 8807 - protein, 15 aa, Homo sapiens
VASAAAKAALEEFSR

SEQ ID NO: 8808 - protein, 15 aa, Homo sapiens
VASAAAKAALEEFSR

SEQ ID NO: 8809 - protein, 15 aa, Homo sapiens
VASAAAKAALEEFSR

SEQ ID NO: 8810 - protein, 15 aa, Homo sapiens
VASAAAKAALEEFSR

SEQ ID NO: 8811 - protein, 15 aa, Homo sapiens
VASAAAKAALEEFSR

SEQ ID NO: 8812 - protein, 15 aa, Homo sapiens
VASAAAKAALEEFSR

SEQ ID NO: 8813 - protein, 25 aa, Homo sapiens
KVEHEISEGNVATAAAAALASAATK

SEQ ID NO: 8814 - protein, 25 aa, Homo sapiens
KVEHEISEGNVATAAAAALASAATK

SEQ ID NO: 8815 - protein, 25 aa, Homo sapiens
KVEHEISEGNVATAAAAALASAATK

SEQ ID NO: 8816 - protein, 25 aa, Homo sapiens
KVEHEISEGNVATAAAAALASAATK

SEQ ID NO: 8817 - protein, 25 aa, Homo sapiens
KVEHEISEGNVATAAAAALASAATK

SEQ ID NO: 8818 - protein, 25 aa, Homo sapiens
KVEHEISEGNVATAAAAALASAATK

SEQ ID NO: 8819 - protein, 25 aa, Homo sapiens
KVEHEISEGNVATAAAAALASAATK

SEQ ID NO: 8820 - protein, 25 aa, Homo sapiens
KVEHEISEGNVATAAAAALASAATK

SEQ ID NO: 8821 - protein, 25 aa, Homo sapiens
KVEHEISEGNVATAAAAALASAATK

SEQ ID NO: 8822 - protein, 25 aa, Homo sapiens
KVEHEISEGNVATAAAAALASAATK

SEQ ID NO: 8823 - protein, 15 aa, Homo sapiens
VASAAAKAALEEFSR

SEQ ID NO: 8824 - protein, 25 aa, Homo sapiens
KVEHEISEGNVATAAAAALASAATK

SEQ ID NO: 8825 - protein, 25 aa, Homo sapiens
KVEHEISEGNVATAAAAALASAATK

SEQ ID NO: 8826 - protein, 25 aa, Homo sapiens
KVEHEISEGNVATAAAAALASAATK

SEQ ID NO: 8827 - protein, 25 aa, Homo sapiens
KVEHEISEGNVATAAAAALASAATK

SEQ ID NO: 8828 - protein, 25 aa, Homo sapiens
KVEHEISEGNVATAAAAALASAATK

SEQ ID NO: 8829 - protein, 25 aa, Homo sapiens
KVEHEISEGNVATAAAAALASAATK

SEQ ID NO: 8830 - protein, 25 aa, Homo sapiens
KVEHEISEGNVATAAAAALASAATK

SEQ ID NO: 8831 - protein, 15 aa, Homo sapiens
VASAAAKAALEEFSR

SEQ ID NO: 8832 - protein, 25 aa, Homo sapiens
KVEHEISEGNVATAAAAALASAATK

SEQ ID NO: 8833 - protein, 15 aa, Homo sapiens
VASAAAKAALEEFSR

SEQ ID NO: 8834 - protein, 10 aa, Homo sapiens
AKHLAAVEER

SEQ ID NO: 8835 - protein, 10 aa, Homo sapiens
AKHLAAVEER

SEQ ID NO: 8836 - protein, 15 aa, Homo sapiens
VASAAAKAALEEFSR

SEQ ID NO: 8837 - protein, 15 aa, Homo sapiens
VASAAAKAALEEFSR

SEQ ID NO: 8838 - protein, 15 aa, Homo sapiens
VASAAAKAALEEFSR

SEQ ID NO: 8839 - protein, 15 aa, Homo sapiens
VASAAAKAALEEFSR

SEQ ID NO: 8840 - protein, 15 aa, Homo sapiens
VASAAAKAALEEFSR

SEQ ID NO: 8841 - protein, 15 aa, Homo sapiens
VASAAAKAALEEFSR

SEQ ID NO: 8842 - protein, 15 aa, Homo sapiens
VASAAAKAALEEFSR

SEQ ID NO: 8843 - protein, 26 aa, Homo sapiens
KKVEHEISEGNVATAAAAALASAATK

SEQ ID NO: 8844 - protein, 26 aa, Homo sapiens
KKVEHEISEGNVATAAAAALASAATK

SEQ ID NO: 8845 - protein, 15 aa, Homo sapiens
VASAAAKAALEEFSR

SEQ ID NO: 8846 - protein, 26 aa, Homo sapiens
KKVEHEISEGNVATAAAAALASAATK

SEQ ID NO: 8847 - protein, 15 aa, Homo sapiens
VASAAAKAALEEFSR

SEQ ID NO: 8848 - protein, 15 aa, Homo sapiens
VASAAAKAALEEFSR

SEQ ID NO: 8849 - protein, 15 aa, Homo sapiens
VASAAAKAALEEFSR

SEQ ID NO: 8850 - protein, 8 aa, Homo sapiens
YKNEQGWR

SEQ ID NO: 8851 - protein, 9 aa, Homo sapiens
YKNEQGWRR

SEQ ID NO: 8852 - protein, 7 aa, Homo sapiens
KASANAR

SEQ ID NO: 8853 - protein, 7 aa, Homo sapiens
KASANAR

SEQ ID NO: 8854 - protein, 39 aa, Homo sapiens; identical to SEQ ID NO: 8701

SEQ ID NO: 8855 - protein, 8 aa, Homo sapiens
KDGGPATK

SEQ ID NO: 8856 - protein, 25 aa, Homo sapiens
KVEHEISEGNVATAAAAALASAATK

SEQ ID NO: 8857 - protein, 25 aa, Homo sapiens
KVEHEISEGNVATAAAAALASAATK

SEQ ID NO: 8858 - protein, 25 aa, Homo sapiens
KVEHEISEGNVATAAAAALASAATK

SEQ ID NO: 8859 - protein, 25 aa, Homo sapiens
KVEHEISEGNVATAAAAALASAATK

SEQ ID NO: 8860 - protein, 25 aa, Homo sapiens
KVEHEISEGNVATAAAAALASAATK

SEQ ID NO: 8861 - protein, 25 aa, Homo sapiens
KVEHEISEGNVATAAAAALASAATK

SEQ ID NO: 8862 - protein, 25 aa, Homo sapiens
KVEHEISEGNVATAAAAALASAATK

SEQ ID NO: 8863 - protein, 25 aa, Homo sapiens
KVEHEISEGNVATAAAAALASAATK

SEQ ID NO: 8864 - protein, 34 aa, Homo sapiens
ASGKVDPTYGLESSCIAGTGPDEPEKLEGAEEEK

SEQ ID NO: 8865 - protein, 34 aa, Homo sapiens; identical to SEQ ID NO: 8864

SEQ ID NO: 8866 - protein, 7 aa, Homo sapiens
KVQEAAR

SEQ ID NO: 8867 - protein, 7 aa, Homo sapiens
KVQEAAR

SEQ ID NO: 8868 - protein, 9 aa, Homo sapiens
DRKASANAR

SEQ ID NO: 8869 - protein, 7 aa, Homo sapiens
KVQEAAR

SEQ ID NO: 8870 - protein, 7 aa, Homo sapiens
KASANAR

SEQ ID NO: 8871 - protein, 9 aa, Homo sapiens
DRKASANAR

SEQ ID NO: 8872 - protein, 9 aa, Homo sapiens
DRKASANAR

SEQ ID NO: 8873 - protein, 7 aa, Homo sapiens
KASANAR

SEQ ID NO: 8874 - protein, 9 aa, Homo sapiens
GQASLYGKR

SEQ ID NO: 8875 - protein, 9 aa, Homo sapiens
GQASLYGKR

SEQ ID NO: 8876 - protein, 9 aa, Homo sapiens
DRKASANAR

SEQ ID NO: 8877 - protein, 7 aa, Homo sapiens
KASANAR

SEQ ID NO: 8878 - protein, 7 aa, Homo sapiens
KASANAR

SEQ ID NO: 8879 - protein, 7 aa, Homo sapiens
KASANAR

SEQ ID NO: 8880 - protein, 22 aa, Homo sapiens
DGGPATKFWESPETVSQLDSVR

SEQ ID NO: 8881 - protein, 7 aa, Homo sapiens
KASANAR

SEQ ID NO: 8882 - protein, 7 aa, Homo sapiens
KASANAR

SEQ ID NO: 8883 - protein, 7 aa, Homo sapiens
KASANAR

SEQ ID NO: 8884 - protein, 28 aa, Homo sapiens
TLAGLVVQLLQFQEDAFGKHVTNPAFTK

SEQ ID NO: 8885 - protein, 28 aa, Homo sapiens
TLAGLVVQLLQFQEDAFGKHVTNPAFTK

SEQ ID NO: 8886 - protein, 28 aa, Homo sapiens
TLAGLVVQLLQFQEDAFGKHVTNPAFTK

SEQ ID NO: 8887 - protein, 28 aa, Homo sapiens
TLAGLVVQLLQFQEDAFGKHVTNPAFTK

SEQ ID NO: 8888 - protein, 28 aa, Homo sapiens
TLAGLVVQLLQFQEDAFGKHVTNPAFTK

SEQ ID NO: 8889 - protein, 28 aa, Homo sapiens
TLAGLVVQLLQFQEDAFGKHVTNPAFTK

SEQ ID NO: 8890 - protein, 32 aa, Homo sapiens
TLAGLVVQLLQFQEDAFGKHVTNPAFTKLPAK

SEQ ID NO: 8891 - protein, 7 aa, Homo sapiens
KASANAR

SEQ ID NO: 8892 - protein, 32 aa, Homo sapiens; identical to SEQ ID NO: 8890

SEQ ID NO: 8893 - protein, 15 aa, Homo sapiens
KHSPSPPPPTPTESR

SEQ ID NO: 8894 - protein, 15 aa, Homo sapiens
KHSPSPPPPTPTESR

SEQ ID NO: 8895 - protein, 15 aa, Homo sapiens
KHSPSPPPPTPTESR

SEQ ID NO: 8896 - protein, 15 aa, Homo sapiens
KHSPSPPPPTPTESR

SEQ ID NO: 8897 - protein, 7 aa, Homo sapiens
KASANAR

SEQ ID NO: 8898 - protein, 9 aa, Homo sapiens
DRKASANAR

SEQ ID NO: 8899 - protein, 8 aa, Homo sapiens
KDGGPATK

SEQ ID NO: 8900 - protein, 9 aa, Homo sapiens
RKDGGPATK

SEQ ID NO: 8901 - protein, 9 aa, Homo sapiens
RKDGGPATK

SEQ ID NO: 8902 - protein, 7 aa, Homo sapiens
KVQEAAR

SEQ ID NO: 8903 - protein, 9 aa, Homo sapiens
DRKASANAR

SEQ ID NO: 8904 - protein, 25 aa, Homo sapiens
SKASHHIYPYSSSQDDEEWLRPVMR

SEQ ID NO: 8905 - protein, 25 aa, Homo sapiens
SKASHHIYPYSSSQDDEEWLRPVMR

SEQ ID NO: 8906 - protein, 20 aa, Homo sapiens
EKLTELMFEHYNIPAFFLCK

SEQ ID NO: 8907 - protein, 29 aa, Homo sapiens
DDGSTLMEIDGDKGKQGGPTYYIDTNALR

SEQ ID NO: 8908 - protein, 29 aa, Homo sapiens
DDGSTLMEIDGDKGKQGGPTYYIDTNALR

SEQ ID NO: 8909 - protein, 20 aa, Homo sapiens
EKLTELMFEHYNIPAFFLCK

SEQ ID NO: 8910 - protein, 29 aa, Homo sapiens
DDGSTLMEIDGDKGKQGGPTYYIDTNALR

SEQ ID NO: 8911 - protein, 29 aa, Homo sapiens
DDGSTLMEIDGDKGKQGGPTYYIDTNALR

SEQ ID NO: 8912 - protein, 29 aa, Homo sapiens
DDGSTLMEIDGDKGKQGGPTYYIDTNALR

SEQ ID NO: 8913 - protein, 13 aa, Homo sapiens
QEYEEGGKQCVER

SEQ ID NO: 8914 - protein, 13 aa, Homo sapiens
QEYEEGGKQCVER

SEQ ID NO: 8915 - protein, 20 aa, Homo sapiens
EKLTELMFEHYNIPAFFLCK

SEQ ID NO: 8916 - protein, 13 aa, Homo sapiens
QEYEEGGKQCVER

SEQ ID NO: 8917 - protein, 13 aa, Homo sapiens
QEYEEGGKQCVER

SEQ ID NO: 8918 - protein, 13 aa, Homo sapiens
QEYEEGGKQCVER

SEQ ID NO: 8919 - protein, 20 aa, Homo sapiens
EKLTELMFEHYNIPAFFLCK

SEQ ID NO: 8920 - protein, 13 aa, Homo sapiens
QEYEEGGKQCVER

SEQ ID NO: 8921 - protein, 13 aa, Homo sapiens
QEYEEGGKQCVER

SEQ ID NO: 8922 - protein, 20 aa, Homo sapiens
EKLTELMFEHYNIPAFFLCK

SEQ ID NO: 8923 - protein, 13 aa, Homo sapiens
QEYEEGGKQCVER

SEQ ID NO: 8924 - protein, 20 aa, Homo sapiens
EKLTELMFEHYNIPAFFLCK

SEQ ID NO: 8925 - protein, 13 aa, Homo sapiens
QEYEEGGKQCVER

SEQ ID NO: 8926 - protein, 20 aa, Homo sapiens
EKLTELMFEHYNIPAFFLCK

SEQ ID NO: 8927 - protein, 13 aa, Homo sapiens
QEYEEGGKQCVER

SEQ ID NO: 8928 - protein, 20 aa, Homo sapiens
EKLTELMFEHYNIPAFFLCK

SEQ ID NO: 8929 - protein, 20 aa, Homo sapiens
EKLTELMFEHYNIPAFFLCK

SEQ ID NO: 8930 - protein, 21 aa, Homo sapiens
REKLTELMFEHYNIPAFFLCK

SEQ ID NO: 8931 - protein, 13 aa, Homo sapiens
QEYEEGGKQCVER

SEQ ID NO: 8932 - protein, 13 aa, Homo sapiens
QEYEEGGKQCVER

SEQ ID NO: 8933 - protein, 20 aa, Homo sapiens
EKLTELMFEHYNIPAFFLCK

SEQ ID NO: 8934 - protein, 13 aa, Homo sapiens
QEYEEGGKQCVER

SEQ ID NO: 8935 - protein, 20 aa, Homo sapiens
EKLTELMFEHYNIPAFFLCK

SEQ ID NO: 8936 - protein, 21 aa, Homo sapiens
REKLTELMFEHYNIPAFFLCK

SEQ ID NO: 8937 - protein, 13 aa, Homo sapiens
QEYEEGGKQCVER

SEQ ID NO: 8938 - protein, 13 aa, Homo sapiens
QEYEEGGKQCVER

SEQ ID NO: 8939 - protein, 13 aa, Homo sapiens
QEYEEGGKQCVER

SEQ ID NO: 8940 - protein, 13 aa, Homo sapiens
QEYEEGGKQCVER

SEQ ID NO: 8941 - protein, 20 aa, Homo sapiens
EKLTELMFEHYNIPAFFLCK

SEQ ID NO: 8942 - protein, 13 aa, Homo sapiens
QEYEEGGKQCVER

SEQ ID NO: 8943 - protein, 13 aa, Homo sapiens
QEYEEGGKQCVER

SEQ ID NO: 8944 - protein, 13 aa, Homo sapiens
QEYEEGGKQCVER

SEQ ID NO: 8945 - protein, 20 aa, Homo sapiens
EKLTELMFEHYNIPAFFLCK

SEQ ID NO: 8946 - protein, 13 aa, Homo sapiens
QEYEEGGKQCVER

SEQ ID NO: 8947 - protein, 21 aa, Homo sapiens
REKLTELMFEHYNIPAFFLCK

SEQ ID NO: 8948 - protein, 13 aa, Homo sapiens
QEYEEGGKQCVER

SEQ ID NO: 8949 - protein, 15 aa, Homo sapiens
DDGSTLMEIDGDKGK

SEQ ID NO: 8950 - protein, 28 aa, Homo sapiens
VDFPTAIGMVVERDDGSTLMEIDGDKGK

SEQ ID NO: 8951 - protein, 29 aa, Homo sapiens
DDGSTLMEIDGDKGKQGGPTYYIDTNALR

SEQ ID NO: 8952 - protein, 20 aa, Homo sapiens
EKLTELMFEHYNIPAFFLCK

SEQ ID NO: 8953 - protein, 20 aa, Homo sapiens
EKLTELMFEHYNIPAFFLCK

SEQ ID NO: 8954 - protein, 20 aa, Homo sapiens
EKLTELMFEHYNIPAFFLCK

SEQ ID NO: 8955 - protein, 28 aa, Homo sapiens
VDFPTAIGMVVERDDGSTLMEIDGDKGK

SEQ ID NO: 8956 - protein, 20 aa, Homo sapiens
EKLTELMFEHYNIPAFFLCK

SEQ ID NO: 8957 - protein, 20 aa, Homo sapiens
EKLTELMFEHYNIPAFFLCK

SEQ ID NO: 8958 - protein, 20 aa, Homo sapiens
EKLTELMFEHYNIPAFFLCK

SEQ ID NO: 8959 - protein, 20 aa, Homo sapiens
EKLTELMFEHYNIPAFFLCK

SEQ ID NO: 8960 - protein, 15 aa, Homo sapiens
DDGSTLMEIDGDKGK

SEQ ID NO: 8961 - protein, 29 aa, Homo sapiens
DDGSTLMEIDGDKGKQGGPTYYIDTNALR

SEQ ID NO: 8962 - protein, 20 aa, Homo sapiens
EKLTELMFEHYNIPAFFLCK

SEQ ID NO: 8963 - protein, 20 aa, Homo sapiens
EKLTELMFEHYNIPAFFLCK

SEQ ID NO: 8964 - protein, 20 aa, Homo sapiens
EKLTELMFEHYNIPAFFLCK

SEQ ID NO: 8965 - protein, 20 aa, Homo sapiens
EKLTELMFEHYNIPAFFLCK

SEQ ID NO: 8966 - protein, 20 aa, Homo sapiens
EKLTELMFEHYNIPAFFLCK

SEQ ID NO: 8967 - protein, 20 aa, Homo sapiens
EKLTELMFEHYNIPAFFLCK

SEQ ID NO: 8968 - protein, 20 aa, Homo sapiens
EKLTELMFEHYNIPAFFLCK

SEQ ID NO: 8969 - protein, 20 aa, Homo sapiens
EKLTELMFEHYNIPAFFLCK

SEQ ID NO: 8970 - protein, 20 aa, Homo sapiens
EKLTELMFEHYNIPAFFLCK

SEQ ID NO: 8971 - protein, 20 aa, Homo sapiens
EKLTELMFEHYNIPAFFLCK

SEQ ID NO: 8972 - protein, 20 aa, Homo sapiens
EKLTELMFEHYNIPAFFLCK

SEQ ID NO: 8973 - protein, 12 aa, Homo sapiens
LKLIANNTTVER

SEQ ID NO: 8974 - protein, 13 aa, Homo sapiens
LKLIANNTTVERR

SEQ ID NO: 8975 - protein, 29 aa, Homo sapiens
ENMEAISPLKNGMVEDWDSFQAILDHTYK

SEQ ID NO: 8976 - protein, 43 aa, Homo sapiens; identical to SEQ ID NO: 2316

SEQ ID NO: 8977 - protein, 43 aa, Homo sapiens; identical to SEQ ID NO: 2316

SEQ ID NO: 8978 - protein, 29 aa, Homo sapiens
ENMEAISPLKNGMVEDWDSFQAILDHTYK

SEQ ID NO: 8979 - protein, 43 aa, Homo sapiens; identical to SEQ ID NO: 2316

SEQ ID NO: 8980 - protein, 43 aa, Homo sapiens; identical to SEQ ID NO: 2316

SEQ ID NO: 8981 - protein, 43 aa, Homo sapiens; identical to SEQ ID NO: 2316

SEQ ID NO: 8982 - protein, 43 aa, Homo sapiens; identical to SEQ ID NO: 2316

SEQ ID NO: 8983 - protein, 29 aa, Homo sapiens
ENMEAISPLKNGMVEDWDSFQAILDHTYK

SEQ ID NO: 8984 - protein, 29 aa, Homo sapiens
ENMEAISPLKNGMVEDWDSFQAILDHTYK

SEQ ID NO: 8985 - protein, 29 aa, Homo sapiens
ENMEAISPLKNGMVEDWDSFQAILDHTYK

SEQ ID NO: 8986 - protein, 29 aa, Homo sapiens
ENMEAISPLKNGMVEDWDSFQAILDHTYK

SEQ ID NO: 8987 - protein, 43 aa, Homo sapiens; identical to SEQ ID NO: 2316

SEQ ID NO: 8988 - protein, 29 aa, Homo sapiens
ENMEAISPLKNGMVEDWDSFQAILDHTYK

SEQ ID NO: 8989 - protein, 29 aa, Homo sapiens
ENMEAISPLKNGMVEDWDSFQAILDHTYK

SEQ ID NO: 8990 - protein, 29 aa, Homo sapiens
ENMEAISPLKNGMVEDWDSFQAILDHTYK

SEQ ID NO: 8991 - protein, 29 aa, Homo sapiens
ENMEAISPLKNGMVEDWDSFQAILDHTYK

SEQ ID NO: 8992 - protein, 29 aa, Homo sapiens
ENMEAISPLKNGMVEDWDSFQAILDHTYK

SEQ ID NO: 8993 - protein, 29 aa, Homo sapiens
ENMEAISPLKNGMVEDWDSFQAILDHTYK

SEQ ID NO: 8994 - protein, 29 aa, Homo sapiens
ENMEAISPLKNGMVEDWDSFQAILDHTYK

SEQ ID NO: 8995 - protein, 43 aa, Homo sapiens; identical to SEQ ID NO: 2316

SEQ ID NO: 8996 - protein, 43 aa, Homo sapiens; identical to SEQ ID NO: 2316

SEQ ID NO: 8997 - protein, 33 aa, Homo sapiens
ENMEAISPLKNGMVEDWDSFQAILDHTYKMHVK

SEQ ID NO: 8998 - protein, 33 aa, Homo sapiens; identical to SEQ ID NO: 8997

SEQ ID NO: 8999 - protein, 33 aa, Homo sapiens; identical to SEQ ID NO: 8997

SEQ ID NO: 9000 - protein, 33 aa, Homo sapiens; identical to SEQ ID NO: 8997

SEQ ID NO: 9001 - protein, 9 aa, Homo sapiens
EGSPANWKR

SEQ ID NO: 9002 - protein, 9 aa, Homo sapiens
KEKLPQVTR

SEQ ID NO: 9003 - protein, 9 aa, Homo sapiens
EGSPANWKR

SEQ ID NO: 9004 - protein, 9 aa, Homo sapiens
KEKLPQVTR

SEQ ID NO: 9005 - protein, 9 aa, Homo sapiens
EGSPANWKR

SEQ ID NO: 9006 - protein, 9 aa, Homo sapiens
KEKLPQVTR

SEQ ID NO: 9007 - protein, 9 aa, Homo sapiens
EGSPANWKR

SEQ ID NO: 9008 - protein, 9 aa, Homo sapiens
EGSPANWKR

SEQ ID NO: 9009 - protein, 9 aa, Homo sapiens
KEKLPQVTR

SEQ ID NO: 9010 - protein, 9 aa, Homo sapiens
KEKLPQVTR

SEQ ID NO: 9011 - protein, 9 aa, Homo sapiens
KEKLPQVTR

SEQ ID NO: 9012 - protein, 13 aa, Homo sapiens
EAVREGSPANWKR

SEQ ID NO: 9013 - protein, 13 aa, Homo sapiens
EAVREGSPANWKR

SEQ ID NO: 9014 - protein, 9 aa, Homo sapiens
KEKLPQVTR

SEQ ID NO: 9015 - protein, 9 aa, Homo sapiens
KEKLPQVTR

SEQ ID NO: 9016 - protein, 9 aa, Homo sapiens
EGSPANWKR

SEQ ID NO: 9017 - protein, 9 aa, Homo sapiens
EGSPANWKR

SEQ ID NO: 9018 - protein, 9 aa, Homo sapiens
EGSPANWKR

SEQ ID NO: 9019 - protein, 9 aa, Homo sapiens
KEKLPQVTR

SEQ ID NO: 9020 - protein, 9 aa, Homo sapiens
EGSPANWKR

SEQ ID NO: 9021 - protein, 13 aa, Homo sapiens
EAVREGSPANWKR

SEQ ID NO: 9022 - protein, 9 aa, Homo sapiens
EGSPANWKR

SEQ ID NO: 9023 - protein, 9 aa, Homo sapiens
KEKLPQVTR

SEQ ID NO: 9024 - protein, 9 aa, Homo sapiens
EGSPANWKR

SEQ ID NO: 9025 - protein, 9 aa, Homo sapiens
EGSPANWKR

SEQ ID NO: 9026 - protein, 9 aa, Homo sapiens
EGSPANWKR

SEQ ID NO: 9027 - protein, 13 aa, Homo sapiens
EAVREGSPANWKR

SEQ ID NO: 9028 - protein, 9 aa, Homo sapiens
EGSPANWKR

SEQ ID NO: 9029 - protein, 9 aa, Homo sapiens
EGSPANWKR

SEQ ID NO: 9030 - protein, 9 aa, Homo sapiens
KEKLPQVTR

SEQ ID NO: 9031 - protein, 9 aa, Homo sapiens
EGSPANWKR

SEQ ID NO: 9032 - protein, 9 aa, Homo sapiens
KEKLPQVTR

SEQ ID NO: 9033 - protein, 9 aa, Homo sapiens
EGSPANWKR

SEQ ID NO: 9034 - protein, 9 aa, Homo sapiens
KEKLPQVTR

SEQ ID NO: 9035 - protein, 9 aa, Homo sapiens
EGSPANWKR

SEQ ID NO: 9036 - protein, 9 aa, Homo sapiens
EGSPANWKR

SEQ ID NO: 9037 - protein, 9 aa, Homo sapiens
KEKLPQVTR

SEQ ID NO: 9038 - protein, 9 aa, Homo sapiens
EGSPANWKR

SEQ ID NO: 9039 - protein, 9 aa, Homo sapiens
EGSPANWKR

SEQ ID NO: 9040 - protein, 9 aa, Homo sapiens
EGSPANWKR

SEQ ID NO: 9041 - protein, 13 aa, Homo sapiens
EAVREGSPANWKR

SEQ ID NO: 9042 - protein, 9 aa, Homo sapiens
EGSPANWKR

SEQ ID NO: 9043 - protein, 9 aa, Homo sapiens
EGSPANWKR

SEQ ID NO: 9044 - protein, 9 aa, Homo sapiens
EGSPANWKR

SEQ ID NO: 9045 - protein, 13 aa, Homo sapiens
EAVREGSPANWKR

SEQ ID NO: 9046 - protein, 9 aa, Homo sapiens
EGSPANWKR

SEQ ID NO: 9047 - protein, 13 aa, Homo sapiens
EAVREGSPANWKR

SEQ ID NO: 9048 - protein, 9 aa, Homo sapiens
KEKLPQVTR

SEQ ID NO: 9049 - protein, 13 aa, Homo sapiens
EAVREGSPANWKR

SEQ ID NO: 9050 - protein, 9 aa, Homo sapiens
EGSPANWKR

SEQ ID NO: 9051 - protein, 9 aa, Homo sapiens
KEKLPQVTR

SEQ ID NO: 9052 - protein, 9 aa, Homo sapiens
EGSPANWKR

SEQ ID NO: 9053 - protein, 9 aa, Homo sapiens
EGSPANWKR

SEQ ID NO: 9054 - protein, 9 aa, Homo sapiens
KEKLPQVTR

SEQ ID NO: 9055 - protein, 9 aa, Homo sapiens
EGSPANWKR

SEQ ID NO: 9056 - protein, 9 aa, Homo sapiens
EGSPANWKR

SEQ ID NO: 9057 - protein, 9 aa, Homo sapiens
KEKLPQVTR

SEQ ID NO: 9058 - protein, 9 aa, Homo sapiens
KEKLPQVTR

SEQ ID NO: 9059 - protein, 9 aa, Homo sapiens
EGSPANWKR

SEQ ID NO: 9060 - protein, 9 aa, Homo sapiens
KEKLPQVTR

SEQ ID NO: 9061 - protein, 9 aa, Homo sapiens
EGSPANWKR

SEQ ID NO: 9062 - protein, 9 aa, Homo sapiens
EGSPANWKR

SEQ ID NO: 9063 - protein, 9 aa, Homo sapiens
EGSPANWKR

SEQ ID NO: 9064 - protein, 13 aa, Homo sapiens
EAVREGSPANWKR

SEQ ID NO: 9065 - protein, 9 aa, Homo sapiens
EGSPANWKR

SEQ ID NO: 9066 - protein, 10 aa, Homo sapiens
EGSPANWKRK

SEQ ID NO: 9067 - protein, 9 aa, Homo sapiens
EGSPANWKR

SEQ ID NO: 9068 - protein, 10 aa, Homo sapiens
EGSPANWKRK

SEQ ID NO: 9069 - protein, 9 aa, Homo sapiens
EGSPANWKR

SEQ ID NO: 9070 - protein, 22 aa, Homo sapiens
MHVKSEASLHPVLMSEAPWNTR

SEQ ID NO: 9071 - protein, 22 aa, Homo sapiens
MHVKSEASLHPVLMSEAPWNTR

SEQ ID NO: 9072 - protein, 22 aa, Homo sapiens
MHVKSEASLHPVLMSEAPWNTR

SEQ ID NO: 9073 - protein, 22 aa, Homo sapiens
MHVKSEASLHPVLMSEAPWNTR

SEQ ID NO: 9074 - protein, 23 aa, Homo sapiens
AGYAGEDCPKVDFPTAIGMVVER

SEQ ID NO: 9075 - protein, 23 aa, Homo sapiens
AGYAGEDCPKVDFPTAIGMVVER

SEQ ID NO: 9076 - protein, 23 aa, Homo sapiens
AGYAGEDCPKVDFPTAIGMVVER

SEQ ID NO: 9077 - protein, 22 aa, Homo sapiens
MHVKSEASLHPVLMSEAPWNTR

SEQ ID NO: 9078 - protein, 23 aa, Homo sapiens
AGYAGEDCPKVDFPTAIGMVVER

SEQ ID NO: 9079 - protein, 22 aa, Homo sapiens
MHVKSEASLHPVLMSEAPWNTR

SEQ ID NO: 9080 - protein, 23 aa, Homo sapiens
AGYAGEDCPKVDFPTAIGMVVER

SEQ ID NO: 9081 - protein, 22 aa, Homo sapiens
MHVKSEASLHPVLMSEAPWNTR

SEQ ID NO: 9082 - protein, 33 aa, Homo sapiens; identical to SEQ ID NO: 8997

SEQ ID NO: 9083 - protein, 33 aa, Homo sapiens; identical to SEQ ID NO: 8997

SEQ ID NO: 9084 - protein, 33 aa, Homo sapiens; identical to SEQ ID NO: 8997

SEQ ID NO: 9085 - protein, 9 aa, Homo sapiens
KEKLPQVTR

SEQ ID NO: 9086 - protein, 36 aa, Homo sapiens
AGYAGEDCPKVDFPTAIGMVVERDDGSTLMEIDGDK

SEQ ID NO: 9087 - protein, 36 aa, Homo sapiens; identical to SEQ ID NO: 9086

SEQ ID NO: 9088 - protein, 36 aa, Homo sapiens; identical to SEQ ID NO: 9086

SEQ ID NO: 9089 - protein, 36 aa, Homo sapiens; identical to SEQ ID NO: 9086

SEQ ID NO: 9090 - protein, 23 aa, Homo sapiens
AGYAGEDCPKVDFPTAIGMVVER

SEQ ID NO: 9091 - protein, 36 aa, Homo sapiens; identical to SEQ ID NO: 9086

SEQ ID NO: 9092 - protein, 36 aa, Homo sapiens; identical to SEQ ID NO: 9086

SEQ ID NO: 9093 - protein, 23 aa, Homo sapiens
ELFQEMNIELVPPYMIASKEAVR

SEQ ID NO: 9094 - protein, 23 aa, Homo sapiens
ELFQEMNIELVPPYMIASKEAVR

SEQ ID NO: 9095 - protein, 23 aa, Homo sapiens
ELFQEMNIELVPPYMIASKEAVR

SEQ ID NO: 9096 - protein, 23 aa, Homo sapiens
ELFQEMNIELVPPYMIASKEAVR

SEQ ID NO: 9097 - protein, 23 aa, Homo sapiens
ELFQEMNIELVPPYMIASKEAVR

SEQ ID NO: 9098 - protein, 23 aa, Homo sapiens
ELFQEMNIELVPPYMIASKEAVR

SEQ ID NO: 9099 - protein, 23 aa, Homo sapiens
ELFQEMNIELVPPYMIASKEAVR

SEQ ID NO: 9100 - protein, 9 aa, Homo sapiens
KEKLPQVTR

SEQ ID NO: 9101 - protein, 23 aa, Homo sapiens
ELFQEMNIELVPPYMIASKEAVR

SEQ ID NO: 9102 - protein, 23 aa, Homo sapiens
ELFQEMNIELVPPYMIASKEAVR

SEQ ID NO: 9103 - protein, 23 aa, Homo sapiens
ELFQEMNIELVPPYMIASKEAVR

SEQ ID NO: 9104 - protein, 12 aa, Homo sapiens
WVPVTDSKEKEK

SEQ ID NO: 9105 - protein, 12 aa, Homo sapiens
WVPVTDSKEKEK

SEQ ID NO: 9106 - protein, 12 aa, Homo sapiens
WVPVTDSKEKEK

SEQ ID NO: 9107 - protein, 12 aa, Homo sapiens
WVPVTDSKEKEK

SEQ ID NO: 9108 - protein, 29 aa, Homo sapiens
TFGQKPVKFQLEDDGEFYMIGSEVGNYLR

SEQ ID NO: 9109 - protein, 15 aa, Homo sapiens
YKAVSISTEPPTYLR

SEQ ID NO: 9110 - protein, 6 aa, Homo sapiens
EQKAKR

SEQ ID NO: 9111 - protein, 6 aa, Homo sapiens
EQKAKR

SEQ ID NO: 9112 - protein, 6 aa, Homo sapiens
GSLYKR

SEQ ID NO: 9113 - protein, 6 aa, Homo sapiens
GSLYKR

SEQ ID NO: 9114 - protein, 6 aa, Homo sapiens
EQKAKR

SEQ ID NO: 9115 - protein, 6 aa, Homo sapiens
EQKAKR

SEQ ID NO: 9116 - protein, 11 aa, Homo sapiens
LDMEIDGQKLR

SEQ ID NO: 9117 - protein, 11 aa, Homo sapiens
LDMEIDGQKLR

SEQ ID NO: 9118 - protein, 7 aa, Homo sapiens
KIRDQDR

SEQ ID NO: 9119 - protein, 11 aa, Homo sapiens
LDMEIDGQKLR

SEQ ID NO: 9120 - protein, 11 aa, Homo sapiens
LDMEIDGQKLR

SEQ ID NO: 9121 - protein, 11 aa, Homo sapiens
LDMEIDGQKLR

SEQ ID NO: 9122 - protein, 11 aa, Homo sapiens
LDMEIDGQKLR

SEQ ID NO: 9123 - protein, 11 aa, Homo sapiens
LDMEIDGQKLR

SEQ ID NO: 9124 - protein, 11 aa, Homo sapiens
LDMEIDGQKLR

SEQ ID NO: 9125 - protein, 3 aa, Homo sapiens
KIR

SEQ ID NO: 9126 - protein, 11 aa, Homo sapiens
LDMEIDGQKLR

SEQ ID NO: 9127 - protein, 11 aa, Homo sapiens
LDMEIDGQKLR

SEQ ID NO: 9128 - protein, 11 aa, Homo sapiens
LDMEIDGQKLR

SEQ ID NO: 9129 - protein, 11 aa, Homo sapiens
LDMEIDGQKLR

SEQ ID NO: 9130 - protein, 14 aa, Homo sapiens
LTKAVATYHANTER

SEQ ID NO: 9131 - protein, 14 aa, Homo sapiens
LTKAVATYHANTER

SEQ ID NO: 9132 - protein, 8 aa, Homo sapiens
SVTGKIQK

SEQ ID NO: 9133 - protein, 17 aa, Homo sapiens
LTKAVATYHANTEREQK

SEQ ID NO: 9134 - protein, 16 aa, Homo sapiens
KIPDPDSDDVSEVDAR

SEQ ID NO: 9135 - protein, 4 aa, Homo sapiens
KDKR

SEQ ID NO: 9136 - protein, 22 aa, Homo sapiens
HIIENAKQDVDDEYGVSQALAR

SEQ ID NO: 9137 - protein, 17 aa, Homo sapiens
VIHVESGKILTGTDAPK

SEQ ID NO: 9138 - protein, 17 aa, Homo sapiens
VIHVESGKILTGTDAPK

SEQ ID NO: 9139 - protein, 17 aa, Homo sapiens
VIHVESGKILTGTDAPK

SEQ ID NO: 9140 - protein, 17 aa, Homo sapiens
KKIPDPDSDDVSEVDAR

SEQ ID NO: 9141 - protein, 17 aa, Homo sapiens
KKIPDPDSDDVSEVDAR

SEQ ID NO: 9142 - protein, 7 aa, Homo sapiens
KEKAQDR

SEQ ID NO: 9143 - protein, 8 aa, Homo sapiens
YKDSSSGR

SEQ ID NO: 9144 - protein, 8 aa, Homo sapiens
YKDSSSGR

SEQ ID NO: 9145 - protein, 8 aa, Homo sapiens
YKDSSSGR

SEQ ID NO: 9146 - protein, 5 aa, Homo sapiens
KIKER

SEQ ID NO: 9147 - protein, 10 aa, Homo sapiens
VSYKGSPAAR

SEQ ID NO: 9148 - protein, 5 aa, Homo sapiens
IKLGR

SEQ ID NO: 9149 - protein, 5 aa, Homo sapiens
NHKYR

SEQ ID NO: 9150 - protein, 7 aa, Homo sapiens
IRNHKYR

SEQ ID NO: 9151 - protein, 7 aa, Homo sapiens
IRNHKYR

SEQ ID NO: 9152 - protein, 10 aa, Homo sapiens
VSYKGSPAAR

SEQ ID NO: 9153 - protein, 11 aa, Homo sapiens
KELPEYYELIR

SEQ ID NO: 9154 - protein, 11 aa, Homo sapiens
KELPEYYELIR

SEQ ID NO: 9155 - protein, 16 aa, Homo sapiens
KRDSDAGSSTPTTSTR

SEQ ID NO: 9156 - protein, 16 aa, Homo sapiens
KRDSDAGSSTPTTSTR

SEQ ID NO: 9157 - protein, 6 aa, Homo sapiens
QKKSSR

SEQ ID NO: 9158 - protein, 17 aa, Homo sapiens
GRPPAEKLSPNPPNLTK

SEQ ID NO: 9159 - protein, 34 aa, Homo sapiens
KICNHPYMFQHIEESFSEHLGFTGGIVQGLDLYR

SEQ ID NO: 9160 - protein, 13 aa, Homo sapiens
LTCEEEEEKMFGR

SEQ ID NO: 9161 - protein, 15 aa, Homo sapiens
AVATYHANTEREQKK

SEQ ID NO: 9162 - protein, 15 aa, Homo sapiens
AVATYHANTEREQKK

SEQ ID NO: 9163 - protein, 8 aa, Homo sapiens
EQKKENER

SEQ ID NO: 9164 - protein, 8 aa, Homo sapiens
EQKKENER

SEQ ID NO: 9165 - protein, 8 aa, Homo sapiens
EQKKENER

SEQ ID NO: 9166 - protein, 15 aa, Homo sapiens
AVATYHANTEREQKK

SEQ ID NO: 9167 - protein, 9 aa, Homo sapiens
ENERIEKER

SEQ ID NO: 9168 - protein, 15 aa, Homo sapiens
AVATYHANTEREQKK

SEQ ID NO: 9169 - protein, 15 aa, Homo sapiens
AVATYHANTEREQKK

SEQ ID NO: 9170 - protein, 15 aa, Homo sapiens
AVATYHANTEREQKK

SEQ ID NO: 9171 - protein, 15 aa, Homo sapiens
AVATYHANTEREQKK

SEQ ID NO: 9172 - protein, 15 aa, Homo sapiens
AVATYHANTEREQKK

SEQ ID NO: 9173 - protein, 15 aa, Homo sapiens
AVATYHANTEREQKK

SEQ ID NO: 9174 - protein, 15 aa, Homo sapiens
AVATYHANTEREQKK

SEQ ID NO: 9175 - protein, 15 aa, Homo sapiens
AVATYHANTEREQKK

SEQ ID NO: 9176 - protein, 15 aa, Homo sapiens
AVATYHANTEREQKK

SEQ ID NO: 9177 - protein, 15 aa, Homo sapiens
AVATYHANTEREQKK

SEQ ID NO: 9178 - protein, 15 aa, Homo sapiens
AVATYHANTEREQKK

SEQ ID NO: 9179 - protein, 15 aa, Homo sapiens
AVATYHANTEREQKK

SEQ ID NO: 9180 - protein, 9 aa, Homo sapiens
ENERIEKER

SEQ ID NO: 9181 - protein, 15 aa, Homo sapiens
AVATYHANTEREQKK

SEQ ID NO: 9182 - protein, 15 aa, Homo sapiens
AVATYHANTEREQKK

SEQ ID NO: 9183 - protein, 15 aa, Homo sapiens
AVATYHANTEREQKK

SEQ ID NO: 9184 - protein, 16 aa, Homo sapiens
GQPLPDHLQMAVQGKR

SEQ ID NO: 9185 - protein, 16 aa, Homo sapiens
GQPLPDHLQMAVQGKR

SEQ ID NO: 9186 - protein, 10 aa, Homo sapiens
YNQMKGMGMR

SEQ ID NO: 9187 - protein, 10 aa, Homo sapiens
YNQMKGMGMR

SEQ ID NO: 9188 - protein, 10 aa, Homo sapiens
YNQMKGMGMR

SEQ ID NO: 9189 - protein, 16 aa, Homo sapiens
GQPLPDHLQMAVQGKR

SEQ ID NO: 9190 - protein, 10 aa, Homo sapiens
YNQMKGMGMR

SEQ ID NO: 9191 - protein, 5 aa, Homo sapiens
IEKER

SEQ ID NO: 9192 - protein, 9 aa, Homo sapiens
ENERIEKER

SEQ ID NO: 9193 - protein, 9 aa, Homo sapiens
ENERIEKER

SEQ ID NO: 9194 - protein, 9 aa, Homo sapiens
ENERIEKER

SEQ ID NO: 9195 - protein, 9 aa, Homo sapiens
ENERIEKER

SEQ ID NO: 9196 - protein, 9 aa, Homo sapiens
ENERIEKER

SEQ ID NO: 9197 - protein, 9 aa, Homo sapiens
ENERIEKER

SEQ ID NO: 9198 - protein, 9 aa, Homo sapiens
ENERIEKER

SEQ ID NO: 9199 - protein, 9 aa, Homo sapiens
ENERIEKER

SEQ ID NO: 9200 - protein, 11 aa, Homo sapiens
QHKAAQVAKEK

SEQ ID NO: 9201 - protein, 16 aa, Homo sapiens
LCTVNSVEEKILAAAK

SEQ ID NO: 9202 - protein, 16 aa, Homo sapiens
LCTVNSVEEKILAAAK

SEQ ID NO: 9203 - protein, 10 aa, Homo sapiens
VSYKGSPAAR

SEQ ID NO: 9204 - protein, 22 aa, Homo sapiens
GMLLKTFNEPGSEYFIFLLSTR

SEQ ID NO: 9205 - protein, 22 aa, Homo sapiens
GMLLKTFNEPGSEYFIFLLSTR

SEQ ID NO: 9206 - protein, 11 aa, Homo sapiens
KELPEYYELIR

SEQ ID NO: 9207 - protein, 22 aa, Homo sapiens
GMLLKTFNEPGSEYFIFLLSTR

SEQ ID NO: 9208 - protein, 10 aa, Homo sapiens
VSYKGSPAAR

SEQ ID NO: 9209 - protein, 10 aa, Homo sapiens
VSYKGSPAAR

SEQ ID NO: 9210 - protein, 10 aa, Homo sapiens
VSYKGSPAAR

SEQ ID NO: 9211 - protein, 10 aa, Homo sapiens
VSYKGSPAAR

SEQ ID NO: 9212 - protein, 10 aa, Homo sapiens
VSYKGSPAAR

SEQ ID NO: 9213 - protein, 7 aa, Homo sapiens
KEKAQDR

SEQ ID NO: 9214 - protein, 5 aa, Homo sapiens
LKGGR

SEQ ID NO: 9215 - protein, 5 aa, Homo sapiens
LKGGR

SEQ ID NO: 9216 - protein, 7 aa, Homo sapiens
VKIKLGR

SEQ ID NO: 9217 - protein, 4 aa, Homo sapiens
VKIK

SEQ ID NO: 9218 - protein, 16 aa, Homo sapiens
GQPLPDHLQMAVQGKR

SEQ ID NO: 9219 - protein, 16 aa, Homo sapiens
GQPLPDHLQMAVQGKR

SEQ ID NO: 9220 - protein, 11 aa, Homo sapiens
AQIMAYKMLAR

SEQ ID NO: 9221 - protein, 10 aa, Homo sapiens
YNQMKGMGMR

SEQ ID NO: 9222 - protein, 20 aa, Homo sapiens
LMEEDELPSWIIKDDAEVER

SEQ ID NO: 9223 - protein, 20 aa, Homo sapiens
LMEEDELPSWIIKDDAEVER

SEQ ID NO: 9224 - protein, 20 aa, Homo sapiens
LMEEDELPSWIIKDDAEVER

SEQ ID NO: 9225 - protein, 13 aa, Homo sapiens
LTCEEEEEKMFGR

SEQ ID NO: 9226 - protein, 20 aa, Homo sapiens
LMEEDELPSWIIKDDAEVER

SEQ ID NO: 9227 - protein, 20 aa, Homo sapiens
LMEEDELPSWIIKDDAEVER

SEQ ID NO: 9228 - protein, 13 aa, Homo sapiens
LTCEEEEEKMFGR

SEQ ID NO: 9229 - protein, 20 aa, Homo sapiens
LMEEDELPSWIIKDDAEVER

SEQ ID NO: 9230 - protein, 13 aa, Homo sapiens
LTCEEEEEKMFGR

SEQ ID NO: 9231 - protein, 20 aa, Homo sapiens
LMEEDELPSWIIKDDAEVER

SEQ ID NO: 9232 - protein, 13 aa, Homo sapiens
LTCEEEEEKMFGR

SEQ ID NO: 9233 - protein, 13 aa, Homo sapiens
LTCEEEEEKMFGR

SEQ ID NO: 9234 - protein, 20 aa, Homo sapiens
LMEEDELPSWIIKDDAEVER

SEQ ID NO: 9235 - protein, 20 aa, Homo sapiens
LMEEDELPSWIIKDDAEVER

SEQ ID NO: 9236 - protein, 13 aa, Homo sapiens
LTCEEEEEKMFGR

SEQ ID NO: 9237 - protein, 13 aa, Homo sapiens
LTCEEEEEKIFGR

SEQ ID NO: 9238 - protein, 20 aa, Homo sapiens
LMEEDELPSWIIKDDAEVER

SEQ ID NO: 9239 - protein, 13 aa, Homo sapiens
LTCEEEEEKMFGR

SEQ ID NO: 9240 - protein, 13 aa, Homo sapiens
LTCEEEEEKMFGR

SEQ ID NO: 9241 - protein, 20 aa, Homo sapiens
LMEEDELPSWIIKDDAEVER

SEQ ID NO: 9242 - protein, 20 aa, Homo sapiens
LMEEDELPSWIIKDDAEVER

SEQ ID NO: 9243 - protein, 13 aa, Homo sapiens
LTCEEEEEKMFGR

SEQ ID NO: 9244 - protein, 13 aa, Homo sapiens
LTCEEEEEKMFGR

SEQ ID NO: 9245 - protein, 13 aa, Homo sapiens
LTCEEEEEKMFGR

SEQ ID NO: 9246 - protein, 20 aa, Homo sapiens
LMEEDELPSWIIKDDAEVER

SEQ ID NO: 9247 - protein, 13 aa, Homo sapiens
LTCEEEEEKMFGR

SEQ ID NO: 9248 - protein, 13 aa, Homo sapiens
LTCEEEEEKMFGR

SEQ ID NO: 9249 - protein, 13 aa, Homo sapiens
LTCEEEEEKMFGR

SEQ ID NO: 9250 - protein, 20 aa, Homo sapiens
LMEEDELPSWIIKDDAEVER

SEQ ID NO: 9251 - protein, 13 aa, Homo sapiens
LTCEEEEEKMFGR

SEQ ID NO: 9252 - protein, 20 aa, Homo sapiens
LMEEDELPSWIIKDDAEVER

SEQ ID NO: 9253 - protein, 13 aa, Homo sapiens
LTCEEEEEKMFGR

SEQ ID NO: 9254 - protein, 13 aa, Homo sapiens
LTCEEEEEKMFGR

SEQ ID NO: 9255 - protein, 13 aa, Homo sapiens
LTCEEEEEKMFGR

SEQ ID NO: 9256 - protein, 13 aa, Homo sapiens
LTCEEEEEKMFGR

SEQ ID NO: 9257 - protein, 20 aa, Homo sapiens
LMEEDELPSWIIKDDAEVER

SEQ ID NO: 9258 - protein, 13 aa, Homo sapiens
LTCEEEEEKMFGR

SEQ ID NO: 9259 - protein, 13 aa, Homo sapiens
LTCEEEEEKMFGR

SEQ ID NO: 9260 - protein, 13 aa, Homo sapiens
LTCEEEEEKMFGR

SEQ ID NO: 9261 - protein, 13 aa, Homo sapiens
LTCEEEEEKMFGR

SEQ ID NO: 9262 - protein, 20 aa, Homo sapiens
LMEEDELPSWIIKDDAEVER

SEQ ID NO: 9263 - protein, 13 aa, Homo sapiens
LTCEEEEEKMFGR

SEQ ID NO: 9264 - protein, 13 aa, Homo sapiens
LTCEEEEEKMFGR

SEQ ID NO: 9265 - protein, 20 aa, Homo sapiens
LMEEDELPSWIIKDDAEVER

SEQ ID NO: 9266 - protein, 13 aa, Homo sapiens
LTCEEEEEKMFGR

SEQ ID NO: 9267 - protein, 20 aa, Homo sapiens
LMEEDELPSWIIKDDAEVER

SEQ ID NO: 9268 - protein, 16 aa, Homo sapiens
VIQAGMFDQKSSSHER

SEQ ID NO: 9269 - protein, 16 aa, Homo sapiens
VIQAGMFDQKSSSHER

SEQ ID NO: 9270 - protein, 16 aa, Homo sapiens
KRDSDAGSSTPTTSTR

SEQ ID NO: 9271 - protein, 16 aa, Homo sapiens
VIQAGMFDQKSSSHER

SEQ ID NO: 9272 - protein, 16 aa, Homo sapiens
VIQAGMFDQKSSSHER

SEQ ID NO: 9273 - protein, 16 aa, Homo sapiens
VIQAGMFDQKSSSHER

SEQ ID NO: 9274 - protein, 16 aa, Homo sapiens
VIQAGMFDQKSSSHER

SEQ ID NO: 9275 - protein, 17 aa, Homo sapiens
VIQAGMFDQKSSSHERR

SEQ ID NO: 9276 - protein, 10 aa, Homo sapiens
VSYKGSPAAR

SEQ ID NO: 9277 - protein, 5 aa, Homo sapiens
LKGGR

SEQ ID NO: 9278 - protein, 5 aa, Homo sapiens
SVKVK

SEQ ID NO: 9279 - protein, 16 aa, Homo sapiens
KRDSDAGSSTPTTSTR

SEQ ID NO: 9280 - protein, 13 aa, Homo sapiens
LTCEEEEEKMFGR

SEQ ID NO: 9281 - protein, 14 aa, Homo sapiens
HRKEVDYSDSLTEK

SEQ ID NO: 9282 - protein, 14 aa, Homo sapiens
HRKEVDYSDSLTEK

SEQ ID NO: 9283 - protein, 6 aa, Homo sapiens
GFKYLR

SEQ ID NO: 9284 - protein, 11 aa, Homo sapiens
KELPEYYELIR

SEQ ID NO: 9285 - protein, 10 aa, Homo sapiens
LDGTTKAEDR

SEQ ID NO: 9286 - protein, 10 aa, Homo sapiens
LDGTTKAEDR

SEQ ID NO: 9287 - protein, 10 aa, Homo sapiens
LDGTTKAEDR

SEQ ID NO: 9288 - protein, 17 aa, Homo sapiens
GRPPAEKLSPNPPNLTK

SEQ ID NO: 9289 - protein, 5 aa, Homo sapiens
NHKYR

SEQ ID NO: 9290 - protein, 17 aa, Homo sapiens
KKIPDPDSDDVSEVDAR

SEQ ID NO: 9291 - protein, 16 aa, Homo sapiens
KIPDPDSDDVSEVDAR

SEQ ID NO: 9292 - protein, 16 aa, Homo sapiens
KIPDPDSDDVSEVDAR

SEQ ID NO: 9293 - protein, 22 aa, Homo sapiens
HIIENAKQDVDDEYGVSQALAR

SEQ ID NO: 9294 - protein, 22 aa, Homo sapiens
HIIENAKQDVDDEYGVSQALAR

SEQ ID NO: 9295 - protein, 22 aa, Homo sapiens
HIIENAKQDVDDEYGVSQALAR

SEQ ID NO: 9296 - protein, 16 aa, Homo sapiens
TIQTIALITYLMEHKR

SEQ ID NO: 9297 - protein, 16 aa, Homo sapiens
KRDSDAGSSTPTTSTR

SEQ ID NO: 9298 - protein, 16 aa, Homo sapiens
KRDSDAGSSTPTTSTR

SEQ ID NO: 9299 - protein, 16 aa, Homo sapiens
KRDSDAGSSTPTTSTR

SEQ ID NO: 9300 - protein, 16 aa, Homo sapiens
KRDSDAGSSTPTTSTR

SEQ ID NO: 9301 - protein, 7 aa, Homo sapiens
KEKAQDR

SEQ ID NO: 9302 - protein, 16 aa, Homo sapiens
KRDSDAGSSTPTTSTR

SEQ ID NO: 9303 - protein, 17 aa, Homo sapiens
GRPPAEKLSPNPPNLTK

SEQ ID NO: 9304 - protein, 16 aa, Homo sapiens
KRDSDAGSSTPTTSTR

SEQ ID NO: 9305 - protein, 16 aa, Homo sapiens
KRDSDAGSSTPTTSTR

SEQ ID NO: 9306 - protein, 16 aa, Homo sapiens
KRDSDAGSSTPTTSTR

SEQ ID NO: 9307 - protein, 16 aa, Homo sapiens
KRDSDAGSSTPTTSTR

SEQ ID NO: 9308 - protein, 17 aa, Homo sapiens
VIHVESGKILTGTDAPK

SEQ ID NO: 9309 - protein, 16 aa, Homo sapiens
KRDSDAGSSTPTTSTR

SEQ ID NO: 9310 - protein, 16 aa, Homo sapiens
KRDSDAGSSTPTTSTR

SEQ ID NO: 9311 - protein, 16 aa, Homo sapiens
KRDSDAGSSTPTTSTR

SEQ ID NO: 9312 - protein, 16 aa, Homo sapiens
KRDSDAGSSTPTTSTR

SEQ ID NO: 9313 - protein, 16 aa, Homo sapiens
KRDSDAGSSTPTTSTR

SEQ ID NO: 9314 - protein, 16 aa, Homo sapiens
KRDSDAGSSTPTTSTR

SEQ ID NO: 9315 - protein, 16 aa, Homo sapiens
KRDSDAGSSTPTTSTR

SEQ ID NO: 9316 - protein, 16 aa, Homo sapiens
KRDSDAGSSTPTTSTR

SEQ ID NO: 9317 - protein, 16 aa, Homo sapiens
KRDSDAGSSTPTTSTR

SEQ ID NO: 9318 - protein, 16 aa, Homo sapiens
KRDSDAGSSTPTTSTR

SEQ ID NO: 9319 - protein, 13 aa, Homo sapiens
LTCEEEEEKMFGR

SEQ ID NO: 9320 - protein, 13 aa, Homo sapiens
LTCEEEEEKMFGR

SEQ ID NO: 9321 - protein, 13 aa, Homo sapiens
LTCEEEEEKMFGR

SEQ ID NO: 9322 - protein, 13 aa, Homo sapiens
LTCEEEEEKMFGR

SEQ ID NO: 9323 - protein, 13 aa, Homo sapiens
LTCEEEEEKMFGR

SEQ ID NO: 9324 - protein, 14 aa, Homo sapiens
HRKEVDYSDSLTEK

SEQ ID NO: 9325 - protein, 16 aa, Homo sapiens
KRDSDAGSSTPTTSTR

SEQ ID NO: 9326 - protein, 16 aa, Homo sapiens
KRDSDAGSSTPTTSTR

SEQ ID NO: 9327 - protein, 16 aa, Homo sapiens
KRDSDAGSSTPTTSTR

SEQ ID NO: 9328 - protein, 16 aa, Homo sapiens
KRDSDAGSSTPTTSTR

SEQ ID NO: 9329 - protein, 13 aa, Homo sapiens
LTCEEEEEKMFGR

SEQ ID NO: 9330 - protein, 4 aa, Homo sapiens
KDKR

SEQ ID NO: 9331 - protein, 16 aa, Homo sapiens
KIPDPDSDDVSEVDAR

SEQ ID NO: 9332 - protein, 11 aa, Homo sapiens
KELPEYYELIR

SEQ ID NO: 9333 - protein, 11 aa, Homo sapiens
KELPEYYELIR

SEQ ID NO: 9334 - protein, 11 aa, Homo sapiens
KELPEYYELIR

SEQ ID NO: 9335 - protein, 17 aa, Homo sapiens
VIHVESGKILTGTDAPK

SEQ ID NO: 9336 - protein, 11 aa, Homo sapiens
KELPEYYELIR

SEQ ID NO: 9337 - protein, 11 aa, Homo sapiens
KELPEYYELIR

SEQ ID NO: 9338 - protein, 11 aa, Homo sapiens
KELPEYYELIR

SEQ ID NO: 9339 - protein, 5 aa, Homo sapiens
LKGGR

SEQ ID NO: 9340 - protein, 7 aa, Homo sapiens
KEKAQDR

SEQ ID NO: 9341 - protein, 8 aa, Homo sapiens
QQKIEQER

SEQ ID NO: 9342 - protein, 8 aa, Homo sapiens
QQKIEQER

SEQ ID NO: 9343 - protein, 9 aa, Homo sapiens
QQKIEQERK

SEQ ID NO: 9344 - protein, 7 aa, Homo sapiens
ITEKLEK

SEQ ID NO: 9345 - protein, 11 aa, Homo sapiens
WKYMIVDEGHR

SEQ ID NO: 9346 - protein, 22 aa, Homo sapiens
HIIENAKQDVDDEYGVSQALAR

SEQ ID NO: 9347 - protein, 22 aa, Homo sapiens
HIIENAKQDVDDEYGVSQALAR

SEQ ID NO: 9348 - protein, 17 aa, Homo sapiens
KKIPDPDSDDVSEVDAR

SEQ ID NO: 9349 - protein, 17 aa, Homo sapiens
KKIPDPDSDDVSEVDAR

SEQ ID NO: 9350 - protein, 17 aa, Homo sapiens
KKIPDPDSDDVSEVDAR

SEQ ID NO: 9351 - protein, 9 aa, Homo sapiens
SRDKDDESK

SEQ ID NO: 9352 - protein, 9 aa, Homo sapiens
SRDKDDESK

SEQ ID NO: 9353 - protein, 7 aa, Homo sapiens
IRNHKYR

SEQ ID NO: 9354 - protein, 17 aa, Homo sapiens
KKIPDPDSDDVSEVDAR

SEQ ID NO: 9355 - protein, 16 aa, Homo sapiens
KIPDPDSDDVSEVDAR

SEQ ID NO: 9356 - protein, 16 aa, Homo sapiens
KIPDPDSDDVSEVDAR

SEQ ID NO: 9357 - protein, 17 aa, Homo sapiens
KKIPDPDSDDVSEVDAR

SEQ ID NO: 9358 - protein, 17 aa, Homo sapiens
KKIPDPDSDDVSEVDAR

SEQ ID NO: 9359 - protein, 17 aa, Homo sapiens
KKIPDPDSDDVSEVDAR

SEQ ID NO: 9360 - protein, 17 aa, Homo sapiens
KKIPDPDSDDVSEVDAR

SEQ ID NO: 9361 - protein, 17 aa, Homo sapiens
KKIPDPDSDDVSEVDAR

SEQ ID NO: 9362 - protein, 13 aa, Homo sapiens
LTCEEEEEKMFGR

SEQ ID NO: 9363 - protein, 13 aa, Homo sapiens
LTCEEEEEKMFGR

SEQ ID NO: 9364 - protein, 16 aa, Homo sapiens
KRDSDAGSSTPTTSTR

SEQ ID NO: 9365 - protein, 16 aa, Homo sapiens
KRDSDAGSSTPTTSTR

SEQ ID NO: 9366 - protein, 14 aa, Homo sapiens
HRKEVDYSDSLTEK

SEQ ID NO: 9367 - protein, 14 aa, Homo sapiens
HRKEVDYSDSLTEK

SEQ ID NO: 9368 - protein, 14 aa, Homo sapiens
HRKEVDYSDSLTEK

SEQ ID NO: 9369 - protein, 13 aa, Homo sapiens
LTCEEEEEKMFGR

SEQ ID NO: 9370 - protein, 13 aa, Homo sapiens
LTCEEEEEKMFGR

SEQ ID NO: 9371 - protein, 10 aa, Homo sapiens
LDGTTKAEDR

SEQ ID NO: 9372 - protein, 13 aa, Homo sapiens
LTCEEEEEKMFGR

SEQ ID NO: 9373 - protein, 16 aa, Homo sapiens
KRDSDAGSSTPTTSTR

SEQ ID NO: 9374 - protein, 16 aa, Homo sapiens
KRDSDAGSSTPTTSTR

SEQ ID NO: 9375 - protein, 16 aa, Homo sapiens
KRDSDAGSSTPTTSTR

SEQ ID NO: 9376 - protein, 16 aa, Homo sapiens
KRDSDAGSSTPTTSTR

SEQ ID NO: 9377 - protein, 16 aa, Homo sapiens
KRDSDAGSSTPTTSTR

SEQ ID NO: 9378 - protein, 10 aa, Homo sapiens
LDGTTKAEDR

SEQ ID NO: 9379 - protein, 10 aa, Homo sapiens
LDGTTKAEDR

SEQ ID NO: 9380 - protein, 10 aa, Homo sapiens
LDGTTKAEDR

SEQ ID NO: 9381 - protein, 10 aa, Homo sapiens
LDGTTKAEDR

SEQ ID NO: 9382 - protein, 14 aa, Homo sapiens
HRKEVDYSDSLTEK

SEQ ID NO: 9383 - protein, 10 aa, Homo sapiens
LDGTTKAEDR

SEQ ID NO: 9384 - protein, 14 aa, Homo sapiens
HRKEVDYSDSLTEK

SEQ ID NO: 9385 - protein, 14 aa, Homo sapiens
HRKEVDYSDSLTEK

SEQ ID NO: 9386 - protein, 11 aa, Homo sapiens
KELPEYYELIR

SEQ ID NO: 9387 - protein, 10 aa, Homo sapiens
LDGTTKAEDR

SEQ ID NO: 9388 - protein, 7 aa, Homo sapiens
KEKAQDR

SEQ ID NO: 9389 - protein, 13 aa, Homo sapiens
YLRLDGTTKAEDR

SEQ ID NO: 9390 - protein, 6 aa, Homo sapiens
QKKSSR

SEQ ID NO: 9391 - protein, 10 aa, Homo sapiens
LDGTTKAEDR

SEQ ID NO: 9392 - protein, 10 aa, Homo sapiens
LDGTTKAEDR

SEQ ID NO: 9393 - protein, 13 aa, Homo sapiens
YLRLDGTTKAEDR

SEQ ID NO: 9394 - protein, 10 aa, Homo sapiens
LDGTTKAEDR

SEQ ID NO: 9395 - protein, 13 aa, Homo sapiens
YLRLDGTTKAEDR

SEQ ID NO: 9396 - protein, 10 aa, Homo sapiens
LDGTTKAEDR

SEQ ID NO: 9397 - protein, 10 aa, Homo sapiens
LDGTTKAEDR

SEQ ID NO: 9398 - protein, 10 aa, Homo sapiens
LDGTTKAEDR

SEQ ID NO: 9399 - protein, 10 aa, Homo sapiens
LDGTTKAEDR

SEQ ID NO: 9400 - protein, 10 aa, Homo sapiens
LDGTTKAEDR

SEQ ID NO: 9401 - protein, 10 aa, Homo sapiens
LDGTTKAEDR

SEQ ID NO: 9402 - protein, 9 aa, Homo sapiens
IVDAVIKYK

SEQ ID NO: 9403 - protein, 5 aa, Homo sapiens
LKGGR

SEQ ID NO: 9404 - protein, 5 aa, Homo sapiens
LKGGR

SEQ ID NO: 9405 - protein, 5 aa, Homo sapiens
LKGGR

SEQ ID NO: 9406 - protein, 5 aa, Homo sapiens
LKGGR

SEQ ID NO: 9407 - protein, 17 aa, Homo sapiens
GRPPAEKLSPNPPNLTK

SEQ ID NO: 9408 - protein, 17 aa, Homo sapiens
GRPPAEKLSPNPPNLTK

SEQ ID NO: 9409 - protein, 17 aa, Homo sapiens
GRPPAEKLSPNPPNLTK

SEQ ID NO: 9410 - protein, 17 aa, Homo sapiens
GRPPAEKLSPNPPNLTK

SEQ ID NO: 9411 - protein, 17 aa, Homo sapiens
GRPPAEKLSPNPPNLTK

SEQ ID NO: 9412 - protein, 17 aa, Homo sapiens
GRPPAEKLSPNPPNLTK

SEQ ID NO: 9413 - protein, 17 aa, Homo sapiens
GRPPAEKLSPNPPNLTK

SEQ ID NO: 9414 - protein, 17 aa, Homo sapiens
GRPPAEKLSPNPPNLTK

SEQ ID NO: 9415 - protein, 17 aa, Homo sapiens
GRPPAEKLSPNPPNLTK

SEQ ID NO: 9416 - protein, 17 aa, Homo sapiens
GRPPAEKLSPNPPNLTK

SEQ ID NO: 9417 - protein, 17 aa, Homo sapiens
GRPPAEKLSPNPPNLTK

SEQ ID NO: 9418 - protein, 17 aa, Homo sapiens
GRPPAEKLSPNPPNLTK

SEQ ID NO: 9419 - protein, 17 aa, Homo sapiens
GRPPAEKLSPNPPNLTK

SEQ ID NO: 9420 - protein, 17 aa, Homo sapiens
GRPPAEKLSPNPPNLTK

SEQ ID NO: 9421 - protein, 17 aa, Homo sapiens
GRPPAEKLSPNPPNLTK

SEQ ID NO: 9422 - protein, 17 aa, Homo sapiens
GRPPAEKLSPNPPNLTK

SEQ ID NO: 9423 - protein, 17 aa, Homo sapiens
GRPPAEKLSPNPPNLTK

SEQ ID NO: 9424 - protein, 17 aa, Homo sapiens
GRPPAEKLSPNPPNLTK

SEQ ID NO: 9425 - protein, 17 aa, Homo sapiens
GRPPAEKLSPNPPNLTK

SEQ ID NO: 9426 - protein, 17 aa, Homo sapiens
GRPPAEKLSPNPPNLTK

SEQ ID NO: 9427 - protein, 5 aa, Homo sapiens
LKGGR

SEQ ID NO: 9428 - protein, 17 aa, Homo sapiens
GRPPAEKLSPNPPNLTK

SEQ ID NO: 9429 - protein, 17 aa, Homo sapiens
GRPPAEKLSPNPPNLTK

SEQ ID NO: 9430 - protein, 17 aa, Homo sapiens
GRPPAEKLSPNPPNLTK

SEQ ID NO: 9431 - protein, 17 aa, Homo sapiens
GRPPAEKLSPNPPNLTK

SEQ ID NO: 9432 - protein, 14 aa, Homo sapiens
HRKEVDYSDSLTEK

SEQ ID NO: 9433 - protein, 14 aa, Homo sapiens
HRKEVDYSDSLTEK

SEQ ID NO: 9434 - protein, 14 aa, Homo sapiens
HRKEVDYSDSLTEK

SEQ ID NO: 9435 - protein, 11 aa, Homo sapiens
KELPEYYELIR

SEQ ID NO: 9436 - protein, 11 aa, Homo sapiens
KELPEYYELIR

SEQ ID NO: 9437 - protein, 14 aa, Homo sapiens
HRKEVDYSDSLTEK

SEQ ID NO: 9438 - protein, 12 aa, Homo sapiens
KEVDYSDSLTEK

SEQ ID NO: 9439 - protein, 14 aa, Homo sapiens
HRKEVDYSDSLTEK

SEQ ID NO: 9440 - protein, 14 aa, Homo sapiens
HRKEVDYSDSLTEK

SEQ ID NO: 9441 - protein, 14 aa, Homo sapiens
HRKEVDYSDSLTEK

SEQ ID NO: 9442 - protein, 16 aa, Homo sapiens
KRDSDAGSSTPTTSTR

SEQ ID NO: 9443 - protein, 14 aa, Homo sapiens
HRKEVDYSDSLTEK

SEQ ID NO: 9444 - protein, 14 aa, Homo sapiens
HRKEVDYSDSLTEK

SEQ ID NO: 9445 - protein, 5 aa, Homo sapiens
NHKYR

SEQ ID NO: 9446 - protein, 14 aa, Homo sapiens
HRKEVDYSDSLTEK

SEQ ID NO: 9447 - protein, 17 aa, Homo sapiens
GRPPAEKLSPNPPNLTK

SEQ ID NO: 9448 - protein, 5 aa, Homo sapiens
SVKVK

SEQ ID NO: 9449 - protein, 10 aa, Homo sapiens
VSYKGSPAAR

SEQ ID NO: 9450 - protein, 26 aa, Homo sapiens
AKPVVSDDDSEEEQEEDRSGSGSEED

SEQ ID NO: 9451 - protein, 26 aa, Homo sapiens
AKPVVSDDDSEEEQEEDRSGSGSEED

SEQ ID NO: 9452 - protein, 17 aa, Homo sapiens
VIHVESGKILTGTDAPK

SEQ ID NO: 9453 - protein, 5 aa, Homo sapiens
LKGGR

SEQ ID NO: 9454 - protein, 5 aa, Homo sapiens
LKGGR

SEQ ID NO: 9455 - protein, 7 aa, Homo sapiens
KEKAQDR

SEQ ID NO: 9456 - protein, 5 aa, Homo sapiens
IKLGR

SEQ ID NO: 9457 - protein, 5 aa, Homo sapiens
IKLGR

SEQ ID NO: 9458 - protein, 7 aa, Homo sapiens
KEKAQDR

SEQ ID NO: 9459 - protein, 7 aa, Homo sapiens
VKIKLGR

SEQ ID NO: 9460 - protein, 5 aa, Homo sapiens
IKLGR

SEQ ID NO: 9461 - protein, 5 aa, Homo sapiens
IKLGR

SEQ ID NO: 9462 - protein, 5 aa, Homo sapiens
IKLGR

SEQ ID NO: 9463 - protein, 5 aa, Homo sapiens
IKLGR

SEQ ID NO: 9464 - protein, 7 aa, Homo sapiens
KEKAQDR

SEQ ID NO: 9465 - protein, 10 aa, Homo sapiens
KIVDAVIKYK

SEQ ID NO: 9466 - protein, 9 aa, Homo sapiens
IVDAVIKYK

SEQ ID NO: 9467 - protein, 9 aa, Homo sapiens
IVDAVIKYK

SEQ ID NO: 9468 - protein, 9 aa, Homo sapiens
IVDAVIKYK

SEQ ID NO: 9469 - protein, 22 aa, Homo sapiens
HIIENAKQDVDDEYGVSQALAR

SEQ ID NO: 9470 - protein, 22 aa, Homo sapiens
HIIENAKQDVDDEYGVSQALAR

SEQ ID NO: 9471 - protein, 22 aa, Homo sapiens
HIIENAKQDVDDEYGVSQALAR

SEQ ID NO: 9472 - protein, 22 aa, Homo sapiens
HIIENAKQDVDDEYGVSQALAR

SEQ ID NO: 9473 - protein, 22 aa, Homo sapiens
HIIENAKQDVDDEYGVSQALAR

SEQ ID NO: 9474 - protein, 22 aa, Homo sapiens
HIIENAKQDVDDEYGVSQALAR

SEQ ID NO: 9475 - protein, 11 aa, Homo sapiens
WKYMIVDEGHR

SEQ ID NO: 9476 - protein, 22 aa, Homo sapiens
HIIENAKQDVDDEYGVSQALAR

SEQ ID NO: 9477 - protein, 11 aa, Homo sapiens
WKYMIVDEGHR

SEQ ID NO: 9478 - protein, 22 aa, Homo sapiens
HIIENAKQDVDDEYGVSQALAR

SEQ ID NO: 9479 - protein, 22 aa, Homo sapiens
HIIENAKQDVDDEYGVSQALAR

SEQ ID NO: 9480 - protein, 5 aa, Homo sapiens
IEKER

SEQ ID NO: 9481 - protein, 5 aa, Homo sapiens
IEKER

SEQ ID NO: 9482 - protein, 7 aa, Homo sapiens
KLIDQKK

SEQ ID NO: 9483 - protein, 8 aa, Homo sapiens
KENERIEK

SEQ ID NO: 9484 - protein, 16 aa, Homo sapiens
KRDSDAGSSTPTTSTR

SEQ ID NO: 9485 - protein, 10 aa, Homo sapiens
VSYKGSPAAR

SEQ ID NO: 9486 - protein, 10 aa, Homo sapiens
VSYKGSPAAR

SEQ ID NO: 9487 - protein, 11 aa, Homo sapiens
KELPEYYELIR

SEQ ID NO: 9488 - protein, 11 aa, Homo sapiens
KELPEYYELIR

SEQ ID NO: 9489 - protein, 16 aa, Homo sapiens
KRDSDAGSSTPTTSTR

SEQ ID NO: 9490 - protein, 8 aa, Homo sapiens
EEARNPKR

SEQ ID NO: 9491 - protein, 8 aa, Homo sapiens
EEARNPKR

SEQ ID NO: 9492 - protein, 6 aa, Homo sapiens
QKKSSR

SEQ ID NO: 9493 - protein, 6 aa, Homo sapiens
QKKSSR

SEQ ID NO: 9494 - protein, 6 aa, Homo sapiens
QKKSSR

SEQ ID NO: 9495 - protein, 6 aa, Homo sapiens
QKKSSR

SEQ ID NO: 9496 - protein, 9 aa, Homo sapiens
VMATIEKVR

SEQ ID NO: 9497 - protein, 15 aa, Homo sapiens
IFKWVPVVDPQEEER

SEQ ID NO: 9498 - protein, 7 aa, Homo sapiens
AKDDIKK

SEQ ID NO: 9499 - protein, 9 aa, Homo sapiens
VMATIEKVR

SEQ ID NO: 9500 - protein, 7 aa, Homo sapiens
AKDDIKK

SEQ ID NO: 9501 - protein, 7 aa, Homo sapiens
AKDDIKK

SEQ ID NO: 9502 - protein, 15 aa, Homo sapiens
IFKWVPVVDPQEEER

SEQ ID NO: 9503 - protein, 15 aa, Homo sapiens
IFKWVPVVDPQEEER

SEQ ID NO: 9504 - protein, 15 aa, Homo sapiens
IFKWVPVVDPQEEER

SEQ ID NO: 9505 - protein, 15 aa, Homo sapiens
IFKWVPVVDPQEEER

SEQ ID NO: 9506 - protein, 11 aa, Homo sapiens
KWVTVGDTSLR

SEQ ID NO: 9507 - protein, 11 aa, Homo sapiens
KWVTVGDTSLR

SEQ ID NO: 9508 - protein, 7 aa, Homo sapiens
AKDDIKR

SEQ ID NO: 9509 - protein, 11 aa, Homo sapiens
IYKWVPVTEPK

SEQ ID NO: 9510 - protein, 7 aa, Homo sapiens
AKDDIKR

SEQ ID NO: 9511 - protein, 11 aa, Homo sapiens
IYKWVPVTEPK

SEQ ID NO: 9512 - protein, 11 aa, Homo sapiens
IYKWVPVTEPK

SEQ ID NO: 9513 - protein, 11 aa, Homo sapiens
IYKWVPVTEPK

SEQ ID NO: 9514 - protein, 7 aa, Homo sapiens
AKDDIKR

SEQ ID NO: 9515 - protein, 7 aa, Homo sapiens
AKDDIKR

SEQ ID NO: 9516 - protein, 7 aa, Homo sapiens
AKDDIKR

SEQ ID NO: 9517 - protein, 9 aa, Homo sapiens
VMAAIEKVR

SEQ ID NO: 9518 - protein, 9 aa, Homo sapiens
VMAAIEKVR

SEQ ID NO: 9519 - protein, 7 aa, Homo sapiens
AKDDIKR

SEQ ID NO: 9520 - protein, 7 aa, Homo sapiens
AKDDIKR

SEQ ID NO: 9521 - protein, 9 aa, Homo sapiens
VMAAIEKVR

SEQ ID NO: 9522 - protein, 9 aa, Homo sapiens
VMAAIEKVR

SEQ ID NO: 9523 - protein, 9 aa, Homo sapiens
VMAAIEKVR

SEQ ID NO: 9524 - protein, 9 aa, Homo sapiens
VMAAIEKVR

SEQ ID NO: 9525 - protein, 9 aa, Homo sapiens
VMAAIEKVR

SEQ ID NO: 9526 - protein, 7 aa, Homo sapiens
AKDDIKR

SEQ ID NO: 9527 - protein, 9 aa, Homo sapiens
VMAAIEKVR

SEQ ID NO: 9528 - protein, 11 aa, Homo sapiens
KWVTVGDTSLR

SEQ ID NO: 9529 - protein, 7 aa, Homo sapiens
AKDDIKR

SEQ ID NO: 9530 - protein, 11 aa, Homo sapiens
IYKWVPVTEPK

SEQ ID NO: 9531 - protein, 11 aa, Homo sapiens
IYKWVPVTEPK

SEQ ID NO: 9532 - protein, 11 aa, Homo sapiens
IYKWVPVTEPK

SEQ ID NO: 9533 - protein, 11 aa, Homo sapiens
IYKWVPVTEPK

SEQ ID NO: 9534 - protein, 11 aa, Homo sapiens
IYKWVPVTEPK

SEQ ID NO: 9535 - protein, 11 aa, Homo sapiens
KWVTVGDTSLR

SEQ ID NO: 9536 - protein, 11 aa, Homo sapiens
KWVTVGDTSLR

SEQ ID NO: 9537 - protein, 14 aa, Homo sapiens
WVPVTEPKVDDKNK

SEQ ID NO: 9538 - protein, 14 aa, Homo sapiens
WVPVTEPKVDDKNK

SEQ ID NO: 9539 - protein, 9 aa, Homo sapiens
VMAAIEKVR

SEQ ID NO: 9540 - protein, 9 aa, Homo sapiens
VMAAIEKVR

SEQ ID NO: 9541 - protein, 8 aa, Homo sapiens
VDDKNKNK

SEQ ID NO: 9542 - protein, 10 aa, Homo sapiens
VMAAIEKVRK

SEQ ID NO: 9543 - protein, 9 aa, Homo sapiens
VMAAIEKVR

SEQ ID NO: 9544 - protein, 11 aa, Homo sapiens
KWVTVGDTSLR

SEQ ID NO: 9545 - protein, 11 aa, Homo sapiens
KWVTVGDTSLR

SEQ ID NO: 9546 - protein, 9 aa, Homo sapiens
VMAAIEKVR

SEQ ID NO: 9547 - protein, 9 aa, Homo sapiens
VMAAIEKVR

SEQ ID NO: 9548 - protein, 9 aa, Homo sapiens
VMAAIEKVR

SEQ ID NO: 9549 - protein, 11 aa, Homo sapiens
IYKWVPVTEPK

SEQ ID NO: 9550 - protein, 9 aa, Homo sapiens
VMAAIEKVR

SEQ ID NO: 9551 - protein, 9 aa, Homo sapiens
VMAAIEKVR

SEQ ID NO: 9552 - protein, 11 aa, Homo sapiens
IYKWVPVTEPK

SEQ ID NO: 9553 - protein, 9 aa, Homo sapiens
VMAAIEKVR

SEQ ID NO: 9554 - protein, 5 aa, Homo sapiens
KWEKK

SEQ ID NO: 9555 - protein, 9 aa, Homo sapiens
VMAAIEKVR

SEQ ID NO: 9556 - protein, 4 aa, Homo sapiens
KWEK

SEQ ID NO: 9557 - protein, 9 aa, Homo sapiens
VMAAIEKVR

SEQ ID NO: 9558 - protein, 9 aa, Homo sapiens
VMAAIEKVR

SEQ ID NO: 9559 - protein, 9 aa, Homo sapiens
VMAAIEKVR

SEQ ID NO: 9560 - protein, 4 aa, Homo sapiens
KWEK

SEQ ID NO: 9561 - protein, 9 aa, Homo sapiens
VMAAIEKVR

SEQ ID NO: 9562 - protein, 9 aa, Homo sapiens
IKIIAPPER

SEQ ID NO: 9563 - protein, 40 aa, Homo sapiens
SIIATIDDVLSARPGALPEDANPGPQTESSKFPFGIQQAK

SEQ ID NO: 9564 - protein, 10 aa, Homo sapiens
FDKLPIKIVK

SEQ ID NO: 9565 - protein, 10 aa, Homo sapiens
FDKLPIKIVK

SEQ ID NO: 9566 - protein, 9 aa, Homo sapiens
KNNLFVVDR

SEQ ID NO: 9567 - protein, 10 aa, Homo sapiens
FDKLPIKIVK

SEQ ID NO: 9568 - protein, 10 aa, Homo sapiens
FDKLPIKIVK

SEQ ID NO: 9569 - protein, 7 aa, Homo sapiens
LPIKIVK

SEQ ID NO: 9570 - protein, 10 aa, Homo sapiens
FDKLPIKIVK

SEQ ID NO: 9571 - protein, 10 aa, Homo sapiens
FDKLPIKIVK

SEQ ID NO: 9572 - protein, 13 aa, Homo sapiens
ITKVYELGNEPER

SEQ ID NO: 9573 - protein, 14 aa, Homo sapiens
KLWVDRYLTFMEER

SEQ ID NO: 9574 - protein, 13 aa, Homo sapiens
ITKVYELGNEPER

SEQ ID NO: 9575 - protein, 13 aa, Homo sapiens
ITKVYELGNEPER

SEQ ID NO: 9576 - protein, 13 aa, Homo sapiens
ITKVYELGNEPER

SEQ ID NO: 9577 - protein, 14 aa, Homo sapiens
ITKVYELGNEPERK

SEQ ID NO: 9578 - protein, 13 aa, Homo sapiens
ITKVYELGNEPER

SEQ ID NO: 9579 - protein, 13 aa, Homo sapiens
ITKVYELGNEPER

SEQ ID NO: 9580 - protein, 14 aa, Homo sapiens
MPYEPNKDPFGGMR

SEQ ID NO: 9581 - protein, 14 aa, Homo sapiens
MPYEPNKDPFGGMR

SEQ ID NO: 9582 - protein, 21 aa, Homo sapiens
SSTISVHDPFSDVSDSSFPKR

SEQ ID NO: 9583 - protein, 21 aa, Homo sapiens
SSTISVHDPFSDVSDSSFPKR

SEQ ID NO: 9584 - protein, 11 aa, Homo sapiens
QASKFDKLPIK

SEQ ID NO: 9585 - protein, 12 aa, Homo sapiens
FPFGIQQAKSHR

SEQ ID NO: 9586 - protein, 12 aa, Homo sapiens
FPFGIQQAKSHR

SEQ ID NO: 9587 - protein, 12 aa, Homo sapiens
FPFGIQQAKSHR

SEQ ID NO: 9588 - protein, 30 aa, Homo sapiens
PGALPEDANPGPQTESSKFPFGIQQAKSHR

SEQ ID NO: 9589 - protein, 12 aa, Homo sapiens
FPFGIQQAKSHR

SEQ ID NO: 9590 - protein, 12 aa, Homo sapiens
FPFGIQQAKSHR

SEQ ID NO: 9591 - protein, 30 aa, Homo sapiens; identical to SEQ ID NO: 9588

SEQ ID NO: 9592 - protein, 37 aa, Homo sapiens; identical to SEQ ID NO: 2344

SEQ ID NO: 9593 - protein, 37 aa, Homo sapiens; identical to SEQ ID NO: 2344

SEQ ID NO: 9594 - protein, 37 aa, Homo sapiens; identical to SEQ ID NO: 2344

SEQ ID NO: 9595 - protein, 36 aa, Homo sapiens; identical to SEQ ID NO: 2345

SEQ ID NO: 9596 - protein, 36 aa, Homo sapiens; identical to SEQ ID NO: 2345

SEQ ID NO: 9597 - protein, 37 aa, Homo sapiens; identical to SEQ ID NO: 2344

SEQ ID NO: 9598 - protein, 6 aa, Homo sapiens
KNPVCR

SEQ ID NO: 9599 - protein, 37 aa, Homo sapiens; identical to SEQ ID NO: 2344

SEQ ID NO: 9600 - protein, 37 aa, Homo sapiens; identical to SEQ ID NO: 2344

SEQ ID NO: 9601 - protein, 37 aa, Homo sapiens; identical to SEQ ID NO: 2344

SEQ ID NO: 9602 - protein, 37 aa, Homo sapiens; identical to SEQ ID NO: 2344

SEQ ID NO: 9603 - protein, 37 aa, Homo sapiens; identical to SEQ ID NO: 2344

SEQ ID NO: 9604 - protein, 12 aa, Homo sapiens
HMDGMYGPPAKR

SEQ ID NO: 9605 - protein, 12 aa, Homo sapiens
HMDGMYGPPAKR

SEQ ID NO: 9606 - protein, 12 aa, Homo sapiens
HMDGMYGPPAKR

SEQ ID NO: 9607 - protein, 12 aa, Homo sapiens
HMDGMYGPPAKR

SEQ ID NO: 9608 - protein, 12 aa, Homo sapiens
HMDGMYGPPAKR

SEQ ID NO: 9609 - protein, 37 aa, Homo sapiens; identical to SEQ ID NO: 2344

SEQ ID NO: 9610 - protein, 12 aa, Homo sapiens
HMDGMYGPPAKR

SEQ ID NO: 9611 - protein, 12 aa, Homo sapiens
HMDGMYGPPAKR

SEQ ID NO: 9612 - protein, 12 aa, Homo sapiens
HMDGMYGPPAKR

SEQ ID NO: 9613 - protein, 36 aa, Homo sapiens; identical to SEQ ID NO: 2345

SEQ ID NO: 9614 - protein, 12 aa, Homo sapiens
HMDGMYGPPAKR

SEQ ID NO: 9615 - protein, 37 aa, Homo sapiens; identical to SEQ ID NO: 2344

SEQ ID NO: 9616 - protein, 12 aa, Homo sapiens
HMDGMYGPPAKR

SEQ ID NO: 9617 - protein, 36 aa, Homo sapiens; identical to SEQ ID NO: 2345

SEQ ID NO: 9618 - protein, 12 aa, Homo sapiens
HMDGMYGPPAKR

SEQ ID NO: 9619 - protein, 12 aa, Homo sapiens
HMDGMYGPPAKR

SEQ ID NO: 9620 - protein, 12 aa, Homo sapiens
HMDGMYGPPAKR

SEQ ID NO: 9621 - protein, 6 aa, Homo sapiens
KNPVCR

SEQ ID NO: 9622 - protein, 6 aa, Homo sapiens
KNPVCR

SEQ ID NO: 9623 - protein, 6 aa, Homo sapiens
KNPVCR

SEQ ID NO: 9624 - protein, 6 aa, Homo sapiens
KNPVCR

SEQ ID NO: 9625 - protein, 6 aa, Homo sapiens
KNPVCR

SEQ ID NO: 9626 - protein, 19 aa, Homo sapiens
GEEPPPEVFSTGDTKKQPK

SEQ ID NO: 9627 - protein, 14 aa, Homo sapiens
RAPQTYEKEEDEDK

SEQ ID NO: 9628 - protein, 18 aa, Homo sapiens
GVACSKDEWWWDCLEVLR

SEQ ID NO: 9629 - protein, 18 aa, Homo sapiens
GVACSKDEWWWDCLEVLR

SEQ ID NO: 9630 - protein, 14 aa, Homo sapiens
RAPQTYEKEEDEDK

SEQ ID NO: 9631 - protein, 14 aa, Homo sapiens
RAPQTYEKEEDEDK

SEQ ID NO: 9632 - protein, 13 aa, Homo sapiens
APQTYEKEEDEDK

SEQ ID NO: 9633 - protein, 14 aa, Homo sapiens
RAPQTYEKEEDEDK

SEQ ID NO: 9634 - protein, 13 aa, Homo sapiens
APQTYEKEEDEDK

SEQ ID NO: 9635 - protein, 14 aa, Homo sapiens
RAPQTYEKEEDEDK

SEQ ID NO: 9636 - protein, 18 aa, Homo sapiens
GVACSKDEWWWDCLEVLR

SEQ ID NO: 9637 - protein, 14 aa, Homo sapiens
RAPQTYEKEEDEDK

SEQ ID NO: 9638 - protein, 14 aa, Homo sapiens
RAPQTYEKEEDEDK

SEQ ID NO: 9639 - protein, 18 aa, Homo sapiens
GVACSKDEWWWDCLEVLR

SEQ ID NO: 9640 - protein, 18 aa, Homo sapiens
GVACSKDEWWWDCLEVLR

SEQ ID NO: 9641 - protein, 13 aa, Homo sapiens
APQTYEKEEDEDK

SEQ ID NO: 9642 - protein, 13 aa, Homo sapiens
SHRNIKLLEDEPR

SEQ ID NO: 9643 - protein, 10 aa, Homo sapiens
QEKFYATLVR

SEQ ID NO: 9644 - protein, 10 aa, Homo sapiens
QEKFYATLVR

SEQ ID NO: 9645 - protein, 10 aa, Homo sapiens
QEKFYATLVR

SEQ ID NO: 9646 - protein, 10 aa, Homo sapiens
QEKFYATLVR

SEQ ID NO: 9647 - protein, 14 aa, Homo sapiens
MPYEPNKDPFGGMR

SEQ ID NO: 9648 - protein, 20 aa, Homo sapiens
KAQEAAAAVMQAAANSAQSR

SEQ ID NO: 9649 - protein, 28 aa, Homo sapiens
CLIDIFGILMEYEVGDPSQKALDHNAAR

SEQ ID NO: 9650 - protein, 20 aa, Homo sapiens
SRDETPLCTIAHWQDSLAKR

SEQ ID NO: 9651 - protein, 19 aa, Homo sapiens
EITFPPGSVEASQPVLKQR

SEQ ID NO: 9652 - protein, 19 aa, Homo sapiens
EITFPPGSVEASQPVLKQR

SEQ ID NO: 9653 - protein, 20 aa, Homo sapiens
SRDETPLCTIAHWQDSLAKR

SEQ ID NO: 9654 - protein, 20 aa, Homo sapiens
SRDETPLCTIAHWQDSLAKR

SEQ ID NO: 9655 - protein, 20 aa, Homo sapiens
SRDETPLCTIAHWQDSLAKR

SEQ ID NO: 9656 - protein, 20 aa, Homo sapiens
SRDETPLCTIAHWQDSLAKR

SEQ ID NO: 9657 - protein, 14 aa, Homo sapiens
MPYEPNKDPFGGMR

SEQ ID NO: 9658 - protein, 37 aa, Homo sapiens; identical to SEQ ID NO: 2344

SEQ ID NO: 9659 - protein, 37 aa, Homo sapiens; identical to SEQ ID NO: 2344

SEQ ID NO: 9660 - protein, 14 aa, Homo sapiens
MPYEPNKDPFGGMR

SEQ ID NO: 9661 - protein, 14 aa, Homo sapiens
MPYEPNKDPFGGMR

SEQ ID NO: 9662 - protein, 12 aa, Homo sapiens
HMDGMYGPPAKR

SEQ ID NO: 9663 - protein, 20 aa, Homo sapiens
KAQEAAAAVMQAAANSAQSR

SEQ ID NO: 9664 - protein, 20 aa, Homo sapiens
KAQEAAAAVMQAAANSAQSR

SEQ ID NO: 9665 - protein, 19 aa, Homo sapiens
INKKTGQPEELVSCSDCGR

SEQ ID NO: 9666 - protein, 21 aa, Homo sapiens
SGHPSCLQFTPVMMAAVKTYR

SEQ ID NO: 9667 - protein, 19 aa, Homo sapiens
INKKTGQPEELVSCSDCGR

SEQ ID NO: 9668 - protein, 16 aa, Homo sapiens
KTGQPEELVSCSDCGR

SEQ ID NO: 9669 - protein, 21 aa, Homo sapiens
SGHPSCLQFTPVMMAAVKTYR

SEQ ID NO: 9670 - protein, 21 aa, Homo sapiens
SGHPSCLQFTPVMMAAVKTYR

SEQ ID NO: 9671 - protein, 16 aa, Homo sapiens
KTGQPEELVSCSDCGR

SEQ ID NO: 9672 - protein, 16 aa, Homo sapiens
KTGQPEELVSCSDCGR

SEQ ID NO: 9673 - protein, 21 aa, Homo sapiens
SGHPSCLQFTPVMMAAVKTYR

SEQ ID NO: 9674 - protein, 21 aa, Homo sapiens
SGHPSCLQFTPVMMAAVKTYR

SEQ ID NO: 9675 - protein, 21 aa, Homo sapiens
SGHPSCLQFTPVMMAAVKTYR

SEQ ID NO: 9676 - protein, 21 aa, Homo sapiens
SGHPSCLQFTPVMMAAVKTYR

SEQ ID NO: 9677 - protein, 16 aa, Homo sapiens
KTGQPEELVSCSDCGR

SEQ ID NO: 9678 - protein, 21 aa, Homo sapiens
SGHPSCLQFTPVMMAAVKTYR

SEQ ID NO: 9679 - protein, 21 aa, Homo sapiens
SGHPSCLQFTPVMMAAVKTYR

SEQ ID NO: 9680 - protein, 21 aa, Homo sapiens
SGHPSCLQFTPVMMAAVKTYR

SEQ ID NO: 9681 - protein, 16 aa, Homo sapiens
KTGQPEELVSCSDCGR

SEQ ID NO: 9682 - protein, 16 aa, Homo sapiens
KTGQPEELVSCSDCGR

SEQ ID NO: 9683 - protein, 16 aa, Homo sapiens
KTGQPEELVSCSDCGR

SEQ ID NO: 9684 - protein, 16 aa, Homo sapiens
KTGQPEELVSCSDCGR

SEQ ID NO: 9685 - protein, 21 aa, Homo sapiens
SGHPSCLQFTPVMMAAVKTYR

SEQ ID NO: 9686 - protein, 16 aa, Homo sapiens
KTGQPEELVSCSDCGR

SEQ ID NO: 9687 - protein, 21 aa, Homo sapiens
SGHPSCLQFTPVMMAAVKTYR

SEQ ID NO: 9688 - protein, 7 aa, Homo sapiens
TDPLEKR

SEQ ID NO: 9689 - protein, 23 aa, Homo sapiens
AHPPEDPRLSFPSIKPDTDQTLK

SEQ ID NO: 9690 - protein, 7 aa, Homo sapiens
TDPLEKR

SEQ ID NO: 9691 - protein, 7 aa, Homo sapiens
TDPLEKR

SEQ ID NO: 9692 - protein, 7 aa, Homo sapiens
TDPLEKR

SEQ ID NO: 9693 - protein, 7 aa, Homo sapiens
TDPLEKR

SEQ ID NO: 9694 - protein, 10 aa, Homo sapiens
SKGKGVGSAR

SEQ ID NO: 9695 - protein, 7 aa, Homo sapiens
TDPLEKR

SEQ ID NO: 9696 - protein, 7 aa, Homo sapiens
TDPLEKR

SEQ ID NO: 9697 - protein, 21 aa, Homo sapiens
KGPDGLALPNNYCDFCLGDSK

SEQ ID NO: 9698 - protein, 16 aa, Homo sapiens
KTGQPEELVSCSDCGR

SEQ ID NO: 9699 - protein, 34 aa, Homo sapiens; identical to SEQ ID NO: 2351

SEQ ID NO: 9700 - protein, 34 aa, Homo sapiens; identical to SEQ ID NO: 2351

SEQ ID NO: 9701 - protein, 16 aa, Homo sapiens
KTGQPEELVSCSDCGR

SEQ ID NO: 9702 - protein, 16 aa, Homo sapiens
KTGQPEELVSCSDCGR

SEQ ID NO: 9703 - protein, 8 aa, Homo sapiens
GKGVGSAR

SEQ ID NO: 9704 - protein, 16 aa, Homo sapiens
KTGQPEELVSCSDCGR

SEQ ID NO: 9705 - protein, 34 aa, Homo sapiens; identical to SEQ ID NO: 2351

SEQ ID NO: 9706 - protein, 34 aa, Homo sapiens; identical to SEQ ID NO: 2351

SEQ ID NO: 9707 - protein, 8 aa, Homo sapiens
GKGVGSAR

SEQ ID NO: 9708 - protein, 34 aa, Homo sapiens; identical to SEQ ID NO: 2351

SEQ ID NO: 9709 - protein, 8 aa, Homo sapiens
GKGVGSAR

SEQ ID NO: 9710 - protein, 11 aa, Homo sapiens
KKLDASILEDR

SEQ ID NO: 9711 - protein, 10 aa, Homo sapiens
SKGKGVGSAR

SEQ ID NO: 9712 - protein, 11 aa, Homo sapiens
KKLDASILEDR

SEQ ID NO: 9713 - protein, 11 aa, Homo sapiens
KKLDASILEDR

SEQ ID NO: 9714 - protein, 11 aa, Homo sapiens
KKLDASILEDR

SEQ ID NO: 9715 - protein, 11 aa, Homo sapiens
KKLDASILEDR

SEQ ID NO: 9716 - protein, 11 aa, Homo sapiens
KKLDASILEDR

SEQ ID NO: 9717 - protein, 16 aa, Homo sapiens
LSFPSIKPDTDQTLKK

SEQ ID NO: 9718 - protein, 16 aa, Homo sapiens
LSFPSIKPDTDQTLKK

SEQ ID NO: 9719 - protein, 16 aa, Homo sapiens
LSFPSIKPDTDQTLKK

SEQ ID NO: 9720 - protein, 25 aa, Homo sapiens
PDTDQTLKKEGLISQDGSSLEALLR

SEQ ID NO: 9721 - protein, 25 aa, Homo sapiens
PDTDQTLKKEGLISQDGSSLEALLR

SEQ ID NO: 9722 - protein, 17 aa, Homo sapiens
KEGLISQDGSSLEALLR

SEQ ID NO: 9723 - protein, 15 aa, Homo sapiens
LSFPSIKPDTDQTLK

SEQ ID NO: 9724 - protein, 15 aa, Homo sapiens
LSFPSIKPDTDQTLK

SEQ ID NO: 9725 - protein, 23 aa, Homo sapiens
AHPPEDPRLSFPSIKPDTDQTLK

SEQ ID NO: 9726 - protein, 15 aa, Homo sapiens
LSFPSIKPDTDQTLK

SEQ ID NO: 9727 - protein, 15 aa, Homo sapiens
LSFPSIKPDTDQTLK

SEQ ID NO: 9728 - protein, 24 aa, Homo sapiens
KGPDGLALPNNYCDFCLGDSKINK

SEQ ID NO: 9729 - protein, 24 aa, Homo sapiens
KGPDGLALPNNYCDFCLGDSKINK

SEQ ID NO: 9730 - protein, 23 aa, Homo sapiens
GPDGLALPNNYCDFCLGDSKINK

SEQ ID NO: 9731 - protein, 24 aa, Homo sapiens
KGPDGLALPNNYCDFCLGDSKINK

SEQ ID NO: 9732 - protein, 24 aa, Homo sapiens
KGPDGLALPNNYCDFCLGDSKINK

SEQ ID NO: 9733 - protein, 34 aa, Homo sapiens; identical to SEQ ID NO: 2351

SEQ ID NO: 9734 - protein, 34 aa, Homo sapiens; identical to SEQ ID NO: 2351

SEQ ID NO: 9735 - protein, 7 aa, Homo sapiens
SEEQKSK

SEQ ID NO: 9736 - protein, 8 aa, Homo sapiens
SEEQKSKK

SEQ ID NO: 9737 - protein, 34 aa, Homo sapiens; identical to SEQ ID NO: 2351

SEQ ID NO: 9738 - protein, 34 aa, Homo sapiens; identical to SEQ ID NO: 2351

SEQ ID NO: 9739 - protein, 34 aa, Homo sapiens; identical to SEQ ID NO: 2351

SEQ ID NO: 9740 - protein, 34 aa, Homo sapiens; identical to SEQ ID NO: 2351

SEQ ID NO: 9741 - protein, 34 aa, Homo sapiens; identical to SEQ ID NO: 2351

SEQ ID NO: 9742 - protein, 21 aa, Homo sapiens
SGHPSCLQFTPVMMAAVKTYR

SEQ ID NO: 9743 - protein, 21 aa, Homo sapiens
SGHPSCLQFTPVMMAAVKTYR

SEQ ID NO: 9744 - protein, 21 aa, Homo sapiens
SGHPSCLQFTPVMMAAVKTYR

SEQ ID NO: 9745 - protein, 21 aa, Homo sapiens
KGPDGLALPNNYCDFCLGDSK

SEQ ID NO: 9746 - protein, 21 aa, Homo sapiens
KGPDGLALPNNYCDFCLGDSK

SEQ ID NO: 9747 - protein, 21 aa, Homo sapiens
KGPDGLALPNNYCDFCLGDSK

SEQ ID NO: 9748 - protein, 21 aa, Homo sapiens
KGPDGLALPNNYCDFCLGDSK

SEQ ID NO: 9749 - protein, 21 aa, Homo sapiens
KGPDGLALPNNYCDFCLGDSK

SEQ ID NO: 9750 - protein, 21 aa, Homo sapiens
KGPDGLALPNNYCDFCLGDSK

SEQ ID NO: 9751 - protein, 7 aa, Homo sapiens
SEEQKSK

SEQ ID NO: 9752 - protein, 21 aa, Homo sapiens
KGPDGLALPNNYCDFCLGDSK

SEQ ID NO: 9753 - protein, 7 aa, Homo sapiens
SEEQKSK

SEQ ID NO: 9754 - protein, 21 aa, Homo sapiens
KGPDGLALPNNYCDFCLGDSK

SEQ ID NO: 9755 - protein, 7 aa, Homo sapiens
SEEQKSK

SEQ ID NO: 9756 - protein, 21 aa, Homo sapiens
KGPDGLALPNNYCDFCLGDSK

SEQ ID NO: 9757 - protein, 24 aa, Homo sapiens
ILEPDDFLDDLDDEDYEEDTPKRR

SEQ ID NO: 9758 - protein, 23 aa, Homo sapiens
ILEPDDFLDDLDDEDYEEDTPKR

SEQ ID NO: 9759 - protein, 24 aa, Homo sapiens
ILEPDDFLDDLDDEDYEEDTPKRR

SEQ ID NO: 9760 - protein, 24 aa, Homo sapiens
ILEPDDFLDDLDDEDYEEDTPKRR

SEQ ID NO: 9761 - protein, 24 aa, Homo sapiens
ILEPDDFLDDLDDEDYEEDTPKRR

SEQ ID NO: 9762 - protein, 24 aa, Homo sapiens
ILEPDDFLDDLDDEDYEEDTPKRR

SEQ ID NO: 9763 - protein, 24 aa, Homo sapiens
ILEPDDFLDDLDDEDYEEDTPKRR

SEQ ID NO: 9764 - protein, 24 aa, Homo sapiens
ILEPDDFLDDLDDEDYEEDTPKRR

SEQ ID NO: 9765 - protein, 8 aa, Homo sapiens
GKGVGSAR

SEQ ID NO: 9766 - protein, 23 aa, Homo sapiens
ILEPDDFLDDLDDEDYEEDTPKR

SEQ ID NO: 9767 - protein, 24 aa, Homo sapiens
ILEPDDFLDDLDDEDYEEDTPKRR

SEQ ID NO: 9768 - protein, 10 aa, Homo sapiens
SKGKGVGSAR

SEQ ID NO: 9769 - protein, 10 aa, Homo sapiens
SKGKGVGSAR

SEQ ID NO: 9770 - protein, 24 aa, Homo sapiens
ILEPDDFLDDLDDEDYEEDTPKRR

SEQ ID NO: 9771 - protein, 24 aa, Homo sapiens
ILEPDDFLDDLDDEDYEEDTPKRR

SEQ ID NO: 9772 - protein, 11 aa, Homo sapiens
KKLDASILEDR

SEQ ID NO: 9773 - protein, 23 aa, Homo sapiens
ILEPDDFLDDLDDEDYEEDTPKR

SEQ ID NO: 9774 - protein, 23 aa, Homo sapiens
ILEPDDFLDDLDDEDYEEDTPKR

SEQ ID NO: 9775 - protein, 23 aa, Homo sapiens
ILEPDDFLDDLDDEDYEEDTPKR

SEQ ID NO: 9776 - protein, 23 aa, Homo sapiens
ILEPDDFLDDLDDEDYEEDTPKR

SEQ ID NO: 9777 - protein, 24 aa, Homo sapiens
ILEPDDFLDDLDDEDYEEDTPKRR

SEQ ID NO: 9778 - protein, 24 aa, Homo sapiens
ILEPDDFLDDLDDEDYEEDTPKRR

SEQ ID NO: 9779 - protein, 24 aa, Homo sapiens
ILEPDDFLDDLDDEDYEEDTPKRR

SEQ ID NO: 9780 - protein, 24 aa, Homo sapiens
ILEPDDFLDDLDDEDYEEDTPKRR

SEQ ID NO: 9781 - protein, 23 aa, Homo sapiens
ILEPDDFLDDLDDEDYEEDTPKR

SEQ ID NO: 9782 - protein, 17 aa, Homo sapiens
KEGLISQDGSSLEALLR

SEQ ID NO: 9783 - protein, 17 aa, Homo sapiens
KEGLISQDGSSLEALLR

SEQ ID NO: 9784 - protein, 17 aa, Homo sapiens
KEGLISQDGSSLEALLR

SEQ ID NO: 9785 - protein, 17 aa, Homo sapiens
KEGLISQDGSSLEALLR

SEQ ID NO: 9786 - protein, 17 aa, Homo sapiens
KEGLISQDGSSLEALLR

SEQ ID NO: 9787 - protein, 17 aa, Homo sapiens
KEGLISQDGSSLEALLR

SEQ ID NO: 9788 - protein, 17 aa, Homo sapiens
KEGLISQDGSSLEALLR

SEQ ID NO: 9789 - protein, 17 aa, Homo sapiens
KEGLISQDGSSLEALLR

SEQ ID NO: 9790 - protein, 17 aa, Homo sapiens
KEGLISQDGSSLEALLR

SEQ ID NO: 9791 - protein, 17 aa, Homo sapiens
KEGLISQDGSSLEALLR

SEQ ID NO: 9792 - protein, 23 aa, Homo sapiens
AHPPEDPRLSFPSIKPDTDQTLK

SEQ ID NO: 9793 - protein, 17 aa, Homo sapiens
KEGLISQDGSSLEALLR

SEQ ID NO: 9794 - protein, 17 aa, Homo sapiens
KEGLISQDGSSLEALLR

SEQ ID NO: 9795 - protein, 23 aa, Homo sapiens
AHPPEDPRLSFPSIKPDTDQTLK

SEQ ID NO: 9796 - protein, 23 aa, Homo sapiens
AHPPEDPRLSFPSIKPDTDQTLK

SEQ ID NO: 9797 - protein, 17 aa, Homo sapiens
KEGLISQDGSSLEALLR

SEQ ID NO: 9798 - protein, 15 aa, Homo sapiens
LSFPSIKPDTDQTLK

SEQ ID NO: 9799 - protein, 17 aa, Homo sapiens
KEGLISQDGSSLEALLR

SEQ ID NO: 9800 - protein, 17 aa, Homo sapiens
KEGLISQDGSSLEALLR

SEQ ID NO: 9801 - protein, 23 aa, Homo sapiens
AHPPEDPRLSFPSIKPDTDQTLK

SEQ ID NO: 9802 - protein, 23 aa, Homo sapiens
AHPPEDPRLSFPSIKPDTDQTLK

SEQ ID NO: 9803 - protein, 23 aa, Homo sapiens
AHPPEDPRLSFPSIKPDTDQTLK

SEQ ID NO: 9804 - protein, 17 aa, Homo sapiens
KEGLISQDGSSLEALLR

SEQ ID NO: 9805 - protein, 15 aa, Homo sapiens
LSFPSIKPDTDQTLK

SEQ ID NO: 9806 - protein, 23 aa, Homo sapiens
AHPPEDPRLSFPSIKPDTDQTLK

SEQ ID NO: 9807 - protein, 23 aa, Homo sapiens
AHPPEDPRLSFPSIKPDTDQTLK

SEQ ID NO: 9808 - protein, 15 aa, Homo sapiens
LSFPSIKPDTDQTLK

SEQ ID NO: 9809 - protein, 17 aa, Homo sapiens
KEGLISQDGSSLEALLR

SEQ ID NO: 9810 - protein, 23 aa, Homo sapiens
AHPPEDPRLSFPSIKPDTDQTLK

SEQ ID NO: 9811 - protein, 23 aa, Homo sapiens
AHPPEDPRLSFPSIKPDTDQTLK

SEQ ID NO: 9812 - protein, 23 aa, Homo sapiens
AHPPEDPRLSFPSIKPDTDQTLK

SEQ ID NO: 9813 - protein, 17 aa, Homo sapiens
KEGLISQDGSSLEALLR

SEQ ID NO: 9814 - protein, 24 aa, Homo sapiens
ILEPDDFLDDLDDEDYEEDTPKRR

SEQ ID NO: 9815 - protein, 17 aa, Homo sapiens
KEGLISQDGSSLEALLR

SEQ ID NO: 9816 - protein, 17 aa, Homo sapiens
KEGLISQDGSSLEALLR

SEQ ID NO: 9817 - protein, 17 aa, Homo sapiens
KEGLISQDGSSLEALLR

SEQ ID NO: 9818 - protein, 17 aa, Homo sapiens
KEGLISQDGSSLEALLR

SEQ ID NO: 9819 - protein, 17 aa, Homo sapiens
KEGLISQDGSSLEALLR

SEQ ID NO: 9820 - protein, 17 aa, Homo sapiens
KEGLISQDGSSLEALLR

SEQ ID NO: 9821 - protein, 17 aa, Homo sapiens
KEGLISQDGSSLEALLR

SEQ ID NO: 9822 - protein, 17 aa, Homo sapiens
KEGLISQDGSSLEALLR

SEQ ID NO: 9823 - protein, 7 aa, Homo sapiens
TDPLEKR

SEQ ID NO: 9824 - protein, 17 aa, Homo sapiens
KEGLISQDGSSLEALLR

SEQ ID NO: 9825 - protein, 6 aa, Homo sapiens
RPMKQK

SEQ ID NO: 9826 - protein, 3 aa, Homo sapiens
KLR

SEQ ID NO: 9827 - protein, 27 aa, Homo sapiens
LYISNTFNPAKPDAEDSDGSIASWELR

SEQ ID NO: 9828 - protein, 7 aa, Homo sapiens
KPLDLYR

SEQ ID NO: 9829 - protein, 20 aa, Homo sapiens
YLAFTEEKAMGMTNLPAVGR

SEQ ID NO: 9830 - protein, 14 aa, Homo sapiens
ITKLYELGGEPERK

SEQ ID NO: 9831 - protein, 14 aa, Homo sapiens
ITKLYELGGEPERK

SEQ ID NO: 9832 - protein, 14 aa, Homo sapiens
ITKLYELGGEPERK

SEQ ID NO: 9833 - protein, 14 aa, Homo sapiens
ITKLYELGGEPERK

SEQ ID NO: 9834 - protein, 14 aa, Homo sapiens
ITKLYELGGEPERK

SEQ ID NO: 9835 - protein, 14 aa, Homo sapiens
ITKLYELGGEPERK

SEQ ID NO: 9836 - protein, 13 aa, Homo sapiens
ITKLYELGGEPER

SEQ ID NO: 9837 - protein, 14 aa, Homo sapiens
ITKLYELGGEPERK

SEQ ID NO: 9838 - protein, 14 aa, Homo sapiens
ITKLYELGGEPERK

SEQ ID NO: 9839 - protein, 14 aa, Homo sapiens
ITKLYELGGEPERK

SEQ ID NO: 9840 - protein, 13 aa, Homo sapiens
ITKLYELGGEPER

SEQ ID NO: 9841 - protein, 14 aa, Homo sapiens
ITKLYELGGEPERK

SEQ ID NO: 9842 - protein, 14 aa, Homo sapiens
ITKLYELGGEPERK

SEQ ID NO: 9843 - protein, 14 aa, Homo sapiens
ITKLYELGGEPERK

SEQ ID NO: 9844 - protein, 13 aa, Homo sapiens
ITKLYELGGEPER

SEQ ID NO: 9845 - protein, 13 aa, Homo sapiens
ITKLYELGGEPER

SEQ ID NO: 9846 - protein, 13 aa, Homo sapiens
ITKLYELGGEPER

SEQ ID NO: 9847 - protein, 13 aa, Homo sapiens
ITKLYELGGEPER

SEQ ID NO: 9848 - protein, 13 aa, Homo sapiens
ITKLYELGGEPER

SEQ ID NO: 9849 - protein, 13 aa, Homo sapiens
ITKLYELGGEPER

SEQ ID NO: 9850 - protein, 6 aa, Homo sapiens
KMWVDR

SEQ ID NO: 9851 - protein, 13 aa, Homo sapiens
ITKLYELGGEPER

SEQ ID NO: 9852 - protein, 27 aa, Homo sapiens
KHVTTAEGTPGTTDQEGPPPDGPPEKR

SEQ ID NO: 9853 - protein, 27 aa, Homo sapiens
KHVTTAEGTPGTTDQEGPPPDGPPEKR

SEQ ID NO: 9854 - protein, 27 aa, Homo sapiens
KHVTTAEGTPGTTDQEGPPPDGPPEKR

SEQ ID NO: 9855 - protein, 27 aa, Homo sapiens
KHVTTAEGTPGTTDQEGPPPDGPPEKR

SEQ ID NO: 9856 - protein, 27 aa, Homo sapiens
KHVTTAEGTPGTTDQEGPPPDGPPEKR

SEQ ID NO: 9857 - protein, 27 aa, Homo sapiens
KHVTTAEGTPGTTDQEGPPPDGPPEKR

SEQ ID NO: 9858 - protein, 11 aa, Homo sapiens
LILLHHKHPER

SEQ ID NO: 9859 - protein, 27 aa, Homo sapiens
KHVTTAEGTPGTTDQEGPPPDGPPEKR

SEQ ID NO: 9860 - protein, 11 aa, Homo sapiens
LILLHHKHPER

SEQ ID NO: 9861 - protein, 12 aa, Homo sapiens
LILLHHKHPERK

SEQ ID NO: 9862 - protein, 27 aa, Homo sapiens
KHVTTAEGTPGTTDQEGPPPDGPPEKR

SEQ ID NO: 9863 - protein, 27 aa, Homo sapiens
KHVTTAEGTPGTTDQEGPPPDGPPEKR

SEQ ID NO: 9864 - protein, 29 aa, Homo sapiens
NIKILEDEPHSKDETPLCTLLDWQDSLAK

SEQ ID NO: 9865 - protein, 12 aa, Homo sapiens
LILLHHKHPERK

SEQ ID NO: 9866 - protein, 11 aa, Homo sapiens
LILLHHKHPER

SEQ ID NO: 9867 - protein, 21 aa, Homo sapiens
RCLIEIFGILKEYEVGDPGQR

SEQ ID NO: 9868 - protein, 20 aa, Homo sapiens
CLIEIFGILKEYEVGDPGQR

SEQ ID NO: 9869 - protein, 34 aa, Homo sapiens; identical to SEQ ID NO: 1943

SEQ ID NO: 9870 - protein, 34 aa, Homo sapiens; identical to SEQ ID NO: 1943

SEQ ID NO: 9871 - protein, 34 aa, Homo sapiens; identical to SEQ ID NO: 1943

SEQ ID NO: 9872 - protein, 29 aa, Homo sapiens
NIKILEDEPHSKDETPLCTLLDWQDSLAK

SEQ ID NO: 9873 - protein, 10 aa, Homo sapiens
LEKLYSTMVR

SEQ ID NO: 9874 - protein, 29 aa, Homo sapiens
NIKILEDEPHSKDETPLCTLLDWQDSLAK

SEQ ID NO: 9875 - protein, 29 aa, Homo sapiens
NIKILEDEPHSKDETPLCTLLDWQDSLAK

SEQ ID NO: 9876 - protein, 10 aa, Homo sapiens
LEKLYSTMVR

SEQ ID NO: 9877 - protein, 29 aa, Homo sapiens
NIKILEDEPHSKDETPLCTLLDWQDSLAK

SEQ ID NO: 9878 - protein, 29 aa, Homo sapiens
NIKILEDEPHSKDETPLCTLLDWQDSLAK

SEQ ID NO: 9879 - protein, 10 aa, Homo sapiens
LEKLYSTMVR

SEQ ID NO: 9880 - protein, 10 aa, Homo sapiens
LEKLYSTMVR

SEQ ID NO: 9881 - protein, 29 aa, Homo sapiens
NIKILEDEPHSKDETPLCTLLDWQDSLAK

SEQ ID NO: 9882 - protein, 29 aa, Homo sapiens
NIKILEDEPHSKDETPLCTLLDWQDSLAK

SEQ ID NO: 9883 - protein, 29 aa, Homo sapiens
NIKILEDEPHSKDETPLCTLLDWQDSLAK

SEQ ID NO: 9884 - protein, 12 aa, Homo sapiens
NIKILEDEPHSK

SEQ ID NO: 9885 - protein, 29 aa, Homo sapiens
NIKILEDEPHSKDETPLCTLLDWQDSLAK

SEQ ID NO: 9886 - protein, 10 aa, Homo sapiens
LEKLYSTMVR

SEQ ID NO: 9887 - protein, 12 aa, Homo sapiens
NIKILEDEPHSK

SEQ ID NO: 9888 - protein, 29 aa, Homo sapiens
NIKILEDEPHSKDETPLCTLLDWQDSLAK

SEQ ID NO: 9889 - protein, 10 aa, Homo sapiens
LEKLYSTMVR

SEQ ID NO: 9890 - protein, 29 aa, Homo sapiens
NIKILEDEPHSKDETPLCTLLDWQDSLAK

SEQ ID NO: 9891 - protein, 12 aa, Homo sapiens
NIKILEDEPHSK

SEQ ID NO: 9892 - protein, 29 aa, Homo sapiens
NIKILEDEPHSKDETPLCTLLDWQDSLAK

SEQ ID NO: 9893 - protein, 29 aa, Homo sapiens
NIKILEDEPHSKDETPLCTLLDWQDSLAK

SEQ ID NO: 9894 - protein, 29 aa, Homo sapiens
NIKILEDEPHSKDETPLCTLLDWQDSLAK

SEQ ID NO: 9895 - protein, 29 aa, Homo sapiens
NIKILEDEPHSKDETPLCTLLDWQDSLAK

SEQ ID NO: 9896 - protein, 29 aa, Homo sapiens
NIKILEDEPHSKDETPLCTLLDWQDSLAK

SEQ ID NO: 9897 - protein, 12 aa, Homo sapiens
LILLHHKHPERK

SEQ ID NO: 9898 - protein, 11 aa, Homo sapiens
LILLHHKHPER

SEQ ID NO: 9899 - protein, 11 aa, Homo sapiens
LILLHHKHPER

SEQ ID NO: 9900 - protein, 12 aa, Homo sapiens
NIKILEDEPHSK

SEQ ID NO: 9901 - protein, 12 aa, Homo sapiens
NIKILEDEPHSK

SEQ ID NO: 9902 - protein, 12 aa, Homo sapiens
LILLHHKHPERK

SEQ ID NO: 9903 - protein, 29 aa, Homo sapiens
NIKILEDEPHSKDETPLCTLLDWQDSLAK

SEQ ID NO: 9904 - protein, 29 aa, Homo sapiens
NIKILEDEPHSKDETPLCTLLDWQDSLAK

SEQ ID NO: 9905 - protein, 15 aa, Homo sapiens
DKPASENSEEKLISK

SEQ ID NO: 9906 - protein, 15 aa, Homo sapiens
DKPASENSEEKLISK

SEQ ID NO: 9907 - protein, 15 aa, Homo sapiens
DKPASENSEEKLISK

SEQ ID NO: 9908 - protein, 25 aa, Homo sapiens
KAPGSDPFMSSGQGPNGGMGDPYSR

SEQ ID NO: 9909 - protein, 25 aa, Homo sapiens
KAPGSDPFMSSGQGPNGGMGDPYSR

SEQ ID NO: 9910 - protein, 21 aa, Homo sapiens
SNSVGIQDAFNDGSDSTFQKR

SEQ ID NO: 9911 - protein, 14 aa, Homo sapiens
MSYEPNKDPYGSMR

SEQ ID NO: 9912 - protein, 14 aa, Homo sapiens
MSYEPNKDPYGSMR

SEQ ID NO: 9913 - protein, 7 aa, Homo sapiens
KPLDLYR

SEQ ID NO: 9914 - protein, 11 aa, Homo sapiens
KSSSSTTTNEK

SEQ ID NO: 9915 - protein, 11 aa, Homo sapiens
KSSSSTTTNEK

SEQ ID NO: 9916 - protein, 11 aa, Homo sapiens
KSSSSTTTNEK

SEQ ID NO: 9917 - protein, 11 aa, Homo sapiens
KSSSSTTTNEK

SEQ ID NO: 9918 - protein, 27 aa, Homo sapiens
KHVTTAEGTPGTTDQEGPPPDGPPEKR

SEQ ID NO: 9919 - protein, 22 aa, Homo sapiens
SSEAIKESSKFPFGISPAQSHR

SEQ ID NO: 9920 - protein, 11 aa, Homo sapiens
LILLHHKHPER

SEQ ID NO: 9921 - protein, 27 aa, Homo sapiens
KHVTTAEGTPGTTDQEGPPPDGPPEKR

SEQ ID NO: 9922 - protein, 11 aa, Homo sapiens
LILLHHKHPER

SEQ ID NO: 9923 - protein, 27 aa, Homo sapiens
KHVTTAEGTPGTTDQEGPPPDGPPEKR

SEQ ID NO: 9924 - protein, 11 aa, Homo sapiens
LILLHHKHPER

SEQ ID NO: 9925 - protein, 27 aa, Homo sapiens
KHVTTAEGTPGTTDQEGPPPDGPPEKR

SEQ ID NO: 9926 - protein, 11 aa, Homo sapiens
LILLHHKHPER

SEQ ID NO: 9927 - protein, 12 aa, Homo sapiens
LILLHHKHPERK

SEQ ID NO: 9928 - protein, 12 aa, Homo sapiens
LILLHHKHPERK

SEQ ID NO: 9929 - protein, 11 aa, Homo sapiens
LILLHHKHPER

SEQ ID NO: 9930 - protein, 12 aa, Homo sapiens
LILLHHKHPERK

SEQ ID NO: 9931 - protein, 27 aa, Homo sapiens
KHVTTAEGTPGTTDQEGPPPDGPPEKR

SEQ ID NO: 9932 - protein, 27 aa, Homo sapiens
KHVTTAEGTPGTTDQEGPPPDGPPEKR

SEQ ID NO: 9933 - protein, 27 aa, Homo sapiens
KHVTTAEGTPGTTDQEGPPPDGPPEKR

SEQ ID NO: 9934 - protein, 27 aa, Homo sapiens
KHVTTAEGTPGTTDQEGPPPDGPPEKR

SEQ ID NO: 9935 - protein, 10 aa, Homo sapiens
LEKLYSTMVR

SEQ ID NO: 9936 - protein, 27 aa, Homo sapiens
KHVTTAEGTPGTTDQEGPPPDGPPEKR

SEQ ID NO: 9937 - protein, 27 aa, Homo sapiens
KHVTTAEGTPGTTDQEGPPPDGPPEKR

SEQ ID NO: 9938 - protein, 27 aa, Homo sapiens
KHVTTAEGTPGTTDQEGPPPDGPPEKR

SEQ ID NO: 9939 - protein, 16 aa, Homo sapiens
SSTLTEDGAKSSEAIK

SEQ ID NO: 9940 - protein, 25 aa, Homo sapiens
KAPGSDPFMSSGQGPNGGMGDPYSR

SEQ ID NO: 9941 - protein, 14 aa, Homo sapiens
MSYEPNKDPYGSMR

SEQ ID NO: 9942 - protein, 14 aa, Homo sapiens
MSYEPNKDPYGSMR

SEQ ID NO: 9943 - protein, 25 aa, Homo sapiens
KAPGSDPFMSSGQGPNGGMGDPYSR

SEQ ID NO: 9944 - protein, 25 aa, Homo sapiens
KAPGSDPFMSSGQGPNGGMGDPYSR

SEQ ID NO: 9945 - protein, 14 aa, Homo sapiens
MSYEPNKDPYGSMR

SEQ ID NO: 9946 - protein, 14 aa, Homo sapiens
MSYEPNKDPYGSMR

SEQ ID NO: 9947 - protein, 14 aa, Homo sapiens
MSYEPNKDPYGSMR

SEQ ID NO: 9948 - protein, 14 aa, Homo sapiens
MSYEPNKDPYGSMR

SEQ ID NO: 9949 - protein, 14 aa, Homo sapiens
MSYEPNKDPYGSMR

SEQ ID NO: 9950 - protein, 14 aa, Homo sapiens
MSYEPNKDPYGSMR

SEQ ID NO: 9951 - protein, 14 aa, Homo sapiens
MSYEPNKDPYGSMR

SEQ ID NO: 9952 - protein, 14 aa, Homo sapiens
MSYEPNKDPYGSMR

SEQ ID NO: 9953 - protein, 14 aa, Homo sapiens
MSYEPNKDPYGSMR

SEQ ID NO: 9954 - protein, 14 aa, Homo sapiens
MSYEPNKDPYGSMR

SEQ ID NO: 9955 - protein, 25 aa, Homo sapiens
KAPGSDPFMSSGQGPNGGMGDPYSR

SEQ ID NO: 9956 - protein, 6 aa, Homo sapiens
KNPVCR

SEQ ID NO: 9957 - protein, 14 aa, Homo sapiens
MSYEPNKDPYGSMR

SEQ ID NO: 9958 - protein, 14 aa, Homo sapiens
MSYEPNKDPYGSMR

SEQ ID NO: 9959 - protein, 20 aa, Homo sapiens
DITFPPGSVEATQPVLKQRR

SEQ ID NO: 9960 - protein, 14 aa, Homo sapiens
NDPFVVDCSDKLGR

SEQ ID NO: 9961 - protein, 12 aa, Homo sapiens
LILLHHKHPERK

SEQ ID NO: 9962 - protein, 26 aa, Homo sapiens
ILEDEPHSKDETPLCTLLDWQDSLAK

SEQ ID NO: 9963 - protein, 10 aa, Homo sapiens
LEKLYSTMVR

SEQ ID NO: 9964 - protein, 29 aa, Homo sapiens
NIKILEDEPHSKDETPLCTLLDWQDSLAK

SEQ ID NO: 9965 - protein, 29 aa, Homo sapiens
NIKILEDEPHSKDETPLCTLLDWQDSLAK

SEQ ID NO: 9966 - protein, 10 aa, Homo sapiens
LEKLYSTMVR

SEQ ID NO: 9967 - protein, 11 aa, Homo sapiens
LILLHHKHPER

SEQ ID NO: 9968 - protein, 13 aa, Homo sapiens
LTMKDIGTPEAWR

SEQ ID NO: 9969 - protein, 16 aa, Homo sapiens
ESSKFPFGISPAQSHR

SEQ ID NO: 9970 - protein, 16 aa, Homo sapiens
ESSKFPFGISPAQSHR

SEQ ID NO: 9971 - protein, 16 aa, Homo sapiens
SSTLTEDGAKSSEAIK

SEQ ID NO: 9972 - protein, 16 aa, Homo sapiens
SSTLTEDGAKSSEAIK

SEQ ID NO: 9973 - protein, 16 aa, Homo sapiens
ESSKFPFGISPAQSHR

SEQ ID NO: 9974 - protein, 16 aa, Homo sapiens
SSTLTEDGAKSSEAIK

SEQ ID NO: 9975 - protein, 16 aa, Homo sapiens
SSTLTEDGAKSSEAIK

SEQ ID NO: 9976 - protein, 16 aa, Homo sapiens
ESSKFPFGISPAQSHR

SEQ ID NO: 9977 - protein, 16 aa, Homo sapiens
SSTLTEDGAKSSEAIK

SEQ ID NO: 9978 - protein, 16 aa, Homo sapiens
ESSKFPFGISPAQSHR

SEQ ID NO: 9979 - protein, 16 aa, Homo sapiens
ESSKFPFGISPAQSHR

SEQ ID NO: 9980 - protein, 16 aa, Homo sapiens
ESSKFPFGISPAQSHR

SEQ ID NO: 9981 - protein, 21 aa, Homo sapiens
SNSVGIQDAFNDGSDSTFQKR

SEQ ID NO: 9982 - protein, 21 aa, Homo sapiens
SNSVGIQDAFNDGSDSTFQKR

SEQ ID NO: 9983 - protein, 21 aa, Homo sapiens
SNSVGIQDAFNDGSDSTFQKR

SEQ ID NO: 9984 - protein, 21 aa, Homo sapiens
SNSVGIQDAFNDGSDSTFQKR

SEQ ID NO: 9985 - protein, 14 aa, Homo sapiens
MSYEPNKDPYGSMR

SEQ ID NO: 9986 - protein, 21 aa, Homo sapiens
SNSVGIQDAFNDGSDSTFQKR

SEQ ID NO: 9987 - protein, 21 aa, Homo sapiens
SNSVGIQDAFNDGSDSTFQKR

SEQ ID NO: 9988 - protein, 14 aa, Homo sapiens
MSYEPNKDPYGSMR

SEQ ID NO: 9989 - protein, 21 aa, Homo sapiens
SNSVGIQDAFNDGSDSTFQKR

SEQ ID NO: 9990 - protein, 21 aa, Homo sapiens
SNSVGIQDAFNDGSDSTFQKR

SEQ ID NO: 9991 - protein, 21 aa, Homo sapiens
SNSVGIQDAFNDGSDSTFQKR

SEQ ID NO: 9992 - protein, 25 aa, Homo sapiens
KAPGSDPFMSSGQGPNGGMGDPYSR

SEQ ID NO: 9993 - protein, 20 aa, Homo sapiens
YLAFTEEKAMGMTNLPAVGR

SEQ ID NO: 9994 - protein, 7 aa, Homo sapiens
KPLDLYR

SEQ ID NO: 9995 - protein, 12 aa, Homo sapiens
LILLHHKHPERK

SEQ ID NO: 9996 - protein, 11 aa, Homo sapiens
LILLHHKHPER

SEQ ID NO: 9997 - protein, 24 aa, Homo sapiens
SLSFVPGNDFEMSKHPGLLLILGK

SEQ ID NO: 9998 - protein, 24 aa, Homo sapiens
SLSFVPGNDFEMSKHPGLLLILGK

SEQ ID NO: 9999 - protein, 11 aa, Homo sapiens
LILLHHKHPER

SEQ ID NO: 10000 - protein, 24 aa, Homo sapiens
SLSFVPGNDFEMSKHPGLLLILGK

SEQ ID NO: 10001 - protein, 24 aa, Homo sapiens
SLSFVPGNDFEMSKHPGLLLILGK

SEQ ID NO: 10002 - protein, 24 aa, Homo sapiens
SLSFVPGNDFEMSKHPGLLLILGK

SEQ ID NO: 10003 - protein, 24 aa, Homo sapiens
SLSFVPGNDFEMSKHPGLLLILGK

SEQ ID NO: 10004 - protein, 24 aa, Homo sapiens
SLSFVPGNDFEMSKHPGLLLILGK

SEQ ID NO: 10005 - protein, 12 aa, Homo sapiens
LILLHHKHPERK

SEQ ID NO: 10006 - protein, 24 aa, Homo sapiens
SLSFVPGNDFEMSKHPGLLLILGK

SEQ ID NO: 10007 - protein, 24 aa, Homo sapiens
SLSFVPGNDFEMSKHPGLLLILGK

SEQ ID NO: 10008 - protein, 24 aa, Homo sapiens
SLSFVPGNDFEMSKHPGLLLILGK

SEQ ID NO: 10009 - protein, 24 aa, Homo sapiens
SLSFVPGNDFEMSKHPGLLLILGK

SEQ ID NO: 10010 - protein, 24 aa, Homo sapiens
SLSFVPGNDFEMSKHPGLLLILGK

SEQ ID NO: 10011 - protein, 10 aa, Homo sapiens
LTPATKMNNK

SEQ ID NO: 10012 - protein, 6 aa, Homo sapiens
KNPVCR

SEQ ID NO: 10013 - protein, 13 aa, Homo sapiens
SSSSTTTNEKITK

SEQ ID NO: 10014 - protein, 13 aa, Homo sapiens
SSSSTTTNEKITK

SEQ ID NO: 10015 - protein, 16 aa, Homo sapiens
ESSKFPFGISPAQSHR

SEQ ID NO: 10016 - protein, 10 aa, Homo sapiens
LEKLYSTMVR

SEQ ID NO: 10017 - protein, 16 aa, Homo sapiens
ESSKFPFGISPAQSHR

SEQ ID NO: 10018 - protein, 23 aa, Homo sapiens
FSKVSSPAPMEGGEEEEELLGPK

SEQ ID NO: 10019 - protein, 23 aa, Homo sapiens
FSKVSSPAPMEGGEEEEELLGPK

SEQ ID NO: 10020 - protein, 23 aa, Homo sapiens
FSKVSSPAPMEGGEEEEELLGPK

SEQ ID NO: 10021 - protein, 30 aa, Homo sapiens
TLLDPGRFSKVSSPAPMEGGEEEEELLGPK

SEQ ID NO: 10022 - protein, 30 aa, Homo sapiens; identical to SEQ ID NO: 10021

SEQ ID NO: 10023 - protein, 27 aa, Homo sapiens
KHVTTAEGTPGTTDQEGPPPDGPPEKR

SEQ ID NO: 10024 - protein, 34 aa, Homo sapiens; identical to SEQ ID NO: 1943

SEQ ID NO: 10025 - protein, 34 aa, Homo sapiens; identical to SEQ ID NO: 1943

SEQ ID NO: 10026 - protein, 24 aa, Homo sapiens
GEMKAAAGQESEGPAVGPPQPLGK

SEQ ID NO: 10027 - protein, 24 aa, Homo sapiens
GEMKAAAGQESEGPAVGPPQPLGK

SEQ ID NO: 10028 - protein, 22 aa, Homo sapiens
KAEQQQREEAGGEAAAAAAAER

SEQ ID NO: 10029 - protein, 24 aa, Homo sapiens
GEMKAAAGQESEGPAVGPPQPLGK

SEQ ID NO: 10030 - protein, 24 aa, Homo sapiens
GEMKAAAGQESEGPAVGPPQPLGK

SEQ ID NO: 10031 - protein, 22 aa, Homo sapiens
KAEQQQREEAGGEAAAAAAAER

SEQ ID NO: 10032 - protein, 39 aa, Homo sapiens
EEAGGEAAAAAAAERGEMKAAAGQESEGPAVGPPQPLGK

SEQ ID NO: 10033 - protein, 24 aa, Homo sapiens
GEMKAAAGQESEGPAVGPPQPLGK

SEQ ID NO: 10034 - protein, 3 aa, Homo sapiens
KCF

SEQ ID NO: 10035 - protein, 3 aa, Homo sapiens
KCF

SEQ ID NO: 10036 - protein, 3 aa, Homo sapiens
KCF

SEQ ID NO: 10037 - protein, 3 aa, Homo sapiens
KCF

SEQ ID NO: 10038 - protein, 3 aa, Homo sapiens
KCF

SEQ ID NO: 10039 - protein, 3 aa, Homo sapiens
KCF

SEQ ID NO: 10040 - protein, 21 aa, Homo sapiens
VAPEEHPVLLTEAPLNPKANR

SEQ ID NO: 10041 - protein, 21 aa, Homo sapiens
VAPEEHPVLLTEAPLNPKANR

SEQ ID NO: 10042 - protein, 31 aa, Homo sapiens
EKMTQIMFETFNTPAMYVAIQAVLSLYASGR

SEQ ID NO: 10043 - protein, 10 aa, Homo sapiens
IKIIAPPERK

SEQ ID NO: 10044 - protein, 9 aa, Homo sapiens
IKIIAPPER

SEQ ID NO: 10045 - protein, 10 aa, Homo sapiens
IKIIAPPERK

SEQ ID NO: 10046 - protein, 10 aa, Homo sapiens
IKIIAPPERK

SEQ ID NO: 10047 - protein, 9 aa, Homo sapiens
IKIIAPPER

SEQ ID NO: 10048 - protein, 9 aa, Homo sapiens
IKIIAPPER

SEQ ID NO: 10049 - protein, 20 aa, Homo sapiens
EITALAPSTMKIKIIAPPER

SEQ ID NO: 10050 - protein, 9 aa, Homo sapiens
IKIIAPPER

SEQ ID NO: 10051 - protein, 9 aa, Homo sapiens
IKIIAPPER

SEQ ID NO: 10052 - protein, 9 aa, Homo sapiens
IKIIAPPER

SEQ ID NO: 10053 - protein, 20 aa, Homo sapiens
EITALAPSTMKIKIIAPPER

SEQ ID NO: 10054 - protein, 20 aa, Homo sapiens
EITALAPSTMKIKIIAPPER

SEQ ID NO: 10055 - protein, 20 aa, Homo sapiens
EITALAPSTMKIKIIAPPER

SEQ ID NO: 10056 - protein, 20 aa, Homo sapiens
EITALAPSTMKIKIIAPPER

SEQ ID NO: 10057 - protein, 20 aa, Homo sapiens
EITALAPSTMKIKIIAPPER

SEQ ID NO: 10058 - protein, 9 aa, Homo sapiens
IKIIAPPER

SEQ ID NO: 10059 - protein, 9 aa, Homo sapiens
IKIIAPPER

SEQ ID NO: 10060 - protein, 9 aa, Homo sapiens
IKIIAPPER

SEQ ID NO: 10061 - protein, 20 aa, Homo sapiens
EITALAPSTMKIKIIAPPER

SEQ ID NO: 10062 - protein, 9 aa, Homo sapiens
IKIIAPPER

SEQ ID NO: 10063 - protein, 10 aa, Homo sapiens
IKIIAPPERK

SEQ ID NO: 10064 - protein, 9 aa, Homo sapiens
IKIIAPPER

SEQ ID NO: 10065 - protein, 9 aa, Homo sapiens
IKIIAPPER

SEQ ID NO: 10066 - protein, 20 aa, Homo sapiens
EITALAPSTMKIKIIAPPER

SEQ ID NO: 10067 - protein, 9 aa, Homo sapiens
IKIIAPPER

SEQ ID NO: 10068 - protein, 20 aa, Homo sapiens
EITALAPSTMKIKIIAPPER

SEQ ID NO: 10069 - protein, 20 aa, Homo sapiens
EITALAPSTMKIKIIAPPER

SEQ ID NO: 10070 - protein, 9 aa, Homo sapiens
IKIIAPPER

SEQ ID NO: 10071 - protein, 9 aa, Homo sapiens
IKIIAPPER

SEQ ID NO: 10072 - protein, 9 aa, Homo sapiens
IKIIAPPER

SEQ ID NO: 10073 - protein, 20 aa, Homo sapiens
EITALAPSTMKIKIIAPPER

SEQ ID NO: 10074 - protein, 9 aa, Homo sapiens
IKIIAPPER

SEQ ID NO: 10075 - protein, 9 aa, Homo sapiens
IKIIAPPER

SEQ ID NO: 10076 - protein, 20 aa, Homo sapiens
EITALAPSTMKIKIIAPPER

SEQ ID NO: 10077 - protein, 9 aa, Homo sapiens
IKIIAPPER

SEQ ID NO: 10078 - protein, 20 aa, Homo sapiens
EITALAPSTMKIKIIAPPER

SEQ ID NO: 10079 - protein, 20 aa, Homo sapiens
EITALAPSTMKIKIIAPPER

SEQ ID NO: 10080 - protein, 20 aa, Homo sapiens
EITALAPSTMKIKIIAPPER

SEQ ID NO: 10081 - protein, 20 aa, Homo sapiens
EITALAPSTMKIKIIAPPER

SEQ ID NO: 10082 - protein, 20 aa, Homo sapiens
EITALAPSTMKIKIIAPPER

SEQ ID NO: 10083 - protein, 22 aa, Homo sapiens
KDLYANTVLSGGTTMYPGIADR

SEQ ID NO: 10084 - protein, 20 aa, Homo sapiens
EITALAPSTMKIKIIAPPER

SEQ ID NO: 10085 - protein, 20 aa, Homo sapiens
EITALAPSTMKIKIIAPPER

SEQ ID NO: 10086 - protein, 20 aa, Homo sapiens
EITALAPSTMKIKIIAPPER

SEQ ID NO: 10087 - protein, 20 aa, Homo sapiens
EITALAPSTMKIKIIAPPER

SEQ ID NO: 10088 - protein, 20 aa, Homo sapiens
EITALAPSTMKIKIIAPPER

SEQ ID NO: 10089 - protein, 20 aa, Homo sapiens
EITALAPSTMKIKIIAPPER

SEQ ID NO: 10090 - protein, 20 aa, Homo sapiens
EITALAPSTMKIKIIAPPER

SEQ ID NO: 10091 - protein, 13 aa, Homo sapiens
EITALAPSTMKIK

SEQ ID NO: 10092 - protein, 22 aa, Homo sapiens
KDLYANTVLSGGTTMYPGIADR

SEQ ID NO: 10093 - protein, 20 aa, Homo sapiens
EITALAPSTMKIKIIAPPER

SEQ ID NO: 10094 - protein, 20 aa, Homo sapiens
EITALAPSTMKIKIIAPPER

SEQ ID NO: 10095 - protein, 22 aa, Homo sapiens
KDLYANTVLSGGTTMYPGIADR

SEQ ID NO: 10096 - protein, 20 aa, Homo sapiens
EITALAPSTMKIKIIAPPER

SEQ ID NO: 10097 - protein, 22 aa, Homo sapiens
KDLYANTVLSGGTTMYPGIADR

SEQ ID NO: 10098 - protein, 22 aa, Homo sapiens
KDLYANTVLSGGTTMYPGIADR

SEQ ID NO: 10099 - protein, 20 aa, Homo sapiens
EITALAPSTMKIKIIAPPER

SEQ ID NO: 10100 - protein, 13 aa, Homo sapiens
EITALAPSTMKIK

SEQ ID NO: 10101 - protein, 20 aa, Homo sapiens
EITALAPSTMKIKIIAPPER

SEQ ID NO: 10102 - protein, 20 aa, Homo sapiens
EITALAPSTMKIKIIAPPER

SEQ ID NO: 10103 - protein, 13 aa, Homo sapiens
EITALAPSTMKIK

SEQ ID NO: 10104 - protein, 22 aa, Homo sapiens
KDLYANTVLSGGTTMYPGIADR

SEQ ID NO: 10105 - protein, 20 aa, Homo sapiens
EITALAPSTMKIKIIAPPER

SEQ ID NO: 10106 - protein, 13 aa, Homo sapiens
EITALAPSTMKIK

SEQ ID NO: 10107 - protein, 22 aa, Homo sapiens
KDLYANTVLSGGTTMYPGIADR

SEQ ID NO: 10108 - protein, 22 aa, Homo sapiens
KDLYANTVLSGGTTMYPGIADR

SEQ ID NO: 10109 - protein, 13 aa, Homo sapiens
EITALAPSTMKIK

SEQ ID NO: 10110 - protein, 13 aa, Homo sapiens
EITALAPSTMKIK

SEQ ID NO: 10111 - protein, 20 aa, Homo sapiens
EITALAPSTMKIKIIAPPER

SEQ ID NO: 10112 - protein, 22 aa, Homo sapiens
KDLYANTVLSGGTTMYPGIADR

SEQ ID NO: 10113 - protein, 20 aa, Homo sapiens
EITALAPSTMKIKIIAPPER

SEQ ID NO: 10114 - protein, 20 aa, Homo sapiens
EITALAPSTMKIKIIAPPER

SEQ ID NO: 10115 - protein, 20 aa, Homo sapiens
EITALAPSTMKIKIIAPPER

SEQ ID NO: 10116 - protein, 13 aa, Homo sapiens
EITALAPSTMKIK

SEQ ID NO: 10117 - protein, 13 aa, Homo sapiens
EITALAPSTMKIK

SEQ ID NO: 10118 - protein, 13 aa, Homo sapiens
EITALAPSTMKIK

SEQ ID NO: 10119 - protein, 20 aa, Homo sapiens
EITALAPSTMKIKIIAPPER

SEQ ID NO: 10120 - protein, 22 aa, Homo sapiens
KDLYANTVLSGGTTMYPGIADR

SEQ ID NO: 10121 - protein, 22 aa, Homo sapiens
KDLYANTVLSGGTTMYPGIADR

SEQ ID NO: 10122 - protein, 20 aa, Homo sapiens
EITALAPSTMKIKIIAPPER

SEQ ID NO: 10123 - protein, 20 aa, Homo sapiens
EITALAPSTMKIKIIAPPER

SEQ ID NO: 10124 - protein, 13 aa, Homo sapiens
EITALAPSTMKIK

SEQ ID NO: 10125 - protein, 20 aa, Homo sapiens
EITALAPSTMKIKIIAPPER

SEQ ID NO: 10126 - protein, 20 aa, Homo sapiens
EITALAPSTMKIKIIAPPER

SEQ ID NO: 10127 - protein, 13 aa, Homo sapiens
EITALAPSTMKIK

SEQ ID NO: 10128 - protein, 13 aa, Homo sapiens
EITALAPSTMKIK

SEQ ID NO: 10129 - protein, 20 aa, Homo sapiens
EITALAPSTMKIKIIAPPER

SEQ ID NO: 10130 - protein, 12 aa, Homo sapiens
DSYVGDEAQSKR

SEQ ID NO: 10131 - protein, 23 aa, Homo sapiens
HQGVMVGMGQKDSYVGDEAQSKR

SEQ ID NO: 10132 - protein, 23 aa, Homo sapiens
HQGVMVGMGQKDSYVGDEAQSKR

SEQ ID NO: 10133 - protein, 23 aa, Homo sapiens
HQGVMVGMGQKDSYVGDEAQSKR

SEQ ID NO: 10134 - protein, 23 aa, Homo sapiens
HQGVMVGMGQKDSYVGDEAQSKR

SEQ ID NO: 10135 - protein, 23 aa, Homo sapiens
HQGVMVGMGQKDSYVGDEAQSKR

SEQ ID NO: 10136 - protein, 23 aa, Homo sapiens
HQGVMVGMGQKDSYVGDEAQSKR

SEQ ID NO: 10137 - protein, 23 aa, Homo sapiens
HQGVMVGMGQKDSYVGDEAQSKR

SEQ ID NO: 10138 - protein, 23 aa, Homo sapiens
HQGVMVGMGQKDSYVGDEAQSKR

SEQ ID NO: 10139 - protein, 23 aa, Homo sapiens
HQGVMVGMGQKDSYVGDEAQSKR

SEQ ID NO: 10140 - protein, 23 aa, Homo sapiens
HQGVMVGMGQKDSYVGDEAQSKR

SEQ ID NO: 10141 - protein, 23 aa, Homo sapiens
HQGVMVGMGQKDSYVGDEAQSKR

SEQ ID NO: 10142 - protein, 23 aa, Homo sapiens
HQGVMVGMGQKDSYVGDEAQSKR

SEQ ID NO: 10143 - protein, 22 aa, Homo sapiens
GILTLKYPIEHGIVTNWDDMEK

SEQ ID NO: 10144 - protein, 23 aa, Homo sapiens
HQGVMVGMGQKDSYVGDEAQSKR

SEQ ID NO: 10145 - protein, 23 aa, Homo sapiens
HQGVMVGMGQKDSYVGDEAQSKR

SEQ ID NO: 10146 - protein, 22 aa, Homo sapiens
GILTLKYPIEHGIVTNWDDMEK

SEQ ID NO: 10147 - protein, 23 aa, Homo sapiens
HQGVMVGMGQKDSYVGDEAQSKR

SEQ ID NO: 10148 - protein, 23 aa, Homo sapiens
HQGVMVGMGQKDSYVGDEAQSKR

SEQ ID NO: 10149 - protein, 23 aa, Homo sapiens
HQGVMVGMGQKDSYVGDEAQSKR

SEQ ID NO: 10150 - protein, 23 aa, Homo sapiens
HQGVMVGMGQKDSYVGDEAQSKR

SEQ ID NO: 10151 - protein, 23 aa, Homo sapiens
HQGVMVGMGQKDSYVGDEAQSKR

SEQ ID NO: 10152 - protein, 22 aa, Homo sapiens
GILTLKYPIEHGIVTNWDDMEK

SEQ ID NO: 10153 - protein, 23 aa, Homo sapiens
HQGVMVGMGQKDSYVGDEAQSKR

SEQ ID NO: 10154 - protein, 22 aa, Homo sapiens
GILTLKYPIEHGIVTNWDDMEK

SEQ ID NO: 10155 - protein, 22 aa, Homo sapiens
GILTLKYPIEHGIVTNWDDMEK

SEQ ID NO: 10156 - protein, 23 aa, Homo sapiens
HQGVMVGMGQKDSYVGDEAQSKR

SEQ ID NO: 10157 - protein, 23 aa, Homo sapiens
HQGVMVGMGQKDSYVGDEAQSKR

SEQ ID NO: 10158 - protein, 22 aa, Homo sapiens
GILTLKYPIEHGIVTNWDDMEK

SEQ ID NO: 10159 - protein, 22 aa, Homo sapiens
GILTLKYPIEHGIVTNWDDMEK

SEQ ID NO: 10160 - protein, 23 aa, Homo sapiens
HQGVMVGMGQKDSYVGDEAQSKR

SEQ ID NO: 10161 - protein, 23 aa, Homo sapiens
HQGVMVGMGQKDSYVGDEAQSKR

SEQ ID NO: 10162 - protein, 22 aa, Homo sapiens
GILTLKYPIEHGIVTNWDDMEK

SEQ ID NO: 10163 - protein, 23 aa, Homo sapiens
HQGVMVGMGQKDSYVGDEAQSKR

SEQ ID NO: 10164 - protein, 23 aa, Homo sapiens
HQGVMVGMGQKDSYVGDEAQSKR

SEQ ID NO: 10165 - protein, 22 aa, Homo sapiens
GILTLKYPIEHGIVTNWDDMEK

SEQ ID NO: 10166 - protein, 23 aa, Homo sapiens
HQGVMVGMGQKDSYVGDEAQSKR

SEQ ID NO: 10167 - protein, 23 aa, Homo sapiens
HQGVMVGMGQKDSYVGDEAQSKR

SEQ ID NO: 10168 - protein, 22 aa, Homo sapiens
GILTLKYPIEHGIVTNWDDMEK

SEQ ID NO: 10169 - protein, 23 aa, Homo sapiens
HQGVMVGMGQKDSYVGDEAQSKR

SEQ ID NO: 10170 - protein, 22 aa, Homo sapiens
GILTLKYPIEHGIVTNWDDMEK

SEQ ID NO: 10171 - protein, 22 aa, Homo sapiens
GILTLKYPIEHGIVTNWDDMEK

SEQ ID NO: 10172 - protein, 22 aa, Homo sapiens
GILTLKYPIEHGIVTNWDDMEK

SEQ ID NO: 10173 - protein, 23 aa, Homo sapiens
HQGVMVGMGQKDSYVGDEAQSKR

SEQ ID NO: 10174 - protein, 23 aa, Homo sapiens
HQGVMVGMGQKDSYVGDEAQSKR

SEQ ID NO: 10175 - protein, 22 aa, Homo sapiens
GILTLKYPIEHGIVTNWDDMEK

SEQ ID NO: 10176 - protein, 22 aa, Homo sapiens
GILTLKYPIEHGIVTNWDDMEK

SEQ ID NO: 10177 - protein, 23 aa, Homo sapiens
HQGVMVGMGQKDSYVGDEAQSKR

SEQ ID NO: 10178 - protein, 22 aa, Homo sapiens
GILTLKYPIEHGIVTNWDDMEK

SEQ ID NO: 10179 - protein, 22 aa, Homo sapiens
GILTLKYPIEHGIVTNWDDMEK

SEQ ID NO: 10180 - protein, 22 aa, Homo sapiens
GILTLKYPIEHGIVTNWDDMEK

SEQ ID NO: 10181 - protein, 22 aa, Homo sapiens
GILTLKYPIEHGIVTNWDDMEK

SEQ ID NO: 10182 - protein, 23 aa, Homo sapiens
HQGVMVGMGQKDSYVGDEAQSKR

SEQ ID NO: 10183 - protein, 23 aa, Homo sapiens
HQGVMVGMGQKDSYVGDEAQSKR

SEQ ID NO: 10184 - protein, 22 aa, Homo sapiens
GILTLKYPIEHGIVTNWDDMEK

SEQ ID NO: 10185 - protein, 22 aa, Homo sapiens
GILTLKYPIEHGIVTNWDDMEK

SEQ ID NO: 10186 - protein, 22 aa, Homo sapiens
GILTLKYPIEHGIVTNWDDMEK

SEQ ID NO: 10187 - protein, 22 aa, Homo sapiens
GILTLKYPIEHGIVTNWDDMEK

SEQ ID NO: 10188 - protein, 22 aa, Homo sapiens
GILTLKYPIEHGIVTNWDDMEK

SEQ ID NO: 10189 - protein, 22 aa, Homo sapiens
GILTLKYPIEHGIVTNWDDMEK

SEQ ID NO: 10190 - protein, 23 aa, Homo sapiens
HQGVMVGMGQKDSYVGDEAQSKR

SEQ ID NO: 10191 - protein, 22 aa, Homo sapiens
GILTLKYPIEHGIVTNWDDMEK

SEQ ID NO: 10192 - protein, 22 aa, Homo sapiens
GILTLKYPIEHGIVTNWDDMEK

SEQ ID NO: 10193 - protein, 22 aa, Homo sapiens
GILTLKYPIEHGIVTNWDDMEK

SEQ ID NO: 10194 - protein, 22 aa, Homo sapiens
GILTLKYPIEHGIVTNWDDMEK

SEQ ID NO: 10195 - protein, 22 aa, Homo sapiens
GILTLKYPIEHGIVTNWDDMEK

SEQ ID NO: 10196 - protein, 23 aa, Homo sapiens
HQGVMVGMGQKDSYVGDEAQSKR

SEQ ID NO: 10197 - protein, 22 aa, Homo sapiens
GILTLKYPIEHGIVTNWDDMEK

SEQ ID NO: 10198 - protein, 22 aa, Homo sapiens
GILTLKYPIEHGIVTNWDDMEK

SEQ ID NO: 10199 - protein, 14 aa, Homo sapiens
VTASSGITIPKPPK

SEQ ID NO: 10200 - protein, 14 aa, Homo sapiens
VTASSGITIPKPPK

SEQ ID NO: 10201 - protein, 14 aa, Homo sapiens
VTASSGITIPKPPK

SEQ ID NO: 10202 - protein, 14 aa, Homo sapiens
VTASSGITIPKPPK

SEQ ID NO: 10203 - protein, 11 aa, Homo sapiens
PPDKPLMPYMR

SEQ ID NO: 10204 - protein, 14 aa, Homo sapiens
VTASSGITIPKPPK

SEQ ID NO: 10205 - protein, 13 aa, Homo sapiens
VWDQVKASNPDLK

SEQ ID NO: 10206 - protein, 12 aa, Homo sapiens
KLEAELLQIEER

SEQ ID NO: 10207 - protein, 6 aa, Homo sapiens
HQEKKR

SEQ ID NO: 10208 - protein, 12 aa, Homo sapiens
KLEAELLQIEER

SEQ ID NO: 10209 - protein, 12 aa, Homo sapiens
KLEAELLQIEER

SEQ ID NO: 10210 - protein, 6 aa, Homo sapiens
MQVLKR

SEQ ID NO: 10211 - protein, 13 aa, Homo sapiens
LWEIGKIIGGMWR

SEQ ID NO: 10212 - protein, 13 aa, Homo sapiens
LWEIGKIIGGMWR

SEQ ID NO: 10213 - protein, 6 aa, Homo sapiens
MQVLKR

SEQ ID NO: 10214 - protein, 6 aa, Homo sapiens
MQVLKR

SEQ ID NO: 10215 - protein, 6 aa, Homo sapiens
MQVLKR

SEQ ID NO: 10216 - protein, 6 aa, Homo sapiens
KRQEER

SEQ ID NO: 10217 - protein, 12 aa, Homo sapiens
KLEAELLQIEER

SEQ ID NO: 10218 - protein, 12 aa, Homo sapiens
KLEAELLQIEER

SEQ ID NO: 10219 - protein, 12 aa, Homo sapiens
KLEAELLQIEER

SEQ ID NO: 10220 - protein, 6 aa, Homo sapiens
MQVLKR

SEQ ID NO: 10221 - protein, 14 aa, Homo sapiens
KFLESTDSFNNELK

SEQ ID NO: 10222 - protein, 18 aa, Homo sapiens
VTASSGITIPKPPKPPDK

SEQ ID NO: 10223 - protein, 17 aa, Homo sapiens
AYHNSPAYLAYINAKSR

SEQ ID NO: 10224 - protein, 17 aa, Homo sapiens
AYHNSPAYLAYINAKSR

SEQ ID NO: 10225 - protein, 17 aa, Homo sapiens
AYHNSPAYLAYINAKSR

SEQ ID NO: 10226 - protein, 17 aa, Homo sapiens
AYHNSPAYLAYINAKSR

SEQ ID NO: 10227 - protein, 23 aa, Homo sapiens
IEYNESMKAYHNSPAYLAYINAK

SEQ ID NO: 10228 - protein, 23 aa, Homo sapiens
IEYNESMKAYHNSPAYLAYINAK

SEQ ID NO: 10229 - protein, 25 aa, Homo sapiens
LCGLKVEVDMEKIAAEIAQAEEQAR

SEQ ID NO: 10230 - protein, 14 aa, Homo sapiens
FLESTDSFNNELKR

SEQ ID NO: 10231 - protein, 25 aa, Homo sapiens
LCGLKVEVDMEKIAAEIAQAEEQAR

SEQ ID NO: 10232 - protein, 12 aa, Homo sapiens
LCGLKVEVDMEK

SEQ ID NO: 10233 - protein, 25 aa, Homo sapiens
LCGLKVEVDMEKIAAEIAQAEEQAR

SEQ ID NO: 10234 - protein, 25 aa, Homo sapiens
LCGLKVEVDMEKIAAEIAQAEEQAR

SEQ ID NO: 10235 - protein, 12 aa, Homo sapiens
LCGLKVEVDMEK

SEQ ID NO: 10236 - protein, 15 aa, Homo sapiens
KFLESTDSFNNELKR

SEQ ID NO: 10237 - protein, 25 aa, Homo sapiens
LCGLKVEVDMEKIAAEIAQAEEQAR

SEQ ID NO: 10238 - protein, 25 aa, Homo sapiens
LCGLKVEVDMEKIAAEIAQAEEQAR

SEQ ID NO: 10239 - protein, 12 aa, Homo sapiens
LCGLKVEVDMEK

SEQ ID NO: 10240 - protein, 25 aa, Homo sapiens
LCGLKVEVDMEKIAAEIAQAEEQAR

SEQ ID NO: 10241 - protein, 12 aa, Homo sapiens
LCGLKVEVDMEK

SEQ ID NO: 10242 - protein, 25 aa, Homo sapiens
LCGLKVEVDMEKIAAEIAQAEEQAR

SEQ ID NO: 10243 - protein, 15 aa, Homo sapiens
KFLESTDSFNNELKR

SEQ ID NO: 10244 - protein, 14 aa, Homo sapiens
FLESTDSFNNELKR

SEQ ID NO: 10245 - protein, 12 aa, Homo sapiens
LCGLKVEVDMEK

SEQ ID NO: 10246 - protein, 25 aa, Homo sapiens
LCGLKVEVDMEKIAAEIAQAEEQAR

SEQ ID NO: 10247 - protein, 12 aa, Homo sapiens
LCGLKVEVDMEK

SEQ ID NO: 10248 - protein, 14 aa, Homo sapiens
FLESTDSFNNELKR

SEQ ID NO: 10249 - protein, 15 aa, Homo sapiens
KFLESTDSFNNELKR

SEQ ID NO: 10250 - protein, 14 aa, Homo sapiens
FLESTDSFNNELKR

SEQ ID NO: 10251 - protein, 14 aa, Homo sapiens
FLESTDSFNNELKR

SEQ ID NO: 10252 - protein, 12 aa, Homo sapiens
LCGLKVEVDMEK

SEQ ID NO: 10253 - protein, 12 aa, Homo sapiens
LCGLKVEVDMEK

SEQ ID NO: 10254 - protein, 15 aa, Homo sapiens
KFLESTDSFNNELKR

SEQ ID NO: 10255 - protein, 14 aa, Homo sapiens
FLESTDSFNNELKR

SEQ ID NO: 10256 - protein, 12 aa, Homo sapiens
LCGLKVEVDMEK

SEQ ID NO: 10257 - protein, 12 aa, Homo sapiens
LCGLKVEVDMEK

SEQ ID NO: 10258 - protein, 12 aa, Homo sapiens
LCGLKVEVDMEK

SEQ ID NO: 10259 - protein, 15 aa, Homo sapiens
KFLESTDSFNNELKR

SEQ ID NO: 10260 - protein, 25 aa, Homo sapiens
LCGLKVEVDMEKIAAEIAQAEEQAR

SEQ ID NO: 10261 - protein, 12 aa, Homo sapiens
LCGLKVEVDMEK

SEQ ID NO: 10262 - protein, 12 aa, Homo sapiens
LCGLKVEVDMEK

SEQ ID NO: 10263 - protein, 14 aa, Homo sapiens
FLESTDSFNNELKR

SEQ ID NO: 10264 - protein, 15 aa, Homo sapiens
KFLESTDSFNNELKR

SEQ ID NO: 10265 - protein, 25 aa, Homo sapiens
LCGLKVEVDMEKIAAEIAQAEEQAR

SEQ ID NO: 10266 - protein, 12 aa, Homo sapiens
LCGLKVEVDMEK

SEQ ID NO: 10267 - protein, 12 aa, Homo sapiens
LCGLKVEVDMEK

SEQ ID NO: 10268 - protein, 15 aa, Homo sapiens
KFLESTDSFNNELKR

SEQ ID NO: 10269 - protein, 14 aa, Homo sapiens
FLESTDSFNNELKR

SEQ ID NO: 10270 - protein, 12 aa, Homo sapiens
LCGLKVEVDMEK

SEQ ID NO: 10271 - protein, 12 aa, Homo sapiens
LCGLKVEVDMEK

SEQ ID NO: 10272 - protein, 12 aa, Homo sapiens
LCGLKVEVDMEK

SEQ ID NO: 10273 - protein, 12 aa, Homo sapiens
LCGLKVEVDMEK

SEQ ID NO: 10274 - protein, 12 aa, Homo sapiens
LCGLKVEVDMEK

SEQ ID NO: 10275 - protein, 15 aa, Homo sapiens
KFLESTDSFNNELKR

SEQ ID NO: 10276 - protein, 12 aa, Homo sapiens
LCGLKVEVDMEK

SEQ ID NO: 10277 - protein, 15 aa, Homo sapiens
KFLESTDSFNNELKR

SEQ ID NO: 10278 - protein, 12 aa, Homo sapiens
LCGLKVEVDMEK

SEQ ID NO: 10279 - protein, 12 aa, Homo sapiens
LCGLKVEVDMEK

SEQ ID NO: 10280 - protein, 12 aa, Homo sapiens
LCGLKVEVDMEK

SEQ ID NO: 10281 - protein, 12 aa, Homo sapiens
LCGLKVEVDMEK

SEQ ID NO: 10282 - protein, 12 aa, Homo sapiens
LCGLKVEVDMEK

SEQ ID NO: 10283 - protein, 12 aa, Homo sapiens
LCGLKVEVDMEK

SEQ ID NO: 10284 - protein, 12 aa, Homo sapiens
LCGLKVEVDMEK

SEQ ID NO: 10285 - protein, 14 aa, Homo sapiens
FLESTDSFNNELKR

SEQ ID NO: 10286 - protein, 15 aa, Homo sapiens
KFLESTDSFNNELKR

SEQ ID NO: 10287 - protein, 20 aa, Homo sapiens
VEVDMEKIAAEIAQAEEQAR

SEQ ID NO: 10288 - protein, 20 aa, Homo sapiens
VEVDMEKIAAEIAQAEEQAR

SEQ ID NO: 10289 - protein, 20 aa, Homo sapiens
VEVDMEKIAAEIAQAEEQAR

SEQ ID NO: 10290 - protein, 14 aa, Homo sapiens
QEEREKEAAEQAER

SEQ ID NO: 10291 - protein, 14 aa, Homo sapiens
QEEREKEAAEQAER

SEQ ID NO: 10292 - protein, 6 aa, Homo sapiens
MQVLKR

SEQ ID NO: 10293 - protein, 10 aa, Homo sapiens
EKEAAEQAER

SEQ ID NO: 10294 - protein, 10 aa, Homo sapiens
EKEAAEQAER

SEQ ID NO: 10295 - protein, 10 aa, Homo sapiens
EKEAAEQAER

SEQ ID NO: 10296 - protein, 14 aa, Homo sapiens
FLESTDSFNNELKR

SEQ ID NO: 10297 - protein, 6 aa, Homo sapiens
HQEKKR

SEQ ID NO: 10298 - protein, 6 aa, Homo sapiens
HQEKKR

SEQ ID NO: 10299 - protein, 15 aa, Homo sapiens
KFLESTDSFNNELKR

SEQ ID NO: 10300 - protein, 15 aa, Homo sapiens
KFLESTDSFNNELKR

SEQ ID NO: 10301 - protein, 6 aa, Homo sapiens
HQEKKR

SEQ ID NO: 10302 - protein, 5 aa, Homo sapiens
HQEKK

SEQ ID NO: 10303 - protein, 6 aa, Homo sapiens
HQEKKR

SEQ ID NO: 10304 - protein, 6 aa, Homo sapiens
HQEKKR

SEQ ID NO: 10305 - protein, 15 aa, Homo sapiens
KFLESTDSFNNELKR

SEQ ID NO: 10306 - protein, 15 aa, Homo sapiens
KFLESTDSFNNELKR

SEQ ID NO: 10307 - protein, 6 aa, Homo sapiens
HQEKKR

SEQ ID NO: 10308 - protein, 14 aa, Homo sapiens
KFLESTDSFNNELK

SEQ ID NO: 10309 - protein, 15 aa, Homo sapiens
KFLESTDSFNNELKR

SEQ ID NO: 10310 - protein, 15 aa, Homo sapiens
KFLESTDSFNNELKR

SEQ ID NO: 10311 - protein, 6 aa, Homo sapiens
HQEKKR

SEQ ID NO: 10312 - protein, 15 aa, Homo sapiens
KFLESTDSFNNELKR

SEQ ID NO: 10313 - protein, 15 aa, Homo sapiens
KFLESTDSFNNELKR

SEQ ID NO: 10314 - protein, 15 aa, Homo sapiens
KFLESTDSFNNELKR

SEQ ID NO: 10315 - protein, 15 aa, Homo sapiens
KFLESTDSFNNELKR

SEQ ID NO: 10316 - protein, 15 aa, Homo sapiens
KFLESTDSFNNELKR

SEQ ID NO: 10317 - protein, 15 aa, Homo sapiens
KFLESTDSFNNELKR

SEQ ID NO: 10318 - protein, 6 aa, Homo sapiens
HQEKKR

SEQ ID NO: 10319 - protein, 14 aa, Homo sapiens
QEEREKEAAEQAER

SEQ ID NO: 10320 - protein, 14 aa, Homo sapiens
QEEREKEAAEQAER

SEQ ID NO: 10321 - protein, 25 aa, Homo sapiens
LCGLKVEVDMEKIAAEIAQAEEQAR

SEQ ID NO: 10322 - protein, 14 aa, Homo sapiens
QEEREKEAAEQAER

SEQ ID NO: 10323 - protein, 14 aa, Homo sapiens
QEEREKEAAEQAER

SEQ ID NO: 10324 - protein, 6 aa, Homo sapiens
KPVDFK

SEQ ID NO: 10325 - protein, 6 aa, Homo sapiens
KPVDFK

SEQ ID NO: 10326 - protein, 6 aa, Homo sapiens
KPVDFK

SEQ ID NO: 10327 - protein, 5 aa, Homo sapiens
NHKYR

SEQ ID NO: 10328 - protein, 7 aa, Homo sapiens
IRNHKYR

SEQ ID NO: 10329 - protein, 7 aa, Homo sapiens
IRNHKYR

SEQ ID NO: 10330 - protein, 7 aa, Homo sapiens
IRNHKYR

SEQ ID NO: 10331 - protein, 7 aa, Homo sapiens
IRNHKYR

SEQ ID NO: 10332 - protein, 5 aa, Homo sapiens
NHKYR

SEQ ID NO: 10333 - protein, 7 aa, Homo sapiens
IRNHKYR

SEQ ID NO: 10334 - protein, 7 aa, Homo sapiens
IRNHKYR

SEQ ID NO: 10335 - protein, 6 aa, Homo sapiens
KPVDFK

SEQ ID NO: 10336 - protein, 7 aa, Homo sapiens
IRNHKYR

SEQ ID NO: 10337 - protein, 7 aa, Homo sapiens
IRNHKYR

SEQ ID NO: 10338 - protein, 7 aa, Homo sapiens
IRNHKYR

SEQ ID NO: 10339 - protein, 4 aa, Homo sapiens
IKER

SEQ ID NO: 10340 - protein, 5 aa, Homo sapiens
IEKER

SEQ ID NO: 10341 - protein, 5 aa, Homo sapiens
IEKER

SEQ ID NO: 10342 - protein, 5 aa, Homo sapiens
IEKER

SEQ ID NO: 10343 - protein, 5 aa, Homo sapiens
IEKER

SEQ ID NO: 10344 - protein, 7 aa, Homo sapiens
KLIDQKK

SEQ ID NO: 10345 - protein, 5 aa, Homo sapiens
IEKER

SEQ ID NO: 10346 - protein, 20 aa, Homo sapiens
LMEEDELPSWIIKDDAEVER

SEQ ID NO: 10347 - protein, 20 aa, Homo sapiens
LMEEDELPSWIIKDDAEVER

SEQ ID NO: 10348 - protein, 11 aa, Homo sapiens
KELPEYYELIR

SEQ ID NO: 10349 - protein, 13 aa, Homo sapiens
LTCEEEEEKIFGR

SEQ ID NO: 10350 - protein, 13 aa, Homo sapiens
LTCEEEEEKIFGR

SEQ ID NO: 10351 - protein, 11 aa, Homo sapiens
KELPEYYELIR

SEQ ID NO: 10352 - protein, 20 aa, Homo sapiens
LMEEDELPSWIIKDDAEVER

SEQ ID NO: 10353 - protein, 13 aa, Homo sapiens
LTCEEEEEKIFGR

SEQ ID NO: 10354 - protein, 13 aa, Homo sapiens
LTCEEEEEKIFGR

SEQ ID NO: 10355 - protein, 13 aa, Homo sapiens
LTCEEEEEKIFGR

SEQ ID NO: 10356 - protein, 13 aa, Homo sapiens
LTCEEEEEKIFGR

SEQ ID NO: 10357 - protein, 13 aa, Homo sapiens
LTCEEEEEKIFGR

SEQ ID NO: 10358 - protein, 13 aa, Homo sapiens
LTCEEEEEKIFGR

SEQ ID NO: 10359 - protein, 13 aa, Homo sapiens
LTCEEEEEKIFGR

SEQ ID NO: 10360 - protein, 13 aa, Homo sapiens
LTCEEEEEKIFGR

SEQ ID NO: 10361 - protein, 13 aa, Homo sapiens
LTCEEEEEKIFGR

SEQ ID NO: 10362 - protein, 13 aa, Homo sapiens
LTCEEEEEKIFGR

SEQ ID NO: 10363 - protein, 13 aa, Homo sapiens
LTCEEEEEKIFGR

SEQ ID NO: 10364 - protein, 13 aa, Homo sapiens
LTCEEEEEKIFGR

SEQ ID NO: 10365 - protein, 13 aa, Homo sapiens
LTCEEEEEKIFGR

SEQ ID NO: 10366 - protein, 16 aa, Homo sapiens
VIQAGMFDQKSSSHER

SEQ ID NO: 10367 - protein, 11 aa, Homo sapiens
KELPEYYELIR

SEQ ID NO: 10368 - protein, 16 aa, Homo sapiens
HQEYLNSILQHAKDFK

SEQ ID NO: 10369 - protein, 16 aa, Homo sapiens
HQEYLNSILQHAKDFK

SEQ ID NO: 10370 - protein, 6 aa, Homo sapiens
LIDQKK

SEQ ID NO: 10371 - protein, 7 aa, Homo sapiens
KLIDQKK

SEQ ID NO: 10372 - protein, 8 aa, Homo sapiens
EQKKETER

SEQ ID NO: 10373 - protein, 15 aa, Homo sapiens
AVATWHANTEREQKK

SEQ ID NO: 10374 - protein, 15 aa, Homo sapiens
AVATWHANTEREQKK

SEQ ID NO: 10375 - protein, 15 aa, Homo sapiens
AVATWHANTEREQKK

SEQ ID NO: 10376 - protein, 15 aa, Homo sapiens
DVDYSDALTEKQWLR

SEQ ID NO: 10377 - protein, 10 aa, Homo sapiens
ISYKGTPAMR

SEQ ID NO: 10378 - protein, 10 aa, Homo sapiens
ISYKGTPAMR

SEQ ID NO: 10379 - protein, 18 aa, Homo sapiens
NHHCKLTQVLNTHYVAPR

SEQ ID NO: 10380 - protein, 18 aa, Homo sapiens
NHHCKLTQVLNTHYVAPR

SEQ ID NO: 10381 - protein, 18 aa, Homo sapiens
NHHCKLTQVLNTHYVAPR

SEQ ID NO: 10382 - protein, 18 aa, Homo sapiens
NHHCKLTQVLNTHYVAPR

SEQ ID NO: 10383 - protein, 20 aa, Homo sapiens
MKNHHCKLTQVLNTHYVAPR

SEQ ID NO: 10384 - protein, 18 aa, Homo sapiens
NHHCKLTQVLNTHYVAPR

SEQ ID NO: 10385 - protein, 9 aa, Homo sapiens
DKHILAKIR

SEQ ID NO: 10386 - protein, 20 aa, Homo sapiens
MKNHHCKLTQVLNTHYVAPR

SEQ ID NO: 10387 - protein, 9 aa, Homo sapiens
DKHILAKIR

SEQ ID NO: 10388 - protein, 18 aa, Homo sapiens
NHHCKLTQVLNTHYVAPR

SEQ ID NO: 10389 - protein, 9 aa, Homo sapiens
DKHILAKIR

SEQ ID NO: 10390 - protein, 9 aa, Homo sapiens
DKHILAKIR

SEQ ID NO: 10391 - protein, 18 aa, Homo sapiens
NHHCKLTQVLNTHYVAPR

SEQ ID NO: 10392 - protein, 7 aa, Homo sapiens
DKHILAK

SEQ ID NO: 10393 - protein, 9 aa, Homo sapiens
DKHILAKIR

SEQ ID NO: 10394 - protein, 9 aa, Homo sapiens
DKHILAKIR

SEQ ID NO: 10395 - protein, 7 aa, Homo sapiens
DKHILAK

SEQ ID NO: 10396 - protein, 9 aa, Homo sapiens
DKHILAKIR

SEQ ID NO: 10397 - protein, 7 aa, Homo sapiens
DKHILAK

SEQ ID NO: 10398 - protein, 7 aa, Homo sapiens
DKHILAK

SEQ ID NO: 10399 - protein, 9 aa, Homo sapiens
DKHILAKIR

SEQ ID NO: 10400 - protein, 7 aa, Homo sapiens
DKHILAK

SEQ ID NO: 10401 - protein, 7 aa, Homo sapiens
DKHILAK

SEQ ID NO: 10402 - protein, 7 aa, Homo sapiens
DKHILAK

SEQ ID NO: 10403 - protein, 7 aa, Homo sapiens
DKHILAK

SEQ ID NO: 10404 - protein, 9 aa, Homo sapiens
DKHILAKIR

SEQ ID NO: 10405 - protein, 7 aa, Homo sapiens
DKHILAK

SEQ ID NO: 10406 - protein, 20 aa, Homo sapiens
MKNHHCKLTQVLNTHYVAPR

SEQ ID NO: 10407 - protein, 9 aa, Homo sapiens
DKHILAKIR

SEQ ID NO: 10408 - protein, 7 aa, Homo sapiens
DKHILAK

SEQ ID NO: 10409 - protein, 7 aa, Homo sapiens
DKHILAK

SEQ ID NO: 10410 - protein, 9 aa, Homo sapiens
DKHILAKIR

SEQ ID NO: 10411 - protein, 8 aa, Homo sapiens
SVAGKIQK

SEQ ID NO: 10412 - protein, 16 aa, Homo sapiens
LCTVNSVEEKILAAAK

SEQ ID NO: 10413 - protein, 16 aa, Homo sapiens
LCTVNSVEEKILAAAK

SEQ ID NO: 10414 - protein, 10 aa, Homo sapiens
ISYKGTPAMR

SEQ ID NO: 10415 - protein, 16 aa, Homo sapiens
SGKFNVLLTTYEYIIK

SEQ ID NO: 10416 - protein, 16 aa, Homo sapiens
SGKFNVLLTTYEYIIK

SEQ ID NO: 10417 - protein, 11 aa, Homo sapiens
WKYMIVDEGHR

SEQ ID NO: 10418 - protein, 16 aa, Homo sapiens
ILLDPNSEEVSEKDAK

SEQ ID NO: 10419 - protein, 16 aa, Homo sapiens
ILLDPNSEEVSEKDAK

SEQ ID NO: 10420 - protein, 16 aa, Homo sapiens
ILLDPNSEEVSEKDAK

SEQ ID NO: 10421 - protein, 16 aa, Homo sapiens
ILLDPNSEEVSEKDAK

SEQ ID NO: 10422 - protein, 16 aa, Homo sapiens
ILLDPNSEEVSEKDAK

SEQ ID NO: 10423 - protein, 16 aa, Homo sapiens
ILLDPNSEEVSEKDAK

SEQ ID NO: 10424 - protein, 16 aa, Homo sapiens
ILLDPNSEEVSEKDAK

SEQ ID NO: 10425 - protein, 16 aa, Homo sapiens
ILLDPNSEEVSEKDAK

SEQ ID NO: 10426 - protein, 16 aa, Homo sapiens
ILLDPNSEEVSEKDAK

SEQ ID NO: 10427 - protein, 21 aa, Homo sapiens
QIIETAKQDVDDEYSMQYSAR

SEQ ID NO: 10428 - protein, 16 aa, Homo sapiens
ILLDPNSEEVSEKDAK

SEQ ID NO: 10429 - protein, 21 aa, Homo sapiens
QIIETAKQDVDDEYSMQYSAR

SEQ ID NO: 10430 - protein, 21 aa, Homo sapiens
QIIETAKQDVDDEYSMQYSAR

SEQ ID NO: 10431 - protein, 21 aa, Homo sapiens
QIIETAKQDVDDEYSMQYSAR

SEQ ID NO: 10432 - protein, 21 aa, Homo sapiens
QIIETAKQDVDDEYSMQYSAR

SEQ ID NO: 10433 - protein, 21 aa, Homo sapiens
QIIETAKQDVDDEYSMQYSAR

SEQ ID NO: 10434 - protein, 5 aa, Homo sapiens
IEKER

SEQ ID NO: 10435 - protein, 8 aa, Homo sapiens
LIDQKKDR

SEQ ID NO: 10436 - protein, 8 aa, Homo sapiens
LIDQKKDR

SEQ ID NO: 10437 - protein, 11 aa, Homo sapiens
KELPEYYELIR

SEQ ID NO: 10438 - protein, 11 aa, Homo sapiens
KELPEYYELIR

SEQ ID NO: 10439 - protein, 11 aa, Homo sapiens
KELPEYYELIR

SEQ ID NO: 10440 - protein, 11 aa, Homo sapiens
KELPEYYELIR

SEQ ID NO: 10441 - protein, 11 aa, Homo sapiens
KELPEYYELIR

SEQ ID NO: 10442 - protein, 11 aa, Homo sapiens
KELPEYYELIR

SEQ ID NO: 10443 - protein, 11 aa, Homo sapiens
KELPEYYELIR

SEQ ID NO: 10444 - protein, 11 aa, Homo sapiens
KELPEYYELIR

SEQ ID NO: 10445 - protein, 11 aa, Homo sapiens
KELPEYYELIR

SEQ ID NO: 10446 - protein, 11 aa, Homo sapiens
KELPEYYELIR

SEQ ID NO: 10447 - protein, 11 aa, Homo sapiens
KELPEYYELIR

SEQ ID NO: 10448 - protein, 11 aa, Homo sapiens
KELPEYYELIR

SEQ ID NO: 10449 - protein, 5 aa, Homo sapiens
NHKYR

SEQ ID NO: 10450 - protein, 15 aa, Homo sapiens
DVDYSDALTEKQWLR

SEQ ID NO: 10451 - protein, 7 aa, Homo sapiens
IRNHKYR

SEQ ID NO: 10452 - protein, 10 aa, Homo sapiens
ISYKGTPAMR

SEQ ID NO: 10453 - protein, 13 aa, Homo sapiens
LTCEEEEEKIFGR

SEQ ID NO: 10454 - protein, 6 aa, Homo sapiens
ILPKLR

SEQ ID NO: 10455 - protein, 10 aa, Homo sapiens
ASGKFELLDR

SEQ ID NO: 10456 - protein, 16 aa, Homo sapiens
VIQAGMFDQKSSSHER

SEQ ID NO: 10457 - protein, 16 aa, Homo sapiens
VIQAGMFDQKSSSHER

SEQ ID NO: 10458 - protein, 8 aa, Homo sapiens
YKLNVDQK

SEQ ID NO: 10459 - protein, 16 aa, Homo sapiens
VIQAGMFDQKSSSHER

SEQ ID NO: 10460 - protein, 17 aa, Homo sapiens
VIQAGMFDQKSSSHERR

SEQ ID NO: 10461 - protein, 14 aa, Homo sapiens
ILAAAKYKLNVDQK

SEQ ID NO: 10462 - protein, 17 aa, Homo sapiens
VIQAGMFDQKSSSHERR

SEQ ID NO: 10463 - protein, 16 aa, Homo sapiens
VIQAGMFDQKSSSHER

SEQ ID NO: 10464 - protein, 14 aa, Homo sapiens
ILAAAKYKLNVDQK

SEQ ID NO: 10465 - protein, 8 aa, Homo sapiens
YKLNVDQK

SEQ ID NO: 10466 - protein, 17 aa, Homo sapiens
VIQAGMFDQKSSSHERR

SEQ ID NO: 10467 - protein, 8 aa, Homo sapiens
YKLNVDQK

SEQ ID NO: 10468 - protein, 8 aa, Homo sapiens
YKLNVDQK

SEQ ID NO: 10469 - protein, 17 aa, Homo sapiens
VIQAGMFDQKSSSHERR

SEQ ID NO: 10470 - protein, 17 aa, Homo sapiens
VIQAGMFDQKSSSHERR

SEQ ID NO: 10471 - protein, 16 aa, Homo sapiens
VIQAGMFDQKSSSHER

SEQ ID NO: 10472 - protein, 11 aa, Homo sapiens
KELPEYYELIR

SEQ ID NO: 10473 - protein, 5 aa, Homo sapiens
KIKER

SEQ ID NO: 10474 - protein, 5 aa, Homo sapiens
KIKER

SEQ ID NO: 10475 - protein, 5 aa, Homo sapiens
NHKYR

SEQ ID NO: 10476 - protein, 5 aa, Homo sapiens
NHKYR

SEQ ID NO: 10477 - protein, 5 aa, Homo sapiens
NHKYR

SEQ ID NO: 10478 - protein, 5 aa, Homo sapiens
NHKYR

SEQ ID NO: 10479 - protein, 11 aa, Homo sapiens
LHKVLRPFLLR

SEQ ID NO: 10480 - protein, 11 aa, Homo sapiens
LHKVLRPFLLR

SEQ ID NO: 10481 - protein, 11 aa, Homo sapiens
LHKVLRPFLLR

SEQ ID NO: 10482 - protein, 6 aa, Homo sapiens
LIDQKK

SEQ ID NO: 10483 - protein, 11 aa, Homo sapiens
LHKVLRPFLLR

SEQ ID NO: 10484 - protein, 16 aa, Homo sapiens
TIQTIALITYLMEHKR

SEQ ID NO: 10485 - protein, 16 aa, Homo sapiens
TIQTIALITYLMEHKR

SEQ ID NO: 10486 - protein, 16 aa, Homo sapiens
TIQTIALITYLMEHKR

SEQ ID NO: 10487 - protein, 16 aa, Homo sapiens
TIQTIALITYLMEHKR

SEQ ID NO: 10488 - protein, 11 aa, Homo sapiens
WKYMIVDEGHR

SEQ ID NO: 10489 - protein, 11 aa, Homo sapiens
WKYMIVDEGHR

SEQ ID NO: 10490 - protein, 11 aa, Homo sapiens
WKYMIVDEGHR

SEQ ID NO: 10491 - protein, 11 aa, Homo sapiens
WKYMIVDEGHR

SEQ ID NO: 10492 - protein, 11 aa, Homo sapiens
WKYMIVDEGHR

SEQ ID NO: 10493 - protein, 11 aa, Homo sapiens
WKYMIVDEGHR

SEQ ID NO: 10494 - protein, 16 aa, Homo sapiens
RMPTTQETDGFQVKRP

SEQ ID NO: 10495 - protein, 16 aa, Homo sapiens
RMPTTQETDGFQVKRP

SEQ ID NO: 10496 - protein, 16 aa, Homo sapiens
RMPTTQETDGFQVKRP

SEQ ID NO: 10497 - protein, 25 aa, Homo sapiens
KRPGDLNVKCTLLLMLDHQPPQYKL

SEQ ID NO: 10498 - protein, 25 aa, Homo sapiens
KRPGDLNVKCTLLLMLDHQPPQYKL

SEQ ID NO: 10499 - protein, 25 aa, Homo sapiens
KRPGDLNVKCTLLLMLDHQPPQYKL

SEQ ID NO: 10500 - protein, 16 aa, Homo sapiens
RMPTTQETDGFQVKRP

SEQ ID NO: 10501 - protein, 25 aa, Homo sapiens
KRPGDLNVKCTLLLMLDHQPPQYKL

SEQ ID NO: 10502 - protein, 25 aa, Homo sapiens
KRPGDLNVKCTLLLMLDHQPPQYKL

SEQ ID NO: 10503 - protein, 25 aa, Homo sapiens
KRPGDLNVKCTLLLMLDHQPPQYKL

SEQ ID NO: 10504 - protein, 25 aa, Homo sapiens
KRPGDLNVKCTLLLMLDHQPPQYKL

SEQ ID NO: 10505 - protein, 16 aa, Homo sapiens
RMPTTQETDGFQVKRP

SEQ ID NO: 10506 - protein, 25 aa, Homo sapiens
KRPGDLNVKCTLLLMLDHQPPQYKL

SEQ ID NO: 10507 - protein, 25 aa, Homo sapiens
KRPGDLNVKCTLLLMLDHQPPQYKL

SEQ ID NO: 10508 - protein, 16 aa, Homo sapiens
RMPTTQETDGFQVKRP

SEQ ID NO: 10509 - protein, 23 aa, Homo sapiens
RMPTTQETDGFQVKRPGDLNVKC

SEQ ID NO: 10510 - protein, 23 aa, Homo sapiens
RMPTTQETDGFQVKRPGDLNVKC

SEQ ID NO: 10511 - protein, 28 aa, Homo sapiens
KLAGLLQHPDPIVINHVISVDPNDQKKT

SEQ ID NO: 10512 - protein, 17 aa, Homo sapiens
KIHETIESINQLKTQRD

SEQ ID NO: 10513 - protein, 11 aa, Homo sapiens
RHIFAKVQQRR

SEQ ID NO: 10514 - protein, 8 aa, Homo sapiens
KPLTQKRK

SEQ ID NO: 10515 - protein, 9 aa, Homo sapiens
KPLTQKRKL

SEQ ID NO: 10516 - protein, 8 aa, Homo sapiens
KPLTQKRK

SEQ ID NO: 10517 - protein, 8 aa, Homo sapiens
KPLTQKRK

SEQ ID NO: 10518 - protein, 8 aa, Homo sapiens
KPLTQKRK

SEQ ID NO: 10519 - protein, 8 aa, Homo sapiens
KPLTQKRK

SEQ ID NO: 10520 - protein, 8 aa, Homo sapiens
KPLTQKRK

SEQ ID NO: 10521 - protein, 9 aa, Homo sapiens
KPLTQKRKL

SEQ ID NO: 10522 - protein, 9 aa, Homo sapiens
KKPLTQKRK

SEQ ID NO: 10523 - protein, 16 aa, Homo sapiens
RMEIQEAIKKPLTQKR

SEQ ID NO: 10524 - protein, 9 aa, Homo sapiens
KKPLTQKRK

SEQ ID NO: 10525 - protein, 9 aa, Homo sapiens
KKPLTQKRK

SEQ ID NO: 10526 - protein, 12 aa, Homo sapiens
KRMEIQEAIKKP

SEQ ID NO: 10527 - protein, 23 aa, Homo sapiens
RMPTTQETDGFQVKRPGDLNVKC

SEQ ID NO: 10528 - protein, 23 aa, Homo sapiens
RMPTTQETDGFQVKRPGDLNVKC

SEQ ID NO: 10529 - protein, 23 aa, Homo sapiens
RMPTTQETDGFQVKRPGDLNVKC

SEQ ID NO: 10530 - protein, 23 aa, Homo sapiens
RMPTTQETDGFQVKRPGDLNVKC

SEQ ID NO: 10531 - protein, 23 aa, Homo sapiens
RMPTTQETDGFQVKRPGDLNVKC

SEQ ID NO: 10532 - protein, 23 aa, Homo sapiens
RMPTTQETDGFQVKRPGDLNVKC

SEQ ID NO: 10533 - protein, 23 aa, Homo sapiens
RMPTTQETDGFQVKRPGDLNVKC

SEQ ID NO: 10534 - protein, 23 aa, Homo sapiens
RMPTTQETDGFQVKRPGDLNVKC

SEQ ID NO: 10535 - protein, 11 aa, Homo sapiens
RHIFAKVQQRR

SEQ ID NO: 10536 - protein, 23 aa, Homo sapiens
RMPTTQETDGFQVKRPGDLNVKC

SEQ ID NO: 10537 - protein, 23 aa, Homo sapiens
RMPTTQETDGFQVKRPGDLNVKC

SEQ ID NO: 10538 - protein, 23 aa, Homo sapiens
RMPTTQETDGFQVKRPGDLNVKC

SEQ ID NO: 10539 - protein, 13 aa, Homo sapiens
RVEGKLLDDPSKQ

SEQ ID NO: 10540 - protein, 13 aa, Homo sapiens
RVEGKLLDDPSKQ

SEQ ID NO: 10541 - protein, 35 aa, Homo sapiens
RFSEIPMKLAGLLQHPDPIVINHVISVDPNDQKKT

SEQ ID NO: 10542 - protein, 35 aa, Homo sapiens; identical to SEQ ID NO: 10541

SEQ ID NO: 10543 - protein, 10 aa, Homo sapiens
RKLDQTIARK

SEQ ID NO: 10544 - protein, 10 aa, Homo sapiens
RKLDQTIARK

SEQ ID NO: 10545 - protein, 17 aa, Homo sapiens
RVASAAAKSALEEFSKM

SEQ ID NO: 10546 - protein, 17 aa, Homo sapiens
RVASAAAKSALEEFSKM

SEQ ID NO: 10547 - protein, 17 aa, Homo sapiens
RVASAAAKSALEEFSKM

SEQ ID NO: 10548 - protein, 33 aa, Homo sapiens; identical to SEQ ID NO: 284

SEQ ID NO: 10549 - protein, 33 aa, Homo sapiens; identical to SEQ ID NO: 284

SEQ ID NO: 10550 - protein, 17 aa, Homo sapiens
RVASAAAKSALEEFSKM

SEQ ID NO: 10551 - protein, 17 aa, Homo sapiens
RVASAAAKSALEEFSKM

SEQ ID NO: 10552 - protein, 33 aa, Homo sapiens; identical to SEQ ID NO: 284

SEQ ID NO: 10553 - protein, 17 aa, Homo sapiens
RVASAAAKSALEEFSKM

SEQ ID NO: 10554 - protein, 17 aa, Homo sapiens
RVASAAAKSALEEFSKM

SEQ ID NO: 10555 - protein, 11 aa, Homo sapiens
KKDSESAPVKG

SEQ ID NO: 10556 - protein, 13 aa, Homo sapiens
KKYIQAEPPTNKS

SEQ ID NO: 10557 - protein, 7 aa, Homo sapiens
KTKVERD

SEQ ID NO: 10558 - protein, 12 aa, Homo sapiens
KAKHLAAVEERK

SEQ ID NO: 10559 - protein, 12 aa, Homo sapiens
KAKHLAAVEERK

SEQ ID NO: 10560 - protein, 12 aa, Homo sapiens
KAKHLAAVEERK

SEQ ID NO: 10561 - protein, 8 aa, Homo sapiens
RKTKVERD

SEQ ID NO: 10562 - protein, 7 aa, Homo sapiens
KTKVERD

SEQ ID NO: 10563 - protein, 7 aa, Homo sapiens
KTKVERD

SEQ ID NO: 10564 - protein, 21 aa, Homo sapiens
KTPQQTSASQQMLNFPDKGKE

SEQ ID NO: 10565 - protein, 21 aa, Homo sapiens
KTPQQTSASQQMLNFPDKGKE

SEQ ID NO: 10566 - protein, 14 aa, Homo sapiens
KEKPTDMQNFGLRT

SEQ ID NO: 10567 - protein, 21 aa, Homo sapiens
KTPQQTSASQQMLNFPDKGKE

SEQ ID NO: 10568 - protein, 21 aa, Homo sapiens
KTPQQTSASQQMLNFPDKGKE

SEQ ID NO: 10569 - protein, 21 aa, Homo sapiens
KTPQQTSASQQMLNFPDKGKE

SEQ ID NO: 10570 - protein, 14 aa, Homo sapiens
KEKPTDMQNFGLRT

SEQ ID NO: 10571 - protein, 14 aa, Homo sapiens
RTDMYTKKNVPSKS

SEQ ID NO: 10572 - protein, 14 aa, Homo sapiens
RTDMYTKKNVPSKS

SEQ ID NO: 10573 - protein, 8 aa, Homo sapiens
KKNVPSKS

SEQ ID NO: 10574 - protein, 8 aa, Homo sapiens
KKNVPSKS

SEQ ID NO: 10575 - protein, 8 aa, Homo sapiens
KKNVPSKS

SEQ ID NO: 10576 - protein, 8 aa, Homo sapiens
KKNVPSKS

SEQ ID NO: 10577 - protein, 8 aa, Homo sapiens
KKNVPSKS

SEQ ID NO: 10578 - protein, 8 aa, Homo sapiens
RKTKVERD

SEQ ID NO: 10579 - protein, 17 aa, Homo sapiens
RVASAAAKSALEEFSKM

SEQ ID NO: 10580 - protein, 8 aa, Homo sapiens
RKTKVERD

SEQ ID NO: 10581 - protein, 8 aa, Homo sapiens
RKTKVERD

SEQ ID NO: 10582 - protein, 17 aa, Homo sapiens
RVASAAAKSALEEFSKM

SEQ ID NO: 10583 - protein, 17 aa, Homo sapiens
RVASAAAKSALEEFSKM

SEQ ID NO: 10584 - protein, 17 aa, Homo sapiens
KMKEEVPTALVEAHVRK

SEQ ID NO: 10585 - protein, 17 aa, Homo sapiens
RVASAAAKSALEEFSKM

SEQ ID NO: 10586 - protein, 17 aa, Homo sapiens
KMKEEVPTALVEAHVRK

SEQ ID NO: 10587 - protein, 17 aa, Homo sapiens
RVASAAAKSALEEFSKM

SEQ ID NO: 10588 - protein, 17 aa, Homo sapiens
RVASAAAKSALEEFSKM

SEQ ID NO: 10589 - protein, 17 aa, Homo sapiens
KMKEEVPTALVEAHVRK

SEQ ID NO: 10590 - protein, 17 aa, Homo sapiens
RVASAAAKSALEEFSKM

SEQ ID NO: 10591 - protein, 17 aa, Homo sapiens
KMKEEVPTALVEAHVRK

SEQ ID NO: 10592 - protein, 17 aa, Homo sapiens
KMKEEVPTALVEAHVRK

SEQ ID NO: 10593 - protein, 17 aa, Homo sapiens
KMKEEVPTALVEAHVRK

SEQ ID NO: 10594 - protein, 12 aa, Homo sapiens
KAKHLAAVEERK

SEQ ID NO: 10595 - protein, 12 aa, Homo sapiens
KAKHLAAVEERK

SEQ ID NO: 10596 - protein, 12 aa, Homo sapiens
KAKHLAAVEERK

SEQ ID NO: 10597 - protein, 12 aa, Homo sapiens
KAKHLAAVEERK

SEQ ID NO: 10598 - protein, 12 aa, Homo sapiens
KAKHLAAVEERK

SEQ ID NO: 10599 - protein, 12 aa, Homo sapiens
KAKHLAAVEERK

SEQ ID NO: 10600 - protein, 12 aa, Homo sapiens
KAKHLAAVEERK

SEQ ID NO: 10601 - protein, 12 aa, Homo sapiens
KAKHLAAVEERK

SEQ ID NO: 10602 - protein, 12 aa, Homo sapiens
KAKHLAAVEERK

SEQ ID NO: 10603 - protein, 17 aa, Homo sapiens
RVASAAAKSALEEFSKM

SEQ ID NO: 10604 - protein, 17 aa, Homo sapiens
RVASAAAKSALEEFSKM

SEQ ID NO: 10605 - protein, 17 aa, Homo sapiens
RVASAAAKSALEEFSKM

SEQ ID NO: 10606 - protein, 17 aa, Homo sapiens
RVASAAAKSALEEFSKM

SEQ ID NO: 10607 - protein, 17 aa, Homo sapiens
RVASAAAKSALEEFSKM

SEQ ID NO: 10608 - protein, 17 aa, Homo sapiens
RVASAAAKSALEEFSKM

SEQ ID NO: 10609 - protein, 17 aa, Homo sapiens
RVASAAAKSALEEFSKM

SEQ ID NO: 10610 - protein, 17 aa, Homo sapiens
RVASAAAKSALEEFSKM

SEQ ID NO: 10611 - protein, 17 aa, Homo sapiens
RVASAAAKSALEEFSKM

SEQ ID NO: 10612 - protein, 25 aa, Homo sapiens
KSALEEFSKMKEEVPTALVEAHVRK

SEQ ID NO: 10613 - protein, 25 aa, Homo sapiens
KSALEEFSKMKEEVPTALVEAHVRK

SEQ ID NO: 10614 - protein, 25 aa, Homo sapiens
KSALEEFSKMKEEVPTALVEAHVRK

SEQ ID NO: 10615 - protein, 25 aa, Homo sapiens
KSALEEFSKMKEEVPTALVEAHVRK

SEQ ID NO: 10616 - protein, 25 aa, Homo sapiens
KSALEEFSKMKEEVPTALVEAHVRK

SEQ ID NO: 10617 - protein, 17 aa, Homo sapiens
RVASAAAKSALEEFSKM

SEQ ID NO: 10618 - protein, 17 aa, Homo sapiens
RVASAAAKSALEEFSKM

SEQ ID NO: 10619 - protein, 17 aa, Homo sapiens
RVASAAAKSALEEFSKM

SEQ ID NO: 10620 - protein, 9 aa, Homo sapiens
RKVEEAAKV

SEQ ID NO: 10621 - protein, 9 aa, Homo sapiens
RKVEEAAKV

SEQ ID NO: 10622 - protein, 8 aa, Homo sapiens
RKTKVERD

SEQ ID NO: 10623 - protein, 8 aa, Homo sapiens
RKTKVERD

SEQ ID NO: 10624 - protein, 14 aa, Homo sapiens
RTDMYTKKNVPSKS

SEQ ID NO: 10625 - protein, 9 aa, Homo sapiens
RKVEEAAKV

SEQ ID NO: 10626 - protein, 8 aa, Homo sapiens
RKTKVERD

SEQ ID NO: 10627 - protein, 22 aa, Homo sapiens
KEPKEGQEEVLKEVVESEGERK

SEQ ID NO: 10628 - protein, 22 aa, Homo sapiens
KEPKEGQEEVLKEVVESEGERK

SEQ ID NO: 10629 - protein, 22 aa, Homo sapiens
KEPKEGQEEVLKEVVESEGERK

SEQ ID NO: 10630 - protein, 17 aa, Homo sapiens
RKIKSLVALLVETQMKK

SEQ ID NO: 10631 - protein, 17 aa, Homo sapiens
RKIKSLVALLVETQMKK

SEQ ID NO: 10632 - protein, 17 aa, Homo sapiens
RKIKSLVALLVETQMKK

SEQ ID NO: 10633 - protein, 17 aa, Homo sapiens
RKIKSLVALLVETQMKK

SEQ ID NO: 10634 - protein, 12 aa, Homo sapiens
KAKHLAAVEERK

SEQ ID NO: 10635 - protein, 17 aa, Homo sapiens
RKIKSLVALLVETQMKK

SEQ ID NO: 10636 - protein, 17 aa, Homo sapiens
RKIKSLVALLVETQMKK

SEQ ID NO: 10637 - protein, 17 aa, Homo sapiens
RKIKSLVALLVETQMKK

SEQ ID NO: 10638 - protein, 17 aa, Homo sapiens
RKIKSLVALLVETQMKK

SEQ ID NO: 10639 - protein, 12 aa, Homo sapiens
KAKHLAAVEERK

SEQ ID NO: 10640 - protein, 12 aa, Homo sapiens
KAKHLAAVEERK

SEQ ID NO: 10641 - protein, 17 aa, Homo sapiens
RKIKSLVALLVETQMKK

SEQ ID NO: 10642 - protein, 17 aa, Homo sapiens
RKIKSLVALLVETQMKK

SEQ ID NO: 10643 - protein, 12 aa, Homo sapiens
KAKHLAAVEERK

SEQ ID NO: 10644 - protein, 17 aa, Homo sapiens
RKIKSLVALLVETQMKK

SEQ ID NO: 10645 - protein, 17 aa, Homo sapiens
RKIKSLVALLVETQMKK

SEQ ID NO: 10646 - protein, 12 aa, Homo sapiens
KAKHLAAVEERK

SEQ ID NO: 10647 - protein, 17 aa, Homo sapiens
RKIKSLVALLVETQMKK

SEQ ID NO: 10648 - protein, 12 aa, Homo sapiens
KAKHLAAVEERK

SEQ ID NO: 10649 - protein, 17 aa, Homo sapiens
RKIKSLVALLVETQMKK

SEQ ID NO: 10650 - protein, 17 aa, Homo sapiens
RKIKSLVALLVETQMKK

SEQ ID NO: 10651 - protein, 17 aa, Homo sapiens
RKIKSLVALLVETQMKK

SEQ ID NO: 10652 - protein, 17 aa, Homo sapiens
RKIKSLVALLVETQMKK

SEQ ID NO: 10653 - protein, 17 aa, Homo sapiens
RKIKSLVALLVETQMKK

SEQ ID NO: 10654 - protein, 17 aa, Homo sapiens
RKIKSLVALLVETQMKK

SEQ ID NO: 10655 - protein, 12 aa, Homo sapiens
KAKHLAAVEERK

SEQ ID NO: 10656 - protein, 17 aa, Homo sapiens
RKIKSLVALLVETQMKK

SEQ ID NO: 10657 - protein, 11 aa, Homo sapiens
KKDSESAPVKG

SEQ ID NO: 10658 - protein, 11 aa, Homo sapiens
RKKDGGPNVKY

SEQ ID NO: 10659 - protein, 9 aa, Homo sapiens
KNVPSKSKA

SEQ ID NO: 10660 - protein, 13 aa, Homo sapiens
RKVEEAAKVTGKA

SEQ ID NO: 10661 - protein, 14 aa, Homo sapiens
RTDMYTKKNVPSKS

SEQ ID NO: 10662 - protein, 16 aa, Homo sapiens
KNVPSKSKAAASATRE

SEQ ID NO: 10663 - protein, 16 aa, Homo sapiens
KNVPSKSKAAASATRE

SEQ ID NO: 10664 - protein, 14 aa, Homo sapiens
RTDMYTKKNVPSKS

SEQ ID NO: 10665 - protein, 14 aa, Homo sapiens
RTDMYTKKNVPSKS

SEQ ID NO: 10666 - protein, 14 aa, Homo sapiens
RTDMYTKKNVPSKS

SEQ ID NO: 10667 - protein, 14 aa, Homo sapiens
RTDMYTKKNVPSKS

SEQ ID NO: 10668 - protein, 9 aa, Homo sapiens
RTDMYTKKN

SEQ ID NO: 10669 - protein, 14 aa, Homo sapiens
RTDMYTKKNVPSKS

SEQ ID NO: 10670 - protein, 14 aa, Homo sapiens
RTDMYTKKNVPSKS

SEQ ID NO: 10671 - protein, 9 aa, Homo sapiens
RTDMYTKKN

SEQ ID NO: 10672 - protein, 9 aa, Homo sapiens
RTDMYTKKN

SEQ ID NO: 10673 - protein, 14 aa, Homo sapiens
RTDMYTKKNVPSKS

SEQ ID NO: 10674 - protein, 8 aa, Homo sapiens
KEPKEPRE

SEQ ID NO: 10675 - protein, 8 aa, Homo sapiens
KEPKEPRE

SEQ ID NO: 10676 - protein, 8 aa, Homo sapiens
KEPKEPRE

SEQ ID NO: 10677 - protein, 8 aa, Homo sapiens
KEPKEPRE

SEQ ID NO: 10678 - protein, 12 aa, Homo sapiens
RVEGQATDEKKE

SEQ ID NO: 10679 - protein, 11 aa, Homo sapiens
KSKAAASATRE

SEQ ID NO: 10680 - protein, 11 aa, Homo sapiens
KSKAAASATRE

SEQ ID NO: 10681 - protein, 17 aa, Homo sapiens
KMKEEVPTALVEAHVRK

SEQ ID NO: 10682 - protein, 8 aa, Homo sapiens
RKTKVERD

SEQ ID NO: 10683 - protein, 8 aa, Homo sapiens
RKTKVERD

SEQ ID NO: 10684 - protein, 8 aa, Homo sapiens
RKTKVERD

SEQ ID NO: 10685 - protein, 9 aa, Homo sapiens
RKVEEAAKV

SEQ ID NO: 10686 - protein, 10 aa, Homo sapiens
KKDGGPNVKY

SEQ ID NO: 10687 - protein, 11 aa, Homo sapiens
RKKDGGPNVKY

SEQ ID NO: 10688 - protein, 10 aa, Homo sapiens
KKDGGPNVKY

SEQ ID NO: 10689 - protein, 11 aa, Homo sapiens
RKKDGGPNVKY

SEQ ID NO: 10690 - protein, 11 aa, Homo sapiens
RKKDGGPNVKY

SEQ ID NO: 10691 - protein, 16 aa, Homo sapiens
KTVNTKKDSESAPVKG

SEQ ID NO: 10692 - protein, 32 aa, Homo sapiens; identical to SEQ ID NO: 5995

SEQ ID NO: 10693 - protein, 16 aa, Homo sapiens
KTVNTKKDSESAPVKG

SEQ ID NO: 10694 - protein, 32 aa, Homo sapiens; identical to SEQ ID NO: 5995

SEQ ID NO: 10695 - protein, 16 aa, Homo sapiens
KTVNTKKDSESAPVKG

SEQ ID NO: 10696 - protein, 16 aa, Homo sapiens
KTVNTKKDSESAPVKG

SEQ ID NO: 10697 - protein, 32 aa, Homo sapiens; identical to SEQ ID NO: 5995

SEQ ID NO: 10698 - protein, 16 aa, Homo sapiens
KTVNTKKDSESAPVKG

SEQ ID NO: 10699 - protein, 16 aa, Homo sapiens
KTVNTKKDSESAPVKG

SEQ ID NO: 10700 - protein, 9 aa, Homo sapiens
KKDEEKGKE

SEQ ID NO: 10701 - protein, 9 aa, Homo sapiens
KKDEEKGKE

SEQ ID NO: 10702 - protein, 9 aa, Homo sapiens
KKDEEKGKE

SEQ ID NO: 10703 - protein, 21 aa, Homo sapiens
REGGGAIEEEAKEKTSEAPKK

SEQ ID NO: 10704 - protein, 8 aa, Homo sapiens
RKTKVERD

SEQ ID NO: 10705 - protein, 9 aa, Homo sapiens
KNVPSKSKA

SEQ ID NO: 10706 - protein, 22 aa, Homo sapiens
KEPKEGQEEVLKEVVESEGERK

SEQ ID NO: 10707 - protein, 22 aa, Homo sapiens
KEPKEGQEEVLKEVVESEGERK

SEQ ID NO: 10708 - protein, 22 aa, Homo sapiens
KEPKEGQEEVLKEVVESEGERK

SEQ ID NO: 10709 - protein, 7 aa, Homo sapiens
RKVHAKW

SEQ ID NO: 10710 - protein, 7 aa, Homo sapiens
RKVHAKW

SEQ ID NO: 10711 - protein, 7 aa, Homo sapiens
RKVHAKW

SEQ ID NO: 10712 - protein, 7 aa, Homo sapiens
RKVHAKW

SEQ ID NO: 10713 - protein, 8 aa, Homo sapiens
RKTKVERD

SEQ ID NO: 10714 - protein, 19 aa, Homo sapiens
KEGQEEVLKEVVESEGERK

SEQ ID NO: 10715 - protein, 19 aa, Homo sapiens
KEGQEEVLKEVVESEGERK

SEQ ID NO: 10716 - protein, 19 aa, Homo sapiens
KEGQEEVLKEVVESEGERK

SEQ ID NO: 10717 - protein, 8 aa, Homo sapiens
RKTKVERD

SEQ ID NO: 10718 - protein, 19 aa, Homo sapiens
KEGQEEVLKEVVESEGERK

SEQ ID NO: 10719 - protein, 8 aa, Homo sapiens
RKTKVERD

SEQ ID NO: 10720 - protein, 8 aa, Homo sapiens
RKTKVERD

SEQ ID NO: 10721 - protein, 19 aa, Homo sapiens
KEGQEEVLKEVVESEGERK

SEQ ID NO: 10722 - protein, 8 aa, Homo sapiens
RKTKVERD

SEQ ID NO: 10723 - protein, 8 aa, Homo sapiens
RKTKVERD

SEQ ID NO: 10724 - protein, 8 aa, Homo sapiens
RKTKVERD

SEQ ID NO: 10725 - protein, 19 aa, Homo sapiens
KEGQEEVLKEVVESEGERK

SEQ ID NO: 10726 - protein, 19 aa, Homo sapiens
KEGQEEVLKEVVESEGERK

SEQ ID NO: 10727 - protein, 8 aa, Homo sapiens
RKTKVERD

SEQ ID NO: 10728 - protein, 8 aa, Homo sapiens
RKTKVERD

SEQ ID NO: 10729 - protein, 20 aa, Homo sapiens
KEGQEEVLKEVVESEGERKT

SEQ ID NO: 10730 - protein, 8 aa, Homo sapiens
RKTKVERD

SEQ ID NO: 10731 - protein, 8 aa, Homo sapiens
RKTKVERD

SEQ ID NO: 10732 - protein, 8 aa, Homo sapiens
RKTKVERD

SEQ ID NO: 10733 - protein, 19 aa, Homo sapiens
KEGQEEVLKEVVESEGERK

SEQ ID NO: 10734 - protein, 8 aa, Homo sapiens
RKTKVERD

SEQ ID NO: 10735 - protein, 8 aa, Homo sapiens
RKTKVERD

SEQ ID NO: 10736 - protein, 8 aa, Homo sapiens
RKTKVERD

SEQ ID NO: 10737 - protein, 8 aa, Homo sapiens
RKTKVERD

SEQ ID NO: 10738 - protein, 8 aa, Homo sapiens
RKTKVERD

SEQ ID NO: 10739 - protein, 19 aa, Homo sapiens
KEGQEEVLKEVVESEGERK

SEQ ID NO: 10740 - protein, 19 aa, Homo sapiens
KEGQEEVLKEVVESEGERK

SEQ ID NO: 10741 - protein, 19 aa, Homo sapiens
KEGQEEVLKEVVESEGERK

SEQ ID NO: 10742 - protein, 19 aa, Homo sapiens
KEGQEEVLKEVVESEGERK

SEQ ID NO: 10743 - protein, 8 aa, Homo sapiens
RKTKVERD

SEQ ID NO: 10744 - protein, 8 aa, Homo sapiens
RKTKVERD

SEQ ID NO: 10745 - protein, 13 aa, Homo sapiens
RKVEEAAKVTGKA

SEQ ID NO: 10746 - protein, 13 aa, Homo sapiens
RKVEEAAKVTGKA

SEQ ID NO: 10747 - protein, 8 aa, Homo sapiens
RKTKVERD

SEQ ID NO: 10748 - protein, 13 aa, Homo sapiens
RKVEEAAKVTGKA

SEQ ID NO: 10749 - protein, 13 aa, Homo sapiens
RKVEEAAKVTGKA

SEQ ID NO: 10750 - protein, 13 aa, Homo sapiens
RKVEEAAKVTGKA

SEQ ID NO: 10751 - protein, 8 aa, Homo sapiens
RKTKVERD

SEQ ID NO: 10752 - protein, 8 aa, Homo sapiens
RKTKVERD

SEQ ID NO: 10753 - protein, 8 aa, Homo sapiens
RKTKVERD

SEQ ID NO: 10754 - protein, 8 aa, Homo sapiens
RKTKVERD

SEQ ID NO: 10755 - protein, 8 aa, Homo sapiens
RKTKVERD

SEQ ID NO: 10756 - protein, 8 aa, Homo sapiens
RKTKVERD

SEQ ID NO: 10757 - protein, 13 aa, Homo sapiens
RKVEEAAKVTGKA

SEQ ID NO: 10758 - protein, 13 aa, Homo sapiens
RKVEEAAKVTGKA

SEQ ID NO: 10759 - protein, 13 aa, Homo sapiens
RKVEEAAKVTGKA

SEQ ID NO: 10760 - protein, 13 aa, Homo sapiens
RKVEEAAKVTGKA

SEQ ID NO: 10761 - protein, 13 aa, Homo sapiens
RKVEEAAKVTGKA

SEQ ID NO: 10762 - protein, 7 aa, Homo sapiens
KTKVERD

SEQ ID NO: 10763 - protein, 13 aa, Homo sapiens
RKVEEAAKVTGKA

SEQ ID NO: 10764 - protein, 8 aa, Homo sapiens
RKTKVERD

SEQ ID NO: 10765 - protein, 7 aa, Homo sapiens
KTKVERD

SEQ ID NO: 10766 - protein, 13 aa, Homo sapiens
RKVEEAAKVTGKA

SEQ ID NO: 10767 - protein, 7 aa, Homo sapiens
KTKVERD

SEQ ID NO: 10768 - protein, 7 aa, Homo sapiens
KTKVERD

SEQ ID NO: 10769 - protein, 8 aa, Homo sapiens
RKTKVERD

SEQ ID NO: 10770 - protein, 8 aa, Homo sapiens
RKTKVERD

SEQ ID NO: 10771 - protein, 8 aa, Homo sapiens
RKTKVERD

SEQ ID NO: 10772 - protein, 8 aa, Homo sapiens
RKTKVERD

SEQ ID NO: 10773 - protein, 8 aa, Homo sapiens
RKTKVERD

SEQ ID NO: 10774 - protein, 8 aa, Homo sapiens
RKTKVERD

SEQ ID NO: 10775 - protein, 8 aa, Homo sapiens
RKTKVERD

SEQ ID NO: 10776 - protein, 8 aa, Homo sapiens
RKTKVERD

SEQ ID NO: 10777 - protein, 20 aa, Homo sapiens
KISAKTLTDEVNSPDSDRRD

SEQ ID NO: 10778 - protein, 8 aa, Homo sapiens
KKGGNYKK

SEQ ID NO: 10779 - protein, 8 aa, Homo sapiens
KKGGNYKK

SEQ ID NO: 10780 - protein, 10 aa, Homo sapiens
RDKKGGNYKK

SEQ ID NO: 10781 - protein, 20 aa, Homo sapiens
KISAKTLTDEVNSPDSDRRD

SEQ ID NO: 10782 - protein, 20 aa, Homo sapiens
KISAKTLTDEVNSPDSDRRD

SEQ ID NO: 10783 - protein, 11 aa, Homo sapiens
RKKDGGPNVKY

SEQ ID NO: 10784 - protein, 11 aa, Homo sapiens
RKKDGGPNVKY

SEQ ID NO: 10785 - protein, 11 aa, Homo sapiens
RKKDGGPNVKY

SEQ ID NO: 10786 - protein, 20 aa, Homo sapiens
KISAKTLTDEVNSPDSDRRD

SEQ ID NO: 10787 - protein, 11 aa, Homo sapiens
RKKDGGPNVKY

SEQ ID NO: 10788 - protein, 11 aa, Homo sapiens
RKKDGGPNVKY

SEQ ID NO: 10789 - protein, 11 aa, Homo sapiens
RKKDGGPNVKY

SEQ ID NO: 10790 - protein, 11 aa, Homo sapiens
RKKDGGPNVKY

SEQ ID NO: 10791 - protein, 11 aa, Homo sapiens
RKKDGGPNVKY

SEQ ID NO: 10792 - protein, 36 aa, Homo sapiens; identical to SEQ ID NO: 6097

SEQ ID NO: 10793 - protein, 7 aa, Homo sapiens
RKVHAKW

SEQ ID NO: 10794 - protein, 7 aa, Homo sapiens
RKVHAKW

SEQ ID NO: 10795 - protein, 7 aa, Homo sapiens
RKVHAKW

SEQ ID NO: 10796 - protein, 7 aa, Homo sapiens
RKVHAKW

SEQ ID NO: 10797 - protein, 7 aa, Homo sapiens
RKVHAKW

SEQ ID NO: 10798 - protein, 19 aa, Homo sapiens
RVASAAAKSALEEFSKMKE

SEQ ID NO: 10799 - protein, 7 aa, Homo sapiens
KTKVERD

SEQ ID NO: 10800 - protein, 25 aa, Homo sapiens
KSALEEFSKMKEEVPTALVEAHVRK

SEQ ID NO: 10801 - protein, 12 aa, Homo sapiens
KAKHLAAVEERK

SEQ ID NO: 10802 - protein, 25 aa, Homo sapiens
KSALEEFSKMKEEVPTALVEAHVRK

SEQ ID NO: 10803 - protein, 8 aa, Homo sapiens
RKTKVERD

SEQ ID NO: 10804 - protein, 8 aa, Homo sapiens
RKTKVERD

SEQ ID NO: 10805 - protein, 9 aa, Homo sapiens
RKVEEAAKV

SEQ ID NO: 10806 - protein, 9 aa, Homo sapiens
RKVEEAAKV

SEQ ID NO: 10807 - protein, 9 aa, Homo sapiens
RKVEEAAKV

SEQ ID NO: 10808 - protein, 9 aa, Homo sapiens
KLKDIIKRH

SEQ ID NO: 10809 - protein, 9 aa, Homo sapiens
KLKDIIKRH

SEQ ID NO: 10810 - protein, 9 aa, Homo sapiens
KLKDIIKRH

SEQ ID NO: 10811 - protein, 28 aa, Homo sapiens
KSLVQNNCLSRPNIFLCPEIEPKLLGKL

SEQ ID NO: 10812 - protein, 9 aa, Homo sapiens
KLKDIIKRH

SEQ ID NO: 10813 - protein, 9 aa, Homo sapiens
KLKDIIKRH

SEQ ID NO: 10814 - protein, 8 aa, Homo sapiens
KLKDIIKR

SEQ ID NO: 10815 - protein, 9 aa, Homo sapiens
KLKDIIKRH

SEQ ID NO: 10816 - protein, 9 aa, Homo sapiens
KLKDIIKRH

SEQ ID NO: 10817 - protein, 11 aa, Homo sapiens
RKKDGGPNVKY

SEQ ID NO: 10818 - protein, 11 aa, Homo sapiens
RKKDGGPNVKY

SEQ ID NO: 10819 - protein, 11 aa, Homo sapiens
RKKDGGPNVKY

SEQ ID NO: 10820 - protein, 11 aa, Homo sapiens
RKKDGGPNVKY

SEQ ID NO: 10821 - protein, 11 aa, Homo sapiens
RKKDGGPNVKY

SEQ ID NO: 10822 - protein, 30 aa, Homo sapiens; identical to SEQ ID NO: 5990

SEQ ID NO: 10823 - protein, 11 aa, Homo sapiens
RKKDGGPNVKY

SEQ ID NO: 10824 - protein, 9 aa, Homo sapiens
KTSEAPKKD

SEQ ID NO: 10825 - protein, 14 aa, Homo sapiens
KDEEKGKEGDSEKE

SEQ ID NO: 10826 - protein, 11 aa, Homo sapiens
RLWLGKNYKKY

SEQ ID NO: 10827 - protein, 7 aa, Homo sapiens
RKVHAKW

SEQ ID NO: 10828 - protein, 8 aa, Homo sapiens
RKTKVERD

SEQ ID NO: 10829 - protein, 8 aa, Homo sapiens
RKTKVERD

SEQ ID NO: 10830 - protein, 7 aa, Homo sapiens
KTKVERD

SEQ ID NO: 10831 - protein, 8 aa, Homo sapiens
RKTKVERD

SEQ ID NO: 10832 - protein, 7 aa, Homo sapiens
KTKVERD

SEQ ID NO: 10833 - protein, 7 aa, Homo sapiens
KTKVERD

SEQ ID NO: 10834 - protein, 7 aa, Homo sapiens
KTKVERD

SEQ ID NO: 10835 - protein, 8 aa, Homo sapiens
RKTKVERD

SEQ ID NO: 10836 - protein, 8 aa, Homo sapiens
RKTKVERD

SEQ ID NO: 10837 - protein, 38 aa, Homo sapiens; identical to SEQ ID NO: 6132

SEQ ID NO: 10838 - protein, 8 aa, Homo sapiens
RKTKVERD

SEQ ID NO: 10839 - protein, 7 aa, Homo sapiens
KTKVERD

SEQ ID NO: 10840 - protein, 7 aa, Homo sapiens
KTKVERD

SEQ ID NO: 10841 - protein, 7 aa, Homo sapiens
KTKVERD

SEQ ID NO: 10842 - protein, 13 aa, Homo sapiens
KKYIQAEPPTNKS

SEQ ID NO: 10843 - protein, 13 aa, Homo sapiens
KKYIQAEPPTNKS

SEQ ID NO: 10844 - protein, 7 aa, Homo sapiens
KTKVERD

SEQ ID NO: 10845 - protein, 7 aa, Homo sapiens
KTKVERD

SEQ ID NO: 10846 - protein, 7 aa, Homo sapiens
KTKVERD

SEQ ID NO: 10847 - protein, 8 aa, Homo sapiens
RKTKVERD

SEQ ID NO: 10848 - protein, 17 aa, Homo sapiens
KMKEEVPTALVEAHVRK

SEQ ID NO: 10849 - protein, 7 aa, Homo sapiens
KTKVERD

SEQ ID NO: 10850 - protein, 8 aa, Homo sapiens
RKTKVERD

SEQ ID NO: 10851 - protein, 8 aa, Homo sapiens
RKTKVERD

SEQ ID NO: 10852 - protein, 7 aa, Homo sapiens
KTKVERD

SEQ ID NO: 10853 - protein, 7 aa, Homo sapiens
KTKVERD

SEQ ID NO: 10854 - protein, 12 aa, Homo sapiens
KAKHLAAVEERK

SEQ ID NO: 10855 - protein, 17 aa, Homo sapiens
KMKEEVPTALVEAHVRK

SEQ ID NO: 10856 - protein, 12 aa, Homo sapiens
KAKHLAAVEERK

SEQ ID NO: 10857 - protein, 17 aa, Homo sapiens
KMKEEVPTALVEAHVRK

SEQ ID NO: 10858 - protein, 12 aa, Homo sapiens
KAKHLAAVEERK

SEQ ID NO: 10859 - protein, 12 aa, Homo sapiens
KAKHLAAVEERK

SEQ ID NO: 10860 - protein, 12 aa, Homo sapiens
KAKHLAAVEERK

SEQ ID NO: 10861 - protein, 17 aa, Homo sapiens
KMKEEVPTALVEAHVRK

SEQ ID NO: 10862 - protein, 12 aa, Homo sapiens
KAKHLAAVEERK

SEQ ID NO: 10863 - protein, 17 aa, Homo sapiens
KMKEEVPTALVEAHVRK

SEQ ID NO: 10864 - protein, 12 aa, Homo sapiens
KAKHLAAVEERK

SEQ ID NO: 10865 - protein, 12 aa, Homo sapiens
KAKHLAAVEERK

SEQ ID NO: 10866 - protein, 17 aa, Homo sapiens
KMKEEVPTALVEAHVRK

SEQ ID NO: 10867 - protein, 17 aa, Homo sapiens
KMKEEVPTALVEAHVRK

SEQ ID NO: 10868 - protein, 13 aa, Homo sapiens
KAKHLAAVEERKI

SEQ ID NO: 10869 - protein, 13 aa, Homo sapiens
RKVEEAAKVTGKA

SEQ ID NO: 10870 - protein, 8 aa, Homo sapiens
RKTKVERD

SEQ ID NO: 10871 - protein, 8 aa, Homo sapiens
RKTKVERD

SEQ ID NO: 10872 - protein, 17 aa, Homo sapiens
KMKEEVPTALVEAHVRK

SEQ ID NO: 10873 - protein, 8 aa, Homo sapiens
RKTKVERD

SEQ ID NO: 10874 - protein, 8 aa, Homo sapiens
RKTKVERD

SEQ ID NO: 10875 - protein, 8 aa, Homo sapiens
RKTKVERD

SEQ ID NO: 10876 - protein, 8 aa, Homo sapiens
RKTKVERD

SEQ ID NO: 10877 - protein, 8 aa, Homo sapiens
RKTKVERD

SEQ ID NO: 10878 - protein, 17 aa, Homo sapiens
RKIKSLVALLVETQMKK

SEQ ID NO: 10879 - protein, 17 aa, Homo sapiens
RKIKSLVALLVETQMKK

SEQ ID NO: 10880 - protein, 17 aa, Homo sapiens
RKIKSLVALLVETQMKK

SEQ ID NO: 10881 - protein, 17 aa, Homo sapiens
RKIKSLVALLVETQMKK

SEQ ID NO: 10882 - protein, 17 aa, Homo sapiens
KMKEEVPTALVEAHVRK

SEQ ID NO: 10883 - protein, 17 aa, Homo sapiens
KMKEEVPTALVEAHVRK

SEQ ID NO: 10884 - protein, 9 aa, Homo sapiens
RKVEEAAKV

SEQ ID NO: 10885 - protein, 9 aa, Homo sapiens
RKVEEAAKV

SEQ ID NO: 10886 - protein, 9 aa, Homo sapiens
RKVEEAAKV

SEQ ID NO: 10887 - protein, 9 aa, Homo sapiens
RKVEEAAKV

SEQ ID NO: 10888 - protein, 17 aa, Homo sapiens
KMKEEVPTALVEAHVRK

SEQ ID NO: 10889 - protein, 9 aa, Homo sapiens
RKVEEAAKV

SEQ ID NO: 10890 - protein, 9 aa, Homo sapiens
RKVEEAAKV

SEQ ID NO: 10891 - protein, 17 aa, Homo sapiens
KMKEEVPTALVEAHVRK

SEQ ID NO: 10892 - protein, 17 aa, Homo sapiens
KMKEEVPTALVEAHVRK

SEQ ID NO: 10893 - protein, 9 aa, Homo sapiens
RKVEEAAKV

SEQ ID NO: 10894 - protein, 9 aa, Homo sapiens
RKVEEAAKV

SEQ ID NO: 10895 - protein, 9 aa, Homo sapiens
RKVEEAAKV

SEQ ID NO: 10896 - protein, 17 aa, Homo sapiens
KMKEEVPTALVEAHVRK

SEQ ID NO: 10897 - protein, 9 aa, Homo sapiens
RKVEEAAKV

SEQ ID NO: 10898 - protein, 12 aa, Homo sapiens
KLPIKCFLDFKA

SEQ ID NO: 10899 - protein, 12 aa, Homo sapiens
KLPIKCFLDFKA

SEQ ID NO: 10900 - protein, 12 aa, Homo sapiens
KLPIKCFLDFKA

SEQ ID NO: 10901 - protein, 12 aa, Homo sapiens
KLPIKCFLDFKA

SEQ ID NO: 10902 - protein, 12 aa, Homo sapiens
KLPIKCFLDFKA

SEQ ID NO: 10903 - protein, 12 aa, Homo sapiens
KLPIKCFLDFKA

SEQ ID NO: 10904 - protein, 12 aa, Homo sapiens
KLPIKCFLDFKA

SEQ ID NO: 10905 - protein, 9 aa, Homo sapiens
RKVEEAAKV

SEQ ID NO: 10906 - protein, 8 aa, Homo sapiens
RKTKVERD

SEQ ID NO: 10907 - protein, 8 aa, Homo sapiens
RKTKVERD

SEQ ID NO: 10908 - protein, 8 aa, Homo sapiens
RKTKVERD

SEQ ID NO: 10909 - protein, 8 aa, Homo sapiens
RKTKVERD

SEQ ID NO: 10910 - protein, 8 aa, Homo sapiens
RKTKVERD

SEQ ID NO: 10911 - protein, 9 aa, Homo sapiens
RKVEEAAKV

SEQ ID NO: 10912 - protein, 9 aa, Homo sapiens
RKVEEAAKV

SEQ ID NO: 10913 - protein, 9 aa, Homo sapiens
RKVEEAAKV

SEQ ID NO: 10914 - protein, 9 aa, Homo sapiens
RKVEEAAKV

SEQ ID NO: 10915 - protein, 38 aa, Homo sapiens; identical to SEQ ID NO: 6132

SEQ ID NO: 10916 - protein, 9 aa, Homo sapiens
RKVEEAAKV

SEQ ID NO: 10917 - protein, 8 aa, Homo sapiens
RKTKVERD

SEQ ID NO: 10918 - protein, 8 aa, Homo sapiens
RKTKVERD

SEQ ID NO: 10919 - protein, 8 aa, Homo sapiens
RKTKVERD

SEQ ID NO: 10920 - protein, 8 aa, Homo sapiens
RKTKVERD

SEQ ID NO: 10921 - protein, 8 aa, Homo sapiens
RKTKVERD

SEQ ID NO: 10922 - protein, 18 aa, Homo sapiens
RLLEDSALSKYDATKQKR

SEQ ID NO: 10923 - protein, 18 aa, Homo sapiens
RLLEDSALSKYDATKQKR

SEQ ID NO: 10924 - protein, 18 aa, Homo sapiens
RLLEDSALSKYDATKQKR

SEQ ID NO: 10925 - protein, 18 aa, Homo sapiens
RLLEDSALSKYDATKQKR

SEQ ID NO: 10926 - protein, 10 aa, Homo sapiens
KYDATKQKRK

SEQ ID NO: 10927 - protein, 12 aa, Homo sapiens
KTHKLQDPHERE

SEQ ID NO: 10928 - protein, 12 aa, Homo sapiens
KTHKLQDPHERE

SEQ ID NO: 10929 - protein, 12 aa, Homo sapiens
KTHKLQDPHERE

SEQ ID NO: 10930 - protein, 12 aa, Homo sapiens
KTHKLQDPHERE

SEQ ID NO: 10931 - protein, 12 aa, Homo sapiens
KTHKLQDPHERE

SEQ ID NO: 10932 - protein, 19 aa, Homo sapiens
REFVICDKYLQQIFESQRM

SEQ ID NO: 10933 - protein, 12 aa, Homo sapiens
KTHKLQDPHERE

SEQ ID NO: 10934 - protein, 12 aa, Homo sapiens
KTHKLQDPHERE

SEQ ID NO: 10935 - protein, 12 aa, Homo sapiens
KTHKLQDPHERE

SEQ ID NO: 10936 - protein, 11 aa, Homo sapiens
RYFYSKVQQRR

SEQ ID NO: 10937 - protein, 12 aa, Homo sapiens
KKMADKILPQRI

SEQ ID NO: 10938 - protein, 12 aa, Homo sapiens
KKMADKILPQRI

SEQ ID NO: 10939 - protein, 12 aa, Homo sapiens
KKMADKILPQRI

SEQ ID NO: 10940 - protein, 8 aa, Homo sapiens
RNHNAKKK

SEQ ID NO: 10941 - protein, 8 aa, Homo sapiens
RNHNAKKK

SEQ ID NO: 10942 - protein, 8 aa, Homo sapiens
RNHNAKKK

SEQ ID NO: 10943 - protein, 28 aa, Homo sapiens
RLHALLMPPEPIIINHVISVDPNDQKKT

SEQ ID NO: 10944 - protein, 28 aa, Homo sapiens
RLHALLMPPEPIIINHVISVDPNDQKKT

SEQ ID NO: 10945 - protein, 28 aa, Homo sapiens
RLHALLMPPEPIIINHVISVDPNDQKKT

SEQ ID NO: 10946 - protein, 23 aa, Homo sapiens
RTATTQETDGFQVKRPGDVNVRC

SEQ ID NO: 10947 - protein, 23 aa, Homo sapiens
RTATTQETDGFQVKRPGDVNVRC

SEQ ID NO: 10948 - protein, 23 aa, Homo sapiens
RTATTQETDGFQVKRPGDVNVRC

SEQ ID NO: 10949 - protein, 23 aa, Homo sapiens
RTATTQETDGFQVKRPGDVNVRC

SEQ ID NO: 10950 - protein, 23 aa, Homo sapiens
RTATTQETDGFQVKRPGDVNVRC

SEQ ID NO: 10951 - protein, 23 aa, Homo sapiens
RTATTQETDGFQVKRPGDVNVRC

SEQ ID NO: 10952 - protein, 23 aa, Homo sapiens
RTATTQETDGFQVKRPGDVNVRC

SEQ ID NO: 10953 - protein, 23 aa, Homo sapiens
RTATTQETDGFQVKRPGDVNVRC

SEQ ID NO: 10954 - protein, 29 aa, Homo sapiens
RIFISNTFNPAKSDAEDGEGTVASWELRV

SEQ ID NO: 10955 - protein, 23 aa, Homo sapiens
RTATTQETDGFQVKRPGDVNVRC

SEQ ID NO: 10956 - protein, 16 aa, Homo sapiens
RTATTQETDGFQVKRP

SEQ ID NO: 10957 - protein, 23 aa, Homo sapiens
RTATTQETDGFQVKRPGDVNVRC

SEQ ID NO: 10958 - protein, 29 aa, Homo sapiens
RIFISNTFNPAKSDAEDGEGTVASWELRV

SEQ ID NO: 10959 - protein, 29 aa, Homo sapiens
RIFISNTFNPAKSDAEDGEGTVASWELRV

SEQ ID NO: 10960 - protein, 23 aa, Homo sapiens
RTATTQETDGFQVKRPGDVNVRC

SEQ ID NO: 10961 - protein, 23 aa, Homo sapiens
RTATTQETDGFQVKRPGDVNVRC

SEQ ID NO: 10962 - protein, 23 aa, Homo sapiens
RTATTQETDGFQVKRPGDVNVRC

SEQ ID NO: 10963 - protein, 23 aa, Homo sapiens
RTATTQETDGFQVKRPGDVNVRC

SEQ ID NO: 10964 - protein, 23 aa, Homo sapiens
RTATTQETDGFQVKRPGDVNVRC

SEQ ID NO: 10965 - protein, 23 aa, Homo sapiens
RTATTQETDGFQVKRPGDVNVRC

SEQ ID NO: 10966 - protein, 33 aa, Homo sapiens; identical to SEQ ID NO: 6261

SEQ ID NO: 10967 - protein, 23 aa, Homo sapiens
RTATTQETDGFQVKRPGDVNVRC

SEQ ID NO: 10968 - protein, 23 aa, Homo sapiens
RTATTQETDGFQVKRPGDVNVRC

SEQ ID NO: 10969 - protein, 29 aa, Homo sapiens
RIFISNTFNPAKSDAEDGEGTVASWELRV

SEQ ID NO: 10970 - protein, 23 aa, Homo sapiens
RTATTQETDGFQVKRPGDVNVRC

SEQ ID NO: 10971 - protein, 33 aa, Homo sapiens; identical to SEQ ID NO: 6261

SEQ ID NO: 10972 - protein, 23 aa, Homo sapiens
RTATTQETDGFQVKRPGDVNVRC

SEQ ID NO: 10973 - protein, 23 aa, Homo sapiens
RTATTQETDGFQVKRPGDVNVRC

SEQ ID NO: 10974 - protein, 23 aa, Homo sapiens
RTATTQETDGFQVKRPGDVNVRC

SEQ ID NO: 10975 - protein, 33 aa, Homo sapiens; identical to SEQ ID NO: 6261

SEQ ID NO: 10976 - protein, 23 aa, Homo sapiens
RTATTQETDGFQVKRPGDVNVRC

SEQ ID NO: 10977 - protein, 33 aa, Homo sapiens; identical to SEQ ID NO: 6261

SEQ ID NO: 10978 - protein, 23 aa, Homo sapiens
RTATTQETDGFQVKRPGDVNVRC

SEQ ID NO: 10979 - protein, 23 aa, Homo sapiens
RTATTQETDGFQVKRPGDVNVRC

SEQ ID NO: 10980 - protein, 23 aa, Homo sapiens
RTATTQETDGFQVKRPGDVNVRC

SEQ ID NO: 10981 - protein, 23 aa, Homo sapiens
RTATTQETDGFQVKRPGDVNVRC

SEQ ID NO: 10982 - protein, 23 aa, Homo sapiens
RTATTQETDGFQVKRPGDVNVRC

SEQ ID NO: 10983 - protein, 23 aa, Homo sapiens
RTATTQETDGFQVKRPGDVNVRC

SEQ ID NO: 10984 - protein, 23 aa, Homo sapiens
RTATTQETDGFQVKRPGDVNVRC

SEQ ID NO: 10985 - protein, 23 aa, Homo sapiens
RTATTQETDGFQVKRPGDVNVRC

SEQ ID NO: 10986 - protein, 12 aa, Homo sapiens
KKMADKILPQRI

SEQ ID NO: 10987 - protein, 12 aa, Homo sapiens
KKMADKILPQRI

SEQ ID NO: 10988 - protein, 11 aa, Homo sapiens
KMADKILPQRI

SEQ ID NO: 10989 - protein, 12 aa, Homo sapiens
KKMADKILPQRI

SEQ ID NO: 10990 - protein, 12 aa, Homo sapiens
KKMADKILPQRI

SEQ ID NO: 10991 - protein, 9 aa, Homo sapiens
RNHNAKKKK

SEQ ID NO: 10992 - protein, 11 aa, Homo sapiens
RMKFSEIPQRL

SEQ ID NO: 10993 - protein, 14 aa, Homo sapiens
RLDIQEALKRPIKQ

SEQ ID NO: 10994 - protein, 14 aa, Homo sapiens
RLDIQEALKRPIKQ

SEQ ID NO: 10995 - protein, 11 aa, Homo sapiens
KMADKILPQRI

SEQ ID NO: 10996 - protein, 10 aa, Homo sapiens
RKLDQTIMRK

SEQ ID NO: 10997 - protein, 10 aa, Homo sapiens
RKLDQTIMRK

SEQ ID NO: 10998 - protein, 10 aa, Homo sapiens
RKLDQTIMRK

SEQ ID NO: 10999 - protein, 11 aa, Homo sapiens
RYFYSKVQQRR

SEQ ID NO: 11000 - protein, 21 aa, Homo sapiens
RKRPAPQQIQQVQQQAVQNRN

SEQ ID NO: 11001 - protein, 21 aa, Homo sapiens
RKRPAPQQIQQVQQQAVQNRN

SEQ ID NO: 11002 - protein, 12 aa, Homo sapiens
KKMADKILPQRI

SEQ ID NO: 11003 - protein, 12 aa, Homo sapiens
KKMADKILPQRI

SEQ ID NO: 11004 - protein, 11 aa, Homo sapiens
RMKFSEIPQRL

SEQ ID NO: 11005 - protein, 11 aa, Homo sapiens
RMKFSEIPQRL

SEQ ID NO: 11006 - protein, 33 aa, Homo sapiens; identical to SEQ ID NO: 284

SEQ ID NO: 11007 - protein, 33 aa, Homo sapiens; identical to SEQ ID NO: 284

SEQ ID NO: 11008 - protein, 33 aa, Homo sapiens; identical to SEQ ID NO: 284

SEQ ID NO: 11009 - protein, 33 aa, Homo sapiens; identical to SEQ ID NO: 284

SEQ ID NO: 11010 - protein, 33 aa, Homo sapiens; identical to SEQ ID NO: 284

SEQ ID NO: 11011 - protein, 11 aa, Homo sapiens
KKGQASLYGKR

SEQ ID NO: 11012 - protein, 7 aa, Homo sapiens
RKKSGKK

SEQ ID NO: 11013 - protein, 10 aa, Homo sapiens
KSKGASAGRE

SEQ ID NO: 11014 - protein, 10 aa, Homo sapiens
KSKGASAGRE

SEQ ID NO: 11015 - protein, 10 aa, Homo sapiens
KSKGASAGRE

SEQ ID NO: 11016 - protein, 10 aa, Homo sapiens
KSKGASAGRE

SEQ ID NO: 11017 - protein, 13 aa, Homo sapiens
RTDIYSKKTLAKS

SEQ ID NO: 11018 - protein, 10 aa, Homo sapiens
KSKGASAGRE

SEQ ID NO: 11019 - protein, 9 aa, Homo sapiens
KKVQEAARA

SEQ ID NO: 11020 - protein, 14 aa, Homo sapiens
KTLAKSKGASAGRE

SEQ ID NO: 11021 - protein, 14 aa, Homo sapiens
KTLAKSKGASAGRE

SEQ ID NO: 11022 - protein, 14 aa, Homo sapiens
KTLAKSKGASAGRE

SEQ ID NO: 11023 - protein, 14 aa, Homo sapiens
KTLAKSKGASAGRE

SEQ ID NO: 11024 - protein, 8 aa, Homo sapiens
KTLAKSKG

SEQ ID NO: 11025 - protein, 8 aa, Homo sapiens
KTLAKSKG

SEQ ID NO: 11026 - protein, 9 aa, Homo sapiens
RTDIYSKKT

SEQ ID NO: 11027 - protein, 9 aa, Homo sapiens
RTDIYSKKT

SEQ ID NO: 11028 - protein, 11 aa, Homo sapiens
KKDSENTPVKG

SEQ ID NO: 11029 - protein, 28 aa, Homo sapiens
KTLVQNNCLTRPNIYLIPDIDLKLANKL

SEQ ID NO: 11030 - protein, 18 aa, Homo sapiens
KAGGALCHILGAAYKYKN

SEQ ID NO: 11031 - protein, 18 aa, Homo sapiens
KAGGALCHILGAAYKYKN

SEQ ID NO: 11032 - protein, 34 aa, Homo sapiens; identical to SEQ ID NO: 6334

SEQ ID NO: 11033 - protein, 12 aa, Homo sapiens
KLPAKCFMDFKA

SEQ ID NO: 11034 - protein, 17 aa, Homo sapiens
RKHSPSPPPPTPTESRK

SEQ ID NO: 11035 - protein, 17 aa, Homo sapiens
RKHSPSPPPPTPTESRK

SEQ ID NO: 11036 - protein, 17 aa, Homo sapiens
RKHSPSPPPPTPTESRK

SEQ ID NO: 11037 - protein, 9 aa, Homo sapiens
RKASANARK

SEQ ID NO: 11038 - protein, 9 aa, Homo sapiens
RKASANARK

SEQ ID NO: 11039 - protein, 9 aa, Homo sapiens
RKASANARK

SEQ ID NO: 11040 - protein, 8 aa, Homo sapiens
RKPVSFRQ

SEQ ID NO: 11041 - protein, 16 aa, Homo sapiens
RISTKNEEPVRSPERR

SEQ ID NO: 11042 - protein, 10 aa, Homo sapiens
KSKGASAGRE

SEQ ID NO: 11043 - protein, 11 aa, Homo sapiens
KGQASLYGKRR

SEQ ID NO: 11044 - protein, 8 aa, Homo sapiens
KNVNLKKD

SEQ ID NO: 11045 - protein, 13 aa, Homo sapiens
RHQGTFTDEKSKA

SEQ ID NO: 11046 - protein, 11 aa, Homo sapiens
KKDSENTPVKG

SEQ ID NO: 11047 - protein, 13 aa, Homo sapiens
RHQGTFTDEKSKA

SEQ ID NO: 11048 - protein, 39 aa, Homo sapiens; identical to SEQ ID NO: 6351

SEQ ID NO: 11049 - protein, 13 aa, Homo sapiens
RHQGTFTDEKSKA

SEQ ID NO: 11050 - protein, 11 aa, Homo sapiens
RDRKASANARK

SEQ ID NO: 11051 - protein, 9 aa, Homo sapiens
RKASANARK

SEQ ID NO: 11052 - protein, 9 aa, Homo sapiens
RKASANARK

SEQ ID NO: 11053 - protein, 11 aa, Homo sapiens
RDRKASANARK

SEQ ID NO: 11054 - protein, 9 aa, Homo sapiens
RKASANARK

SEQ ID NO: 11055 - protein, 9 aa, Homo sapiens
RKASANARK

SEQ ID NO: 11056 - protein, 9 aa, Homo sapiens
RKASANARK

SEQ ID NO: 11057 - protein, 11 aa, Homo sapiens
RDRKASANARK

SEQ ID NO: 11058 - protein, 11 aa, Homo sapiens
RDRKASANARK

SEQ ID NO: 11059 - protein, 13 aa, Homo sapiens
RHQGTFTDEKSKA

SEQ ID NO: 11060 - protein, 13 aa, Homo sapiens
RHQGTFTDEKSKA

SEQ ID NO: 11061 - protein, 9 aa, Homo sapiens
KKVQEAARA

SEQ ID NO: 11062 - protein, 9 aa, Homo sapiens
KKVQEAARA

SEQ ID NO: 11063 - protein, 13 aa, Homo sapiens
RHQGTFTDEKSKA

SEQ ID NO: 11064 - protein, 13 aa, Homo sapiens
RHQGTFTDEKSKA

SEQ ID NO: 11065 - protein, 27 aa, Homo sapiens
KSKASHHIYPYSSSQDDEEWLRPVMRK

SEQ ID NO: 11066 - protein, 7 aa, Homo sapiens
RKKSGKK

SEQ ID NO: 11067 - protein, 7 aa, Homo sapiens
RKKSGKK

SEQ ID NO: 11068 - protein, 7 aa, Homo sapiens
RKKSGKK

SEQ ID NO: 11069 - protein, 7 aa, Homo sapiens
RKKSGKK

SEQ ID NO: 11070 - protein, 18 aa, Homo sapiens
RVREEVPLELVEAHVKKV

SEQ ID NO: 11071 - protein, 18 aa, Homo sapiens
RVREEVPLELVEAHVKKV

SEQ ID NO: 11072 - protein, 18 aa, Homo sapiens
RVREEVPLELVEAHVKKV

SEQ ID NO: 11073 - protein, 27 aa, Homo sapiens
KKVEHEISEGNVATAAAAALASAATKA

SEQ ID NO: 11074 - protein, 27 aa, Homo sapiens
KKVEHEISEGNVATAAAAALASAATKA

SEQ ID NO: 11075 - protein, 9 aa, Homo sapiens
RKASANARK

SEQ ID NO: 11076 - protein, 9 aa, Homo sapiens
RKASANARK

SEQ ID NO: 11077 - protein, 9 aa, Homo sapiens
RKASANARK

SEQ ID NO: 11078 - protein, 9 aa, Homo sapiens
RKASANARK

SEQ ID NO: 11079 - protein, 9 aa, Homo sapiens
RKASANARK

SEQ ID NO: 11080 - protein, 11 aa, Homo sapiens
RDRKASANARK

SEQ ID NO: 11081 - protein, 9 aa, Homo sapiens
RKASANARK

SEQ ID NO: 11082 - protein, 12 aa, Homo sapiens
RISTKNEEPVRS

SEQ ID NO: 11083 - protein, 9 aa, Homo sapiens
RKASANARK

SEQ ID NO: 11084 - protein, 11 aa, Homo sapiens
RDRKASANARK

SEQ ID NO: 11085 - protein, 16 aa, Homo sapiens
RISTKNEEPVRSPERR

SEQ ID NO: 11086 - protein, 16 aa, Homo sapiens
RISTKNEEPVRSPERR

SEQ ID NO: 11087 - protein, 11 aa, Homo sapiens
RDRKASANARK

SEQ ID NO: 11088 - protein, 16 aa, Homo sapiens
RISTKNEEPVRSPERR

SEQ ID NO: 11089 - protein, 9 aa, Homo sapiens
RKASANARK

SEQ ID NO: 11090 - protein, 11 aa, Homo sapiens
RDRKASANARK

SEQ ID NO: 11091 - protein, 9 aa, Homo sapiens
RKASANARK

SEQ ID NO: 11092 - protein, 11 aa, Homo sapiens
RDRKASANARK

SEQ ID NO: 11093 - protein, 11 aa, Homo sapiens
RDRKASANARK

SEQ ID NO: 11094 - protein, 11 aa, Homo sapiens
RDRKASANARK

SEQ ID NO: 11095 - protein, 11 aa, Homo sapiens
RDRKASANARK

SEQ ID NO: 11096 - protein, 12 aa, Homo sapiens
RISTKNEEPVRS

SEQ ID NO: 11097 - protein, 10 aa, Homo sapiens
RKDGGPATKF

SEQ ID NO: 11098 - protein, 10 aa, Homo sapiens
RKDGGPATKF

SEQ ID NO: 11099 - protein, 11 aa, Homo sapiens
RRKDGGPATKF

SEQ ID NO: 11100 - protein, 20 aa, Homo sapiens
RSPQVPAAQQMLNFPEKNKE

SEQ ID NO: 11101 - protein, 20 aa, Homo sapiens
RSPQVPAAQQMLNFPEKNKE

SEQ ID NO: 11102 - protein, 14 aa, Homo sapiens
KEKPVDLQNFGLRT

SEQ ID NO: 11103 - protein, 20 aa, Homo sapiens
RSPQVPAAQQMLNFPEKNKE

SEQ ID NO: 11104 - protein, 20 aa, Homo sapiens
RSPQVPAAQQMLNFPEKNKE

SEQ ID NO: 11105 - protein, 20 aa, Homo sapiens
RSPQVPAAQQMLNFPEKNKE

SEQ ID NO: 11106 - protein, 20 aa, Homo sapiens
RSPQVPAAQQMLNFPEKNKE

SEQ ID NO: 11107 - protein, 20 aa, Homo sapiens
RSPQVPAAQQMLNFPEKNKE

SEQ ID NO: 11108 - protein, 20 aa, Homo sapiens
RSPQVPAAQQMLNFPEKNKE

SEQ ID NO: 11109 - protein, 20 aa, Homo sapiens
RSPQVPAAQQMLNFPEKNKE

SEQ ID NO: 11110 - protein, 14 aa, Homo sapiens
KEKPVDLQNFGLRT

SEQ ID NO: 11111 - protein, 14 aa, Homo sapiens
KEKPVDLQNFGLRT

SEQ ID NO: 11112 - protein, 14 aa, Homo sapiens
KEKPVDLQNFGLRT

SEQ ID NO: 11113 - protein, 14 aa, Homo sapiens
KEKPVDLQNFGLRT

SEQ ID NO: 11114 - protein, 14 aa, Homo sapiens
KEKPVDLQNFGLRT

SEQ ID NO: 11115 - protein, 14 aa, Homo sapiens
KEKPVDLQNFGLRT

SEQ ID NO: 11116 - protein, 22 aa, Homo sapiens
RSPQVPAAQQMLNFPEKNKEKP

SEQ ID NO: 11117 - protein, 14 aa, Homo sapiens
KEKPVDLQNFGLRT

SEQ ID NO: 11118 - protein, 9 aa, Homo sapiens
KKVQEAARA

SEQ ID NO: 11119 - protein, 17 aa, Homo sapiens
RVASAAAKAALEEFSRV

SEQ ID NO: 11120 - protein, 14 aa, Homo sapiens
KEKPVDLQNFGLRT

SEQ ID NO: 11121 - protein, 16 aa, Homo sapiens
KNKEKPVDLQNFGLRT

SEQ ID NO: 11122 - protein, 13 aa, Homo sapiens
RTDIYSKKTLAKS

SEQ ID NO: 11123 - protein, 13 aa, Homo sapiens
RTDIYSKKTLAKS

SEQ ID NO: 11124 - protein, 13 aa, Homo sapiens
RTDIYSKKTLAKS

SEQ ID NO: 11125 - protein, 13 aa, Homo sapiens
RTDIYSKKTLAKS

SEQ ID NO: 11126 - protein, 9 aa, Homo sapiens
RESDTGKKK

SEQ ID NO: 11127 - protein, 11 aa, Homo sapiens
KERESDTGKKK

SEQ ID NO: 11128 - protein, 11 aa, Homo sapiens
KERESDTGKKK

SEQ ID NO: 11129 - protein, 11 aa, Homo sapiens
KERESDTGKKK

SEQ ID NO: 11130 - protein, 9 aa, Homo sapiens
RESDTGKKK

SEQ ID NO: 11131 - protein, 11 aa, Homo sapiens
KERESDTGKKK

SEQ ID NO: 11132 - protein, 11 aa, Homo sapiens
KERESDTGKKK

SEQ ID NO: 11133 - protein, 17 aa, Homo sapiens
RVASAAAKAALEEFSRV

SEQ ID NO: 11134 - protein, 17 aa, Homo sapiens
RVASAAAKAALEEFSRV

SEQ ID NO: 11135 - protein, 17 aa, Homo sapiens
RVASAAAKAALEEFSRV

SEQ ID NO: 11136 - protein, 22 aa, Homo sapiens
REEVPLELVEAHVKKVQEAARA

SEQ ID NO: 11137 - protein, 22 aa, Homo sapiens
REEVPLELVEAHVKKVQEAARA

SEQ ID NO: 11138 - protein, 22 aa, Homo sapiens
REEVPLELVEAHVKKVQEAARA

SEQ ID NO: 11139 - protein, 22 aa, Homo sapiens
REEVPLELVEAHVKKVQEAARA

SEQ ID NO: 11140 - protein, 22 aa, Homo sapiens
REEVPLELVEAHVKKVQEAARA

SEQ ID NO: 11141 - protein, 22 aa, Homo sapiens
REEVPLELVEAHVKKVQEAARA

SEQ ID NO: 11142 - protein, 22 aa, Homo sapiens
REEVPLELVEAHVKKVQEAARA

SEQ ID NO: 11143 - protein, 22 aa, Homo sapiens
REEVPLELVEAHVKKVQEAARA

SEQ ID NO: 11144 - protein, 22 aa, Homo sapiens
REEVPLELVEAHVKKVQEAARA

SEQ ID NO: 11145 - protein, 22 aa, Homo sapiens
REEVPLELVEAHVKKVQEAARA

SEQ ID NO: 11146 - protein, 22 aa, Homo sapiens
REEVPLELVEAHVKKVQEAARA

SEQ ID NO: 11147 - protein, 17 aa, Homo sapiens
RVASAAAKAALEEFSRV

SEQ ID NO: 11148 - protein, 17 aa, Homo sapiens
RVASAAAKAALEEFSRV

SEQ ID NO: 11149 - protein, 11 aa, Homo sapiens
KERESDTGKKK

SEQ ID NO: 11150 - protein, 11 aa, Homo sapiens
KERESDTGKKK

SEQ ID NO: 11151 - protein, 17 aa, Homo sapiens
RVASAAAKAALEEFSRV

SEQ ID NO: 11152 - protein, 17 aa, Homo sapiens
RVASAAAKAALEEFSRV

SEQ ID NO: 11153 - protein, 17 aa, Homo sapiens
RVASAAAKAALEEFSRV

SEQ ID NO: 11154 - protein, 17 aa, Homo sapiens
RVASAAAKAALEEFSRV

SEQ ID NO: 11155 - protein, 17 aa, Homo sapiens
RVASAAAKAALEEFSRV

SEQ ID NO: 11156 - protein, 17 aa, Homo sapiens
RVASAAAKAALEEFSRV

SEQ ID NO: 11157 - protein, 17 aa, Homo sapiens
RVASAAAKAALEEFSRV

SEQ ID NO: 11158 - protein, 17 aa, Homo sapiens
RVASAAAKAALEEFSRV

SEQ ID NO: 11159 - protein, 17 aa, Homo sapiens
RVASAAAKAALEEFSRV

SEQ ID NO: 11160 - protein, 17 aa, Homo sapiens
RVASAAAKAALEEFSRV

SEQ ID NO: 11161 - protein, 17 aa, Homo sapiens
RVASAAAKAALEEFSRV

SEQ ID NO: 11162 - protein, 17 aa, Homo sapiens
RVASAAAKAALEEFSRV

SEQ ID NO: 11163 - protein, 17 aa, Homo sapiens
RVASAAAKAALEEFSRV

SEQ ID NO: 11164 - protein, 17 aa, Homo sapiens
RVASAAAKAALEEFSRV

SEQ ID NO: 11165 - protein, 17 aa, Homo sapiens
RVASAAAKAALEEFSRV

SEQ ID NO: 11166 - protein, 17 aa, Homo sapiens
RVASAAAKAALEEFSRV

SEQ ID NO: 11167 - protein, 17 aa, Homo sapiens
RVASAAAKAALEEFSRV

SEQ ID NO: 11168 - protein, 17 aa, Homo sapiens
RVASAAAKAALEEFSRV

SEQ ID NO: 11169 - protein, 17 aa, Homo sapiens
RVASAAAKAALEEFSRV

SEQ ID NO: 11170 - protein, 17 aa, Homo sapiens
RVASAAAKAALEEFSRV

SEQ ID NO: 11171 - protein, 27 aa, Homo sapiens
KKVEHEISEGNVATAAAAALASAATKA

SEQ ID NO: 11172 - protein, 17 aa, Homo sapiens
RVASAAAKAALEEFSRV

SEQ ID NO: 11173 - protein, 17 aa, Homo sapiens
RVASAAAKAALEEFSRV

SEQ ID NO: 11174 - protein, 17 aa, Homo sapiens
RVASAAAKAALEEFSRV

SEQ ID NO: 11175 - protein, 17 aa, Homo sapiens
RVASAAAKAALEEFSRV

SEQ ID NO: 11176 - protein, 17 aa, Homo sapiens
RVASAAAKAALEEFSRV

SEQ ID NO: 11177 - protein, 17 aa, Homo sapiens
RVASAAAKAALEEFSRV

SEQ ID NO: 11178 - protein, 17 aa, Homo sapiens
RVASAAAKAALEEFSRV

SEQ ID NO: 11179 - protein, 27 aa, Homo sapiens
KKVEHEISEGNVATAAAAALASAATKA

SEQ ID NO: 11180 - protein, 17 aa, Homo sapiens
RVASAAAKAALEEFSRV

SEQ ID NO: 11181 - protein, 27 aa, Homo sapiens
KKVEHEISEGNVATAAAAALASAATKA

SEQ ID NO: 11182 - protein, 17 aa, Homo sapiens
RVASAAAKAALEEFSRV

SEQ ID NO: 11183 - protein, 17 aa, Homo sapiens
RVASAAAKAALEEFSRV

SEQ ID NO: 11184 - protein, 9 aa, Homo sapiens
KKVQEAARA

SEQ ID NO: 11185 - protein, 9 aa, Homo sapiens
KKVQEAARA

SEQ ID NO: 11186 - protein, 9 aa, Homo sapiens
KKVQEAARA

SEQ ID NO: 11187 - protein, 9 aa, Homo sapiens
KKVQEAARA

SEQ ID NO: 11188 - protein, 28 aa, Homo sapiens
KKKVEHEISEGNVATAAAAALASAATKA

SEQ ID NO: 11189 - protein, 28 aa, Homo sapiens
KKKVEHEISEGNVATAAAAALASAATKA

SEQ ID NO: 11190 - protein, 28 aa, Homo sapiens
KKKVEHEISEGNVATAAAAALASAATKA

SEQ ID NO: 11191 - protein, 17 aa, Homo sapiens
RVASAAAKAALEEFSRV

SEQ ID NO: 11192 - protein, 17 aa, Homo sapiens
RVASAAAKAALEEFSRV

SEQ ID NO: 11193 - protein, 28 aa, Homo sapiens
KKKVEHEISEGNVATAAAAALASAATKA

SEQ ID NO: 11194 - protein, 17 aa, Homo sapiens
RVASAAAKAALEEFSRV

SEQ ID NO: 11195 - protein, 28 aa, Homo sapiens
KKKVEHEISEGNVATAAAAALASAATKA

SEQ ID NO: 11196 - protein, 10 aa, Homo sapiens
RESDTGKKKV

SEQ ID NO: 11197 - protein, 10 aa, Homo sapiens
RESDTGKKKV

SEQ ID NO: 11198 - protein, 9 aa, Homo sapiens
RKASANARK

SEQ ID NO: 11199 - protein, 18 aa, Homo sapiens
RVREEVPLELVEAHVKKV

SEQ ID NO: 11200 - protein, 41 aa, Homo sapiens; identical to SEQ ID NO: 6353

SEQ ID NO: 11201 - protein, 41 aa, Homo sapiens; identical to SEQ ID NO: 6353

SEQ ID NO: 11202 - protein, 9 aa, Homo sapiens
RKASANARK

SEQ ID NO: 11203 - protein, 28 aa, Homo sapiens
KKKVEHEISEGNVATAAAAALASAATKA

SEQ ID NO: 11204 - protein, 11 aa, Homo sapiens
RRKDGGPATKF

SEQ ID NO: 11205 - protein, 9 aa, Homo sapiens
KKVQEAARA

SEQ ID NO: 11206 - protein, 9 aa, Homo sapiens
KKVQEAARA

SEQ ID NO: 11207 - protein, 9 aa, Homo sapiens
KKVQEAARA

SEQ ID NO: 11208 - protein, 9 aa, Homo sapiens
KKVQEAARA

SEQ ID NO: 11209 - protein, 9 aa, Homo sapiens
KKVQEAARA

SEQ ID NO: 11210 - protein, 9 aa, Homo sapiens
KKVQEAARA

SEQ ID NO: 11211 - protein, 9 aa, Homo sapiens
KKVQEAARA

SEQ ID NO: 11212 - protein, 9 aa, Homo sapiens
KKVQEAARA

SEQ ID NO: 11213 - protein, 9 aa, Homo sapiens
KKVQEAARA

SEQ ID NO: 11214 - protein, 9 aa, Homo sapiens
KKVQEAARA

SEQ ID NO: 11215 - protein, 9 aa, Homo sapiens
KKVQEAARA

SEQ ID NO: 11216 - protein, 8 aa, Homo sapiens
KLANKLKD

SEQ ID NO: 11217 - protein, 11 aa, Homo sapiens
KKDSENTPVKG

SEQ ID NO: 11218 - protein, 12 aa, Homo sapiens
KKGQASLYGKRR

SEQ ID NO: 11219 - protein, 11 aa, Homo sapiens
KKGQASLYGKR

SEQ ID NO: 11220 - protein, 11 aa, Homo sapiens
KKGQASLYGKR

SEQ ID NO: 11221 - protein, 12 aa, Homo sapiens
KKGQASLYGKRR

SEQ ID NO: 11222 - protein, 9 aa, Homo sapiens
RKASANARK

SEQ ID NO: 11223 - protein, 9 aa, Homo sapiens
RKASANARK

SEQ ID NO: 11224 - protein, 11 aa, Homo sapiens
KGQASLYGKRR

SEQ ID NO: 11225 - protein, 25 aa, Homo sapiens
RKDGGPATKFWESPETVSQLDSVRV

SEQ ID NO: 11226 - protein, 25 aa, Homo sapiens
RKDGGPATKFWESPETVSQLDSVRV

SEQ ID NO: 11227 - protein, 25 aa, Homo sapiens
RKDGGPATKFWESPETVSQLDSVRV

SEQ ID NO: 11228 - protein, 9 aa, Homo sapiens
RKASANARK

SEQ ID NO: 11229 - protein, 25 aa, Homo sapiens
RKDGGPATKFWESPETVSQLDSVRV

SEQ ID NO: 11230 - protein, 25 aa, Homo sapiens
RKDGGPATKFWESPETVSQLDSVRV

SEQ ID NO: 11231 - protein, 25 aa, Homo sapiens
RKDGGPATKFWESPETVSQLDSVRV

SEQ ID NO: 11232 - protein, 9 aa, Homo sapiens
RKASANARK

SEQ ID NO: 11233 - protein, 9 aa, Homo sapiens
RKASANARK

SEQ ID NO: 11234 - protein, 9 aa, Homo sapiens
RKASANARK

SEQ ID NO: 11235 - protein, 9 aa, Homo sapiens
RKASANARK

SEQ ID NO: 11236 - protein, 9 aa, Homo sapiens
RKASANARK

SEQ ID NO: 11237 - protein, 9 aa, Homo sapiens
RKASANARK

SEQ ID NO: 11238 - protein, 9 aa, Homo sapiens
RKASANARK

SEQ ID NO: 11239 - protein, 34 aa, Homo sapiens; identical to SEQ ID NO: 6542

SEQ ID NO: 11240 - protein, 9 aa, Homo sapiens
RKASANARK

SEQ ID NO: 11241 - protein, 9 aa, Homo sapiens
RKASANARK

SEQ ID NO: 11242 - protein, 9 aa, Homo sapiens
RKASANARK

SEQ ID NO: 11243 - protein, 11 aa, Homo sapiens
RDRKASANARK

SEQ ID NO: 11244 - protein, 11 aa, Homo sapiens
RDRKASANARK

SEQ ID NO: 11245 - protein, 25 aa, Homo sapiens
RKDGGPATKFWESPETVSQLDSVRV

SEQ ID NO: 11246 - protein, 11 aa, Homo sapiens
RRKDGGPATKF

SEQ ID NO: 11247 - protein, 9 aa, Homo sapiens
RKASANARK

SEQ ID NO: 11248 - protein, 9 aa, Homo sapiens
RKASANARK

SEQ ID NO: 11249 - protein, 9 aa, Homo sapiens
RKASANARK

SEQ ID NO: 11250 - protein, 9 aa, Homo sapiens
RKASANARK

SEQ ID NO: 11251 - protein, 9 aa, Homo sapiens
RKASANARK

SEQ ID NO: 11252 - protein, 9 aa, Homo sapiens
RKASANARK

SEQ ID NO: 11253 - protein, 9 aa, Homo sapiens
RKASANARK

SEQ ID NO: 11254 - protein, 18 aa, Homo sapiens
KGKQGGPTYYIDTNALRV

SEQ ID NO: 11255 - protein, 22 aa, Homo sapiens
REKLTELMFEHYNIPAFFLCKT

SEQ ID NO: 11256 - protein, 22 aa, Homo sapiens
REKLTELMFEHYNIPAFFLCKT

SEQ ID NO: 11257 - protein, 18 aa, Homo sapiens
KGKQGGPTYYIDTNALRV

SEQ ID NO: 11258 - protein, 22 aa, Homo sapiens
REKLTELMFEHYNIPAFFLCKT

SEQ ID NO: 11259 - protein, 22 aa, Homo sapiens
REKLTELMFEHYNIPAFFLCKT

SEQ ID NO: 11260 - protein, 22 aa, Homo sapiens
REKLTELMFEHYNIPAFFLCKT

SEQ ID NO: 11261 - protein, 22 aa, Homo sapiens
REKLTELMFEHYNIPAFFLCKT

SEQ ID NO: 11262 - protein, 22 aa, Homo sapiens
REKLTELMFEHYNIPAFFLCKT

SEQ ID NO: 11263 - protein, 15 aa, Homo sapiens
KQEYEEGGKQCVERK

SEQ ID NO: 11264 - protein, 22 aa, Homo sapiens
REKLTELMFEHYNIPAFFLCKT

SEQ ID NO: 11265 - protein, 22 aa, Homo sapiens
REKLTELMFEHYNIPAFFLCKT

SEQ ID NO: 11266 - protein, 22 aa, Homo sapiens
REKLTELMFEHYNIPAFFLCKT

SEQ ID NO: 11267 - protein, 16 aa, Homo sapiens
KQEYEEGGKQCVERKC

SEQ ID NO: 11268 - protein, 22 aa, Homo sapiens
REKLTELMFEHYNIPAFFLCKT

SEQ ID NO: 11269 - protein, 22 aa, Homo sapiens
REKLTELMFEHYNIPAFFLCKT

SEQ ID NO: 11270 - protein, 15 aa, Homo sapiens
KQEYEEGGKQCVERK

SEQ ID NO: 11271 - protein, 22 aa, Homo sapiens
REKLTELMFEHYNIPAFFLCKT

SEQ ID NO: 11272 - protein, 15 aa, Homo sapiens
KQEYEEGGKQCVERK

SEQ ID NO: 11273 - protein, 22 aa, Homo sapiens
REKLTELMFEHYNIPAFFLCKT

SEQ ID NO: 11274 - protein, 15 aa, Homo sapiens
KQEYEEGGKQCVERK

SEQ ID NO: 11275 - protein, 22 aa, Homo sapiens
REKLTELMFEHYNIPAFFLCKT

SEQ ID NO: 11276 - protein, 15 aa, Homo sapiens
KQEYEEGGKQCVERK

SEQ ID NO: 11277 - protein, 15 aa, Homo sapiens
KQEYEEGGKQCVERK

SEQ ID NO: 11278 - protein, 15 aa, Homo sapiens
KQEYEEGGKQCVERK

SEQ ID NO: 11279 - protein, 22 aa, Homo sapiens
REKLTELMFEHYNIPAFFLCKT

SEQ ID NO: 11280 - protein, 23 aa, Homo sapiens
KREKLTELMFEHYNIPAFFLCKT

SEQ ID NO: 11281 - protein, 16 aa, Homo sapiens
KQEYEEGGKQCVERKC

SEQ ID NO: 11282 - protein, 22 aa, Homo sapiens
REKLTELMFEHYNIPAFFLCKT

SEQ ID NO: 11283 - protein, 15 aa, Homo sapiens
KQEYEEGGKQCVERK

SEQ ID NO: 11284 - protein, 15 aa, Homo sapiens
KQEYEEGGKQCVERK

SEQ ID NO: 11285 - protein, 22 aa, Homo sapiens
REKLTELMFEHYNIPAFFLCKT

SEQ ID NO: 11286 - protein, 22 aa, Homo sapiens
REKLTELMFEHYNIPAFFLCKT

SEQ ID NO: 11287 - protein, 22 aa, Homo sapiens
REKLTELMFEHYNIPAFFLCKT

SEQ ID NO: 11288 - protein, 22 aa, Homo sapiens
REKLTELMFEHYNIPAFFLCKT

SEQ ID NO: 11289 - protein, 15 aa, Homo sapiens
KQEYEEGGKQCVERK

SEQ ID NO: 11290 - protein, 23 aa, Homo sapiens
KREKLTELMFEHYNIPAFFLCKT

SEQ ID NO: 11291 - protein, 22 aa, Homo sapiens
REKLTELMFEHYNIPAFFLCKT

SEQ ID NO: 11292 - protein, 22 aa, Homo sapiens
REKLTELMFEHYNIPAFFLCKT

SEQ ID NO: 11293 - protein, 15 aa, Homo sapiens
KQEYEEGGKQCVERK

SEQ ID NO: 11294 - protein, 22 aa, Homo sapiens
REKLTELMFEHYNIPAFFLCKT

SEQ ID NO: 11295 - protein, 15 aa, Homo sapiens
KQEYEEGGKQCVERK

SEQ ID NO: 11296 - protein, 22 aa, Homo sapiens
REKLTELMFEHYNIPAFFLCKT

SEQ ID NO: 11297 - protein, 22 aa, Homo sapiens
REKLTELMFEHYNIPAFFLCKT

SEQ ID NO: 11298 - protein, 22 aa, Homo sapiens
REKLTELMFEHYNIPAFFLCKT

SEQ ID NO: 11299 - protein, 22 aa, Homo sapiens
REKLTELMFEHYNIPAFFLCKT

SEQ ID NO: 11300 - protein, 17 aa, Homo sapiens
RDDGSTLMEIDGDKGKQ

SEQ ID NO: 11301 - protein, 31 aa, Homo sapiens; identical to SEQ ID NO: 6559

SEQ ID NO: 11302 - protein, 17 aa, Homo sapiens
RDDGSTLMEIDGDKGKQ

SEQ ID NO: 11303 - protein, 22 aa, Homo sapiens
REKLTELMFEHYNIPAFFLCKT

SEQ ID NO: 11304 - protein, 17 aa, Homo sapiens
RDDGSTLMEIDGDKGKQ

SEQ ID NO: 11305 - protein, 17 aa, Homo sapiens
RDDGSTLMEIDGDKGKQ

SEQ ID NO: 11306 - protein, 17 aa, Homo sapiens
RDDGSTLMEIDGDKGKQ

SEQ ID NO: 11307 - protein, 31 aa, Homo sapiens; identical to SEQ ID NO: 6559

SEQ ID NO: 11308 - protein, 22 aa, Homo sapiens
REKLTELMFEHYNIPAFFLCKT

SEQ ID NO: 11309 - protein, 22 aa, Homo sapiens
REKLTELMFEHYNIPAFFLCKT

SEQ ID NO: 11310 - protein, 17 aa, Homo sapiens
RDDGSTLMEIDGDKGKQ

SEQ ID NO: 11311 - protein, 23 aa, Homo sapiens
KREKLTELMFEHYNIPAFFLCKT

SEQ ID NO: 11312 - protein, 23 aa, Homo sapiens
KREKLTELMFEHYNIPAFFLCKT

SEQ ID NO: 11313 - protein, 23 aa, Homo sapiens
KREKLTELMFEHYNIPAFFLCKT

SEQ ID NO: 11314 - protein, 23 aa, Homo sapiens
KREKLTELMFEHYNIPAFFLCKT

SEQ ID NO: 11315 - protein, 23 aa, Homo sapiens
KREKLTELMFEHYNIPAFFLCKT

SEQ ID NO: 11316 - protein, 23 aa, Homo sapiens
KREKLTELMFEHYNIPAFFLCKT

SEQ ID NO: 11317 - protein, 23 aa, Homo sapiens
KREKLTELMFEHYNIPAFFLCKT

SEQ ID NO: 11318 - protein, 23 aa, Homo sapiens
KREKLTELMFEHYNIPAFFLCKT

SEQ ID NO: 11319 - protein, 23 aa, Homo sapiens
KREKLTELMFEHYNIPAFFLCKT

SEQ ID NO: 11320 - protein, 23 aa, Homo sapiens
KREKLTELMFEHYNIPAFFLCKT

SEQ ID NO: 11321 - protein, 13 aa, Homo sapiens
RELSQKTPPSMRL

SEQ ID NO: 11322 - protein, 13 aa, Homo sapiens
RELSQKTPPSMRL

SEQ ID NO: 11323 - protein, 45 aa, Homo sapiens; identical to SEQ ID NO: 928

SEQ ID NO: 11324 - protein, 31 aa, Homo sapiens; identical to SEQ ID NO: 783

SEQ ID NO: 11325 - protein, 31 aa, Homo sapiens; identical to SEQ ID NO: 783

SEQ ID NO: 11326 - protein, 45 aa, Homo sapiens; identical to SEQ ID NO: 928

SEQ ID NO: 11327 - protein, 31 aa, Homo sapiens; identical to SEQ ID NO: 783

SEQ ID NO: 11328 - protein, 31 aa, Homo sapiens; identical to SEQ ID NO: 783

SEQ ID NO: 11329 - protein, 31 aa, Homo sapiens; identical to SEQ ID NO: 783

SEQ ID NO: 11330 - protein, 31 aa, Homo sapiens; identical to SEQ ID NO: 783

SEQ ID NO: 11331 - protein, 45 aa, Homo sapiens; identical to SEQ ID NO: 928

SEQ ID NO: 11332 - protein, 45 aa, Homo sapiens; identical to SEQ ID NO: 928

SEQ ID NO: 11333 - protein, 45 aa, Homo sapiens; identical to SEQ ID NO: 928

SEQ ID NO: 11334 - protein, 45 aa, Homo sapiens; identical to SEQ ID NO: 928

SEQ ID NO: 11335 - protein, 31 aa, Homo sapiens; identical to SEQ ID NO: 783

SEQ ID NO: 11336 - protein, 45 aa, Homo sapiens; identical to SEQ ID NO: 928

SEQ ID NO: 11337 - protein, 45 aa, Homo sapiens; identical to SEQ ID NO: 928

SEQ ID NO: 11338 - protein, 45 aa, Homo sapiens; identical to SEQ ID NO: 928

SEQ ID NO: 11339 - protein, 45 aa, Homo sapiens; identical to SEQ ID NO: 928

SEQ ID NO: 11340 - protein, 45 aa, Homo sapiens; identical to SEQ ID NO: 928

SEQ ID NO: 11341 - protein, 45 aa, Homo sapiens; identical to SEQ ID NO: 928

SEQ ID NO: 11342 - protein, 45 aa, Homo sapiens; identical to SEQ ID NO: 928

SEQ ID NO: 11343 - protein, 31 aa, Homo sapiens; identical to SEQ ID NO: 783

SEQ ID NO: 11344 - protein, 31 aa, Homo sapiens; identical to SEQ ID NO: 783

SEQ ID NO: 11345 - protein, 24 aa, Homo sapiens
KMHVKSEASLHPVLMSEAPWNTRA

SEQ ID NO: 11346 - protein, 24 aa, Homo sapiens
KMHVKSEASLHPVLMSEAPWNTRA

SEQ ID NO: 11347 - protein, 24 aa, Homo sapiens
KMHVKSEASLHPVLMSEAPWNTRA

SEQ ID NO: 11348 - protein, 24 aa, Homo sapiens
KMHVKSEASLHPVLMSEAPWNTRA

SEQ ID NO: 11349 - protein, 11 aa, Homo sapiens
RKEKLPQVTRS

SEQ ID NO: 11350 - protein, 11 aa, Homo sapiens
REGSPANWKRK

SEQ ID NO: 11351 - protein, 11 aa, Homo sapiens
RKEKLPQVTRS

SEQ ID NO: 11352 - protein, 11 aa, Homo sapiens
REGSPANWKRK

SEQ ID NO: 11353 - protein, 11 aa, Homo sapiens
RKEKLPQVTRS

SEQ ID NO: 11354 - protein, 11 aa, Homo sapiens
REGSPANWKRK

SEQ ID NO: 11355 - protein, 11 aa, Homo sapiens
RKEKLPQVTRS

SEQ ID NO: 11356 - protein, 11 aa, Homo sapiens
RKEKLPQVTRS

SEQ ID NO: 11357 - protein, 11 aa, Homo sapiens
REGSPANWKRK

SEQ ID NO: 11358 - protein, 11 aa, Homo sapiens
REGSPANWKRK

SEQ ID NO: 11359 - protein, 11 aa, Homo sapiens
REGSPANWKRK

SEQ ID NO: 11360 - protein, 11 aa, Homo sapiens
RKEKLPQVTRS

SEQ ID NO: 11361 - protein, 11 aa, Homo sapiens
RKEKLPQVTRS

SEQ ID NO: 11362 - protein, 11 aa, Homo sapiens
REGSPANWKRK

SEQ ID NO: 11363 - protein, 11 aa, Homo sapiens
REGSPANWKRK

SEQ ID NO: 11364 - protein, 11 aa, Homo sapiens
RKEKLPQVTRS

SEQ ID NO: 11365 - protein, 11 aa, Homo sapiens
RKEKLPQVTRS

SEQ ID NO: 11366 - protein, 11 aa, Homo sapiens
RKEKLPQVTRS

SEQ ID NO: 11367 - protein, 11 aa, Homo sapiens
REGSPANWKRK

SEQ ID NO: 11368 - protein, 11 aa, Homo sapiens
RKEKLPQVTRS

SEQ ID NO: 11369 - protein, 11 aa, Homo sapiens
RKEKLPQVTRS

SEQ ID NO: 11370 - protein, 11 aa, Homo sapiens
RKEKLPQVTRS

SEQ ID NO: 11371 - protein, 11 aa, Homo sapiens
REGSPANWKRK

SEQ ID NO: 11372 - protein, 11 aa, Homo sapiens
RKEKLPQVTRS

SEQ ID NO: 11373 - protein, 11 aa, Homo sapiens
RKEKLPQVTRS

SEQ ID NO: 11374 - protein, 11 aa, Homo sapiens
RKEKLPQVTRS

SEQ ID NO: 11375 - protein, 11 aa, Homo sapiens
RKEKLPQVTRS

SEQ ID NO: 11376 - protein, 11 aa, Homo sapiens
RKEKLPQVTRS

SEQ ID NO: 11377 - protein, 11 aa, Homo sapiens
RKEKLPQVTRS

SEQ ID NO: 11378 - protein, 11 aa, Homo sapiens
REGSPANWKRK

SEQ ID NO: 11379 - protein, 11 aa, Homo sapiens
RKEKLPQVTRS

SEQ ID NO: 11380 - protein, 11 aa, Homo sapiens
REGSPANWKRK

SEQ ID NO: 11381 - protein, 11 aa, Homo sapiens
RKEKLPQVTRS

SEQ ID NO: 11382 - protein, 11 aa, Homo sapiens
REGSPANWKRK

SEQ ID NO: 11383 - protein, 11 aa, Homo sapiens
RKEKLPQVTRS

SEQ ID NO: 11384 - protein, 11 aa, Homo sapiens
RKEKLPQVTRS

SEQ ID NO: 11385 - protein, 11 aa, Homo sapiens
REGSPANWKRK

SEQ ID NO: 11386 - protein, 11 aa, Homo sapiens
RKEKLPQVTRS

SEQ ID NO: 11387 - protein, 11 aa, Homo sapiens
RKEKLPQVTRS

SEQ ID NO: 11388 - protein, 11 aa, Homo sapiens
RKEKLPQVTRS

SEQ ID NO: 11389 - protein, 11 aa, Homo sapiens
RKEKLPQVTRS

SEQ ID NO: 11390 - protein, 11 aa, Homo sapiens
RKEKLPQVTRS

SEQ ID NO: 11391 - protein, 11 aa, Homo sapiens
RKEKLPQVTRS

SEQ ID NO: 11392 - protein, 11 aa, Homo sapiens
RKEKLPQVTRS

SEQ ID NO: 11393 - protein, 11 aa, Homo sapiens
RKEKLPQVTRS

SEQ ID NO: 11394 - protein, 10 aa, Homo sapiens
KEKLPQVTRS

SEQ ID NO: 11395 - protein, 11 aa, Homo sapiens
RKEKLPQVTRS

SEQ ID NO: 11396 - protein, 15 aa, Homo sapiens
KEAVREGSPANWKRK

SEQ ID NO: 11397 - protein, 11 aa, Homo sapiens
RKEKLPQVTRS

SEQ ID NO: 11398 - protein, 11 aa, Homo sapiens
RKEKLPQVTRS

SEQ ID NO: 11399 - protein, 15 aa, Homo sapiens
KEAVREGSPANWKRK

SEQ ID NO: 11400 - protein, 11 aa, Homo sapiens
RKEKLPQVTRS

SEQ ID NO: 11401 - protein, 11 aa, Homo sapiens
RKEKLPQVTRS

SEQ ID NO: 11402 - protein, 11 aa, Homo sapiens
REGSPANWKRK

SEQ ID NO: 11403 - protein, 11 aa, Homo sapiens
RKEKLPQVTRS

SEQ ID NO: 11404 - protein, 11 aa, Homo sapiens
RKEKLPQVTRS

SEQ ID NO: 11405 - protein, 11 aa, Homo sapiens
REGSPANWKRK

SEQ ID NO: 11406 - protein, 11 aa, Homo sapiens
REGSPANWKRK

SEQ ID NO: 11407 - protein, 11 aa, Homo sapiens
RKEKLPQVTRS

SEQ ID NO: 11408 - protein, 11 aa, Homo sapiens
REGSPANWKRK

SEQ ID NO: 11409 - protein, 11 aa, Homo sapiens
RKEKLPQVTRS

SEQ ID NO: 11410 - protein, 11 aa, Homo sapiens
RKEKLPQVTRS

SEQ ID NO: 11411 - protein, 11 aa, Homo sapiens
RKEKLPQVTRS

SEQ ID NO: 11412 - protein, 11 aa, Homo sapiens
RKEKLPQVTRS

SEQ ID NO: 11413 - protein, 11 aa, Homo sapiens
RKEKLPQVTRS

SEQ ID NO: 11414 - protein, 10 aa, Homo sapiens
KEKLPQVTRS

SEQ ID NO: 11415 - protein, 11 aa, Homo sapiens
RKEKLPQVTRS

SEQ ID NO: 11416 - protein, 10 aa, Homo sapiens
KEKLPQVTRS

SEQ ID NO: 11417 - protein, 11 aa, Homo sapiens
RKEKLPQVTRS

SEQ ID NO: 11418 - protein, 25 aa, Homo sapiens
RAGYAGEDCPKVDFPTAIGMVVERD

SEQ ID NO: 11419 - protein, 25 aa, Homo sapiens
RAGYAGEDCPKVDFPTAIGMVVERD

SEQ ID NO: 11420 - protein, 25 aa, Homo sapiens
RAGYAGEDCPKVDFPTAIGMVVERD

SEQ ID NO: 11421 - protein, 25 aa, Homo sapiens
RAGYAGEDCPKVDFPTAIGMVVERD

SEQ ID NO: 11422 - protein, 24 aa, Homo sapiens
KMHVKSEASLHPVLMSEAPWNTRA

SEQ ID NO: 11423 - protein, 24 aa, Homo sapiens
KMHVKSEASLHPVLMSEAPWNTRA

SEQ ID NO: 11424 - protein, 24 aa, Homo sapiens
KMHVKSEASLHPVLMSEAPWNTRA

SEQ ID NO: 11425 - protein, 25 aa, Homo sapiens
RAGYAGEDCPKVDFPTAIGMVVERD

SEQ ID NO: 11426 - protein, 24 aa, Homo sapiens
KMHVKSEASLHPVLMSEAPWNTRA

SEQ ID NO: 11427 - protein, 25 aa, Homo sapiens
RAGYAGEDCPKVDFPTAIGMVVERD

SEQ ID NO: 11428 - protein, 24 aa, Homo sapiens
KMHVKSEASLHPVLMSEAPWNTRA

SEQ ID NO: 11429 - protein, 25 aa, Homo sapiens
RAGYAGEDCPKVDFPTAIGMVVERD

SEQ ID NO: 11430 - protein, 24 aa, Homo sapiens
KMHVKSEASLHPVLMSEAPWNTRA

SEQ ID NO: 11431 - protein, 24 aa, Homo sapiens
KMHVKSEASLHPVLMSEAPWNTRA

SEQ ID NO: 11432 - protein, 24 aa, Homo sapiens
KMHVKSEASLHPVLMSEAPWNTRA

SEQ ID NO: 11433 - protein, 11 aa, Homo sapiens
RKEKLPQVTRS

SEQ ID NO: 11434 - protein, 18 aa, Homo sapiens
KGKQGGPTYYIDTNALRV

SEQ ID NO: 11435 - protein, 18 aa, Homo sapiens
KGKQGGPTYYIDTNALRV

SEQ ID NO: 11436 - protein, 18 aa, Homo sapiens
KGKQGGPTYYIDTNALRV

SEQ ID NO: 11437 - protein, 18 aa, Homo sapiens
KGKQGGPTYYIDTNALRV

SEQ ID NO: 11438 - protein, 31 aa, Homo sapiens; identical to SEQ ID NO: 6559

SEQ ID NO: 11439 - protein, 18 aa, Homo sapiens
KGKQGGPTYYIDTNALRV

SEQ ID NO: 11440 - protein, 18 aa, Homo sapiens
KGKQGGPTYYIDTNALRV

SEQ ID NO: 11441 - protein, 11 aa, Homo sapiens
RKEKLPQVTRS

SEQ ID NO: 11442 - protein, 11 aa, Homo sapiens
RKEKLPQVTRS

SEQ ID NO: 11443 - protein, 11 aa, Homo sapiens
RKEKLPQVTRS

SEQ ID NO: 11444 - protein, 11 aa, Homo sapiens
RKEKLPQVTRS

SEQ ID NO: 11445 - protein, 11 aa, Homo sapiens
RKEKLPQVTRS

SEQ ID NO: 11446 - protein, 11 aa, Homo sapiens
RKEKLPQVTRS

SEQ ID NO: 11447 - protein, 11 aa, Homo sapiens
RKEKLPQVTRS

SEQ ID NO: 11448 - protein, 25 aa, Homo sapiens
RELFQEMNIELVPPYMIASKEAVRE

SEQ ID NO: 11449 - protein, 11 aa, Homo sapiens
RKEKLPQVTRS

SEQ ID NO: 11450 - protein, 11 aa, Homo sapiens
RKEKLPQVTRS

SEQ ID NO: 11451 - protein, 11 aa, Homo sapiens
RKEKLPQVTRS

SEQ ID NO: 11452 - protein, 11 aa, Homo sapiens
KSKSNSSAARE

SEQ ID NO: 11453 - protein, 11 aa, Homo sapiens
KSKSNSSAARE

SEQ ID NO: 11454 - protein, 11 aa, Homo sapiens
KSKSNSSAARE

SEQ ID NO: 11455 - protein, 11 aa, Homo sapiens
KSKSNSSAARE

SEQ ID NO: 11456 - protein, 31 aa, Homo sapiens; identical to SEQ ID NO: 6760

SEQ ID NO: 11457 - protein, 8 aa, Homo sapiens
RGSLYKRY

SEQ ID NO: 11458 - protein, 17 aa, Homo sapiens
KYKAVSISTEPPTYLRE

SEQ ID NO: 11459 - protein, 17 aa, Homo sapiens
KYKAVSISTEPPTYLRE

SEQ ID NO: 11460 - protein, 8 aa, Homo sapiens
REQKAKRN

SEQ ID NO: 11461 - protein, 8 aa, Homo sapiens
REQKAKRN

SEQ ID NO: 11462 - protein, 27 aa, Homo sapiens
RGQLSWHQKTYAFSENPLPTVEIAIRN

SEQ ID NO: 11463 - protein, 27 aa, Homo sapiens
RGQLSWHQKTYAFSENPLPTVEIAIRN

SEQ ID NO: 11464 - protein, 9 aa, Homo sapiens
KKIRDQDRN

SEQ ID NO: 11465 - protein, 9 aa, Homo sapiens
KKIRDQDRN

SEQ ID NO: 11466 - protein, 13 aa, Homo sapiens
RLDMEIDGQKLRD

SEQ ID NO: 11467 - protein, 9 aa, Homo sapiens
KKIRDQDRN

SEQ ID NO: 11468 - protein, 9 aa, Homo sapiens
KKIRDQDRN

SEQ ID NO: 11469 - protein, 9 aa, Homo sapiens
KKIRDQDRN

SEQ ID NO: 11470 - protein, 9 aa, Homo sapiens
KKIRDQDRN

SEQ ID NO: 11471 - protein, 9 aa, Homo sapiens
KKIRDQDRN

SEQ ID NO: 11472 - protein, 9 aa, Homo sapiens
KKIRDQDRN

SEQ ID NO: 11473 - protein, 13 aa, Homo sapiens
RLDMEIDGQKLRD

SEQ ID NO: 11474 - protein, 9 aa, Homo sapiens
KKIRDQDRN

SEQ ID NO: 11475 - protein, 9 aa, Homo sapiens
KKIRDQDRN

SEQ ID NO: 11476 - protein, 9 aa, Homo sapiens
KKIRDQDRN

SEQ ID NO: 11477 - protein, 9 aa, Homo sapiens
KKIRDQDRN

SEQ ID NO: 11478 - protein, 10 aa, Homo sapiens
RSVTGKIQKL

SEQ ID NO: 11479 - protein, 10 aa, Homo sapiens
RSVTGKIQKL

SEQ ID NO: 11480 - protein, 19 aa, Homo sapiens
KLTKAVATYHANTEREQKK

SEQ ID NO: 11481 - protein, 10 aa, Homo sapiens
RSVTGKIQKL

SEQ ID NO: 11482 - protein, 6 aa, Homo sapiens
KKDKRL

SEQ ID NO: 11483 - protein, 11 aa, Homo sapiens
RQHKAAQVAKE

SEQ ID NO: 11484 - protein, 19 aa, Homo sapiens
KVIHVESGKILTGTDAPKA

SEQ ID NO: 11485 - protein, 13 aa, Homo sapiens
RWKYMIVDEGHRM

SEQ ID NO: 11486 - protein, 13 aa, Homo sapiens
RWKYMIVDEGHRM

SEQ ID NO: 11487 - protein, 13 aa, Homo sapiens
RWKYMIVDEGHRM

SEQ ID NO: 11488 - protein, 19 aa, Homo sapiens
KVIHVESGKILTGTDAPKA

SEQ ID NO: 11489 - protein, 19 aa, Homo sapiens
KVIHVESGKILTGTDAPKA

SEQ ID NO: 11490 - protein, 8 aa, Homo sapiens
RKPVDFKK

SEQ ID NO: 11491 - protein, 7 aa, Homo sapiens
KIKLGRK

SEQ ID NO: 11492 - protein, 7 aa, Homo sapiens
KIKLGRK

SEQ ID NO: 11493 - protein, 7 aa, Homo sapiens
RNHKYRS

SEQ ID NO: 11494 - protein, 10 aa, Homo sapiens
KYKDSSSGRQ

SEQ ID NO: 11495 - protein, 10 aa, Homo sapiens
KYKDSSSGRQ

SEQ ID NO: 11496 - protein, 9 aa, Homo sapiens
RIRNHKYRS

SEQ ID NO: 11497 - protein, 9 aa, Homo sapiens
RKEKAQDRL

SEQ ID NO: 11498 - protein, 9 aa, Homo sapiens
RKEKAQDRL

SEQ ID NO: 11499 - protein, 9 aa, Homo sapiens
RKEKAQDRL

SEQ ID NO: 11500 - protein, 9 aa, Homo sapiens
RIRNHKYRS

SEQ ID NO: 11501 - protein, 6 aa, Homo sapiens
KKSSRK

SEQ ID NO: 11502 - protein, 6 aa, Homo sapiens
KKSSRK

SEQ ID NO: 11503 - protein, 6 aa, Homo sapiens
KKSSRK

SEQ ID NO: 11504 - protein, 6 aa, Homo sapiens
KKSSRK

SEQ ID NO: 11505 - protein, 18 aa, Homo sapiens
RKRDSDAGSSTPTTSTRS

SEQ ID NO: 11506 - protein, 6 aa, Homo sapiens
KKSSRK

SEQ ID NO: 11507 - protein, 16 aa, Homo sapiens
KGGTKTLMNTIMQLRK

SEQ ID NO: 11508 - protein, 16 aa, Homo sapiens
KGGTKTLMNTIMQLRK

SEQ ID NO: 11509 - protein, 8 aa, Homo sapiens
KLIDQKKD

SEQ ID NO: 11510 - protein, 8 aa, Homo sapiens
KLIDQKKD

SEQ ID NO: 11511 - protein, 9 aa, Homo sapiens
RKLIDQKKD

SEQ ID NO: 11512 - protein, 8 aa, Homo sapiens
KLIDQKKD

SEQ ID NO: 11513 - protein, 8 aa, Homo sapiens
KLIDQKKD

SEQ ID NO: 11514 - protein, 6 aa, Homo sapiens
KKDKRL

SEQ ID NO: 11515 - protein, 17 aa, Homo sapiens
KAVATYHANTEREQKKE

SEQ ID NO: 11516 - protein, 7 aa, Homo sapiens
RIEKERM

SEQ ID NO: 11517 - protein, 11 aa, Homo sapiens
KENERIEKERM

SEQ ID NO: 11518 - protein, 11 aa, Homo sapiens
KENERIEKERM

SEQ ID NO: 11519 - protein, 7 aa, Homo sapiens
RIEKERM

SEQ ID NO: 11520 - protein, 7 aa, Homo sapiens
RIEKERM

SEQ ID NO: 11521 - protein, 11 aa, Homo sapiens
KENERIEKERM

SEQ ID NO: 11522 - protein, 7 aa, Homo sapiens
RIEKERM

SEQ ID NO: 11523 - protein, 11 aa, Homo sapiens
KENERIEKERM

SEQ ID NO: 11524 - protein, 11 aa, Homo sapiens
KENERIEKERM

SEQ ID NO: 11525 - protein, 11 aa, Homo sapiens
KENERIEKERM

SEQ ID NO: 11526 - protein, 11 aa, Homo sapiens
KENERIEKERM

SEQ ID NO: 11527 - protein, 11 aa, Homo sapiens
KENERIEKERM

SEQ ID NO: 11528 - protein, 17 aa, Homo sapiens
KAVATYHANTEREQKKE

SEQ ID NO: 11529 - protein, 11 aa, Homo sapiens
KENERIEKERM

SEQ ID NO: 11530 - protein, 11 aa, Homo sapiens
KENERIEKERM

SEQ ID NO: 11531 - protein, 11 aa, Homo sapiens
KENERIEKERM

SEQ ID NO: 11532 - protein, 12 aa, Homo sapiens
RYNQMKGMGMRS

SEQ ID NO: 11533 - protein, 12 aa, Homo sapiens
RYNQMKGMGMRS

SEQ ID NO: 11534 - protein, 18 aa, Homo sapiens
RGQPLPDHLQMAVQGKRP

SEQ ID NO: 11535 - protein, 18 aa, Homo sapiens
RGQPLPDHLQMAVQGKRP

SEQ ID NO: 11536 - protein, 18 aa, Homo sapiens
RGQPLPDHLQMAVQGKRP

SEQ ID NO: 11537 - protein, 12 aa, Homo sapiens
RYNQMKGMGMRS

SEQ ID NO: 11538 - protein, 18 aa, Homo sapiens
RGQPLPDHLQMAVQGKRP

SEQ ID NO: 11539 - protein, 19 aa, Homo sapiens
KKKIPDPDSDDVSEVDARH

SEQ ID NO: 11540 - protein, 8 aa, Homo sapiens
KLIDQKKD

SEQ ID NO: 11541 - protein, 9 aa, Homo sapiens
RKLIDQKKD

SEQ ID NO: 11542 - protein, 9 aa, Homo sapiens
RKLIDQKKD

SEQ ID NO: 11543 - protein, 9 aa, Homo sapiens
RKLIDQKKD

SEQ ID NO: 11544 - protein, 9 aa, Homo sapiens
RKLIDQKKD

SEQ ID NO: 11545 - protein, 9 aa, Homo sapiens
RKLIDQKKD

SEQ ID NO: 11546 - protein, 9 aa, Homo sapiens
RKLIDQKKD

SEQ ID NO: 11547 - protein, 8 aa, Homo sapiens
KLIDQKKD

SEQ ID NO: 11548 - protein, 18 aa, Homo sapiens
RLCTVNSVEEKILAAAKY

SEQ ID NO: 11549 - protein, 12 aa, Homo sapiens
KVSYKGSPAARR

SEQ ID NO: 11550 - protein, 12 aa, Homo sapiens
KVSYKGSPAARR

SEQ ID NO: 11551 - protein, 18 aa, Homo sapiens
RLCTVNSVEEKILAAAKY

SEQ ID NO: 11552 - protein, 13 aa, Homo sapiens
RKELPEYYELIRK

SEQ ID NO: 11553 - protein, 13 aa, Homo sapiens
RKELPEYYELIRK

SEQ ID NO: 11554 - protein, 24 aa, Homo sapiens
RGMLLKTFNEPGSEYFIFLLSTRA

SEQ ID NO: 11555 - protein, 12 aa, Homo sapiens
KVSYKGSPAARR

SEQ ID NO: 11556 - protein, 24 aa, Homo sapiens
RGMLLKTFNEPGSEYFIFLLSTRA

SEQ ID NO: 11557 - protein, 24 aa, Homo sapiens
RGMLLKTFNEPGSEYFIFLLSTRA

SEQ ID NO: 11558 - protein, 24 aa, Homo sapiens
RGMLLKTFNEPGSEYFIFLLSTRA

SEQ ID NO: 11559 - protein, 24 aa, Homo sapiens
RGMLLKTFNEPGSEYFIFLLSTRA

SEQ ID NO: 11560 - protein, 28 aa, Homo sapiens
KAEDRGMLLKTFNEPGSEYFIFLLSTRA

SEQ ID NO: 11561 - protein, 9 aa, Homo sapiens
KVKIKLGRK

SEQ ID NO: 11562 - protein, 9 aa, Homo sapiens
KVKIKLGRK

SEQ ID NO: 11563 - protein, 9 aa, Homo sapiens
KVKIKLGRK

SEQ ID NO: 11564 - protein, 9 aa, Homo sapiens
RKEKAQDRL

SEQ ID NO: 11565 - protein, 9 aa, Homo sapiens
RKEKAQDRL

SEQ ID NO: 11566 - protein, 13 aa, Homo sapiens
RAQIMAYKMLARG

SEQ ID NO: 11567 - protein, 13 aa, Homo sapiens
RAQIMAYKMLARG

SEQ ID NO: 11568 - protein, 12 aa, Homo sapiens
RYNQMKGMGMRS

SEQ ID NO: 11569 - protein, 13 aa, Homo sapiens
RAQIMAYKMLARG

SEQ ID NO: 11570 - protein, 15 aa, Homo sapiens
RLTCEEEEEKMFGRG

SEQ ID NO: 11571 - protein, 15 aa, Homo sapiens
RLTCEEEEEKMFGRG

SEQ ID NO: 11572 - protein, 15 aa, Homo sapiens
RLTCEEEEEKMFGRG

SEQ ID NO: 11573 - protein, 22 aa, Homo sapiens
RLMEEDELPSWIIKDDAEVERL

SEQ ID NO: 11574 - protein, 15 aa, Homo sapiens
RLTCEEEEEKMFGRG

SEQ ID NO: 11575 - protein, 15 aa, Homo sapiens
RLTCEEEEEKMFGRG

SEQ ID NO: 11576 - protein, 22 aa, Homo sapiens
RLMEEDELPSWIIKDDAEVERL

SEQ ID NO: 11577 - protein, 15 aa, Homo sapiens
RLTCEEEEEKMFGRG

SEQ ID NO: 11578 - protein, 22 aa, Homo sapiens
RLMEEDELPSWIIKDDAEVERL

SEQ ID NO: 11579 - protein, 15 aa, Homo sapiens
RLTCEEEEEKMFGRG

SEQ ID NO: 11580 - protein, 22 aa, Homo sapiens
RLMEEDELPSWIIKDDAEVERL

SEQ ID NO: 11581 - protein, 22 aa, Homo sapiens
RLMEEDELPSWIIKDDAEVERL

SEQ ID NO: 11582 - protein, 15 aa, Homo sapiens
RLTCEEEEEKMFGRG

SEQ ID NO: 11583 - protein, 15 aa, Homo sapiens
RLTCEEEEEKMFGRG

SEQ ID NO: 11584 - protein, 22 aa, Homo sapiens
RLMEEDELPSWIIKDDAEVERL

SEQ ID NO: 11585 - protein, 22 aa, Homo sapiens
RLMEEDELPSWIIKDDAEVERL

SEQ ID NO: 11586 - protein, 15 aa, Homo sapiens
RLTCEEEEEKMFGRG

SEQ ID NO: 11587 - protein, 22 aa, Homo sapiens
RLMEEDELPSWIIKDDAEVERL

SEQ ID NO: 11588 - protein, 22 aa, Homo sapiens
RLMEEDELPSWIIKDDAEVERL

SEQ ID NO: 11589 - protein, 15 aa, Homo sapiens
RLTCEEEEEKMFGRG

SEQ ID NO: 11590 - protein, 15 aa, Homo sapiens
RLTCEEEEEKMFGRG

SEQ ID NO: 11591 - protein, 22 aa, Homo sapiens
RLMEEDELPSWIIKDDAEVERL

SEQ ID NO: 11592 - protein, 22 aa, Homo sapiens
RLMEEDELPSWIIKDDAEVERL

SEQ ID NO: 11593 - protein, 22 aa, Homo sapiens
RLMEEDELPSWIIKDDAEVERL

SEQ ID NO: 11594 - protein, 15 aa, Homo sapiens
RLTCEEEEEKMFGRG

SEQ ID NO: 11595 - protein, 22 aa, Homo sapiens
RLMEEDELPSWIIKDDAEVERL

SEQ ID NO: 11596 - protein, 22 aa, Homo sapiens
RLMEEDELPSWIIKDDAEVERL

SEQ ID NO: 11597 - protein, 22 aa, Homo sapiens
RLMEEDELPSWIIKDDAEVERL

SEQ ID NO: 11598 - protein, 15 aa, Homo sapiens
RLTCEEEEEKMFGRG

SEQ ID NO: 11599 - protein, 22 aa, Homo sapiens
RLMEEDELPSWIIKDDAEVERL

SEQ ID NO: 11600 - protein, 15 aa, Homo sapiens
RLTCEEEEEKMFGRG

SEQ ID NO: 11601 - protein, 22 aa, Homo sapiens
RLMEEDELPSWIIKDDAEVERL

SEQ ID NO: 11602 - protein, 22 aa, Homo sapiens
RLMEEDELPSWIIKDDAEVERL

SEQ ID NO: 11603 - protein, 22 aa, Homo sapiens
RLMEEDELPSWIIKDDAEVERL

SEQ ID NO: 11604 - protein, 22 aa, Homo sapiens
RLMEEDELPSWIIKDDAEVERL

SEQ ID NO: 11605 - protein, 15 aa, Homo sapiens
RLTCEEEEEKMFGRG

SEQ ID NO: 11606 - protein, 22 aa, Homo sapiens
RLMEEDELPSWIIKDDAEVERL

SEQ ID NO: 11607 - protein, 22 aa, Homo sapiens
RLMEEDELPSWIIKDDAEVERL

SEQ ID NO: 11608 - protein, 22 aa, Homo sapiens
RLMEEDELPSWIIKDDAEVERL

SEQ ID NO: 11609 - protein, 22 aa, Homo sapiens
RLMEEDELPSWIIKDDAEVERL

SEQ ID NO: 11610 - protein, 15 aa, Homo sapiens
RLTCEEEEEKMFGRG

SEQ ID NO: 11611 - protein, 22 aa, Homo sapiens
RLMEEDELPSWIIKDDAEVERL

SEQ ID NO: 11612 - protein, 22 aa, Homo sapiens
RLMEEDELPSWIIKDDAEVERL

SEQ ID NO: 11613 - protein, 15 aa, Homo sapiens
RLTCEEEEEKMFGRG

SEQ ID NO: 11614 - protein, 22 aa, Homo sapiens
RLMEEDELPSWIIKDDAEVERL

SEQ ID NO: 11615 - protein, 15 aa, Homo sapiens
RLTCEEEEEKMFGRG

SEQ ID NO: 11616 - protein, 16 aa, Homo sapiens
RHRKEVDYSDSLTEKQ

SEQ ID NO: 11617 - protein, 18 aa, Homo sapiens
RKRDSDAGSSTPTTSTRS

SEQ ID NO: 11618 - protein, 18 aa, Homo sapiens
KVIQAGMFDQKSSSHERR

SEQ ID NO: 11619 - protein, 7 aa, Homo sapiens
RLKGGRR

SEQ ID NO: 11620 - protein, 12 aa, Homo sapiens
KVSYKGSPAARR

SEQ ID NO: 11621 - protein, 12 aa, Homo sapiens
KVSYKGSPAARR

SEQ ID NO: 11622 - protein, 12 aa, Homo sapiens
KVSYKGSPAARR

SEQ ID NO: 11623 - protein, 12 aa, Homo sapiens
KVSYKGSPAARR

SEQ ID NO: 11624 - protein, 18 aa, Homo sapiens
KVIQAGMFDQKSSSHERR

SEQ ID NO: 11625 - protein, 9 aa, Homo sapiens
RSVKVKIKL

SEQ ID NO: 11626 - protein, 9 aa, Homo sapiens
RKEKAQDRL

SEQ ID NO: 11627 - protein, 8 aa, Homo sapiens
RGFKYLRL

SEQ ID NO: 11628 - protein, 8 aa, Homo sapiens
RGFKYLRL

SEQ ID NO: 11629 - protein, 8 aa, Homo sapiens
RGFKYLRL

SEQ ID NO: 11630 - protein, 8 aa, Homo sapiens
RGFKYLRL

SEQ ID NO: 11631 - protein, 9 aa, Homo sapiens
RKEKAQDRL

SEQ ID NO: 11632 - protein, 8 aa, Homo sapiens
RGFKYLRL

SEQ ID NO: 11633 - protein, 8 aa, Homo sapiens
RGFKYLRL

SEQ ID NO: 11634 - protein, 8 aa, Homo sapiens
RGFKYLRL

SEQ ID NO: 11635 - protein, 8 aa, Homo sapiens
RGFKYLRL

SEQ ID NO: 11636 - protein, 8 aa, Homo sapiens
RGFKYLRL

SEQ ID NO: 11637 - protein, 8 aa, Homo sapiens
RGFKYLRL

SEQ ID NO: 11638 - protein, 13 aa, Homo sapiens
RWKYMIVDEGHRM

SEQ ID NO: 11639 - protein, 13 aa, Homo sapiens
RWKYMIVDEGHRM

SEQ ID NO: 11640 - protein, 13 aa, Homo sapiens
RWKYMIVDEGHRM

SEQ ID NO: 11641 - protein, 19 aa, Homo sapiens
KKKIPDPDSDDVSEVDARH

SEQ ID NO: 11642 - protein, 18 aa, Homo sapiens
KKIPDPDSDDVSEVDARH

SEQ ID NO: 11643 - protein, 19 aa, Homo sapiens
KKKIPDPDSDDVSEVDARH

SEQ ID NO: 11644 - protein, 16 aa, Homo sapiens
RVDKQSALMVNGVLKQ

SEQ ID NO: 11645 - protein, 7 aa, Homo sapiens
KKIKERI

SEQ ID NO: 11646 - protein, 7 aa, Homo sapiens
KKIKERI

SEQ ID NO: 11647 - protein, 7 aa, Homo sapiens
KKIKERI

SEQ ID NO: 11648 - protein, 7 aa, Homo sapiens
RSVKVKI

SEQ ID NO: 11649 - protein, 18 aa, Homo sapiens
RKRDSDAGSSTPTTSTRS

SEQ ID NO: 11650 - protein, 12 aa, Homo sapiens
KVSYKGSPAARR

SEQ ID NO: 11651 - protein, 18 aa, Homo sapiens
RKRDSDAGSSTPTTSTRS

SEQ ID NO: 11652 - protein, 10 aa, Homo sapiens
KYKDSSSGRQ

SEQ ID NO: 11653 - protein, 7 aa, Homo sapiens
RNHKYRS

SEQ ID NO: 11654 - protein, 7 aa, Homo sapiens
RNHKYRS

SEQ ID NO: 11655 - protein, 9 aa, Homo sapiens
RIRNHKYRS

SEQ ID NO: 11656 - protein, 18 aa, Homo sapiens
RKRDSDAGSSTPTTSTRS

SEQ ID NO: 11657 - protein, 8 aa, Homo sapiens
RKPVDFKK

SEQ ID NO: 11658 - protein, 8 aa, Homo sapiens
RKPVDFKK

SEQ ID NO: 11659 - protein, 7 aa, Homo sapiens
RLKGGRR

SEQ ID NO: 11660 - protein, 7 aa, Homo sapiens
RLKGGRR

SEQ ID NO: 11661 - protein, 7 aa, Homo sapiens
RLKGGRR

SEQ ID NO: 11662 - protein, 8 aa, Homo sapiens
RLKGGRRR

SEQ ID NO: 11663 - protein, 7 aa, Homo sapiens
KIKLGRK

SEQ ID NO: 11664 - protein, 13 aa, Homo sapiens
RKELPEYYELIRK

SEQ ID NO: 11665 - protein, 13 aa, Homo sapiens
RKELPEYYELIRK

SEQ ID NO: 11666 - protein, 13 aa, Homo sapiens
RKELPEYYELIRK

SEQ ID NO: 11667 - protein, 12 aa, Homo sapiens
KVSYKGSPAARR

SEQ ID NO: 11668 - protein, 12 aa, Homo sapiens
KVSYKGSPAARR

SEQ ID NO: 11669 - protein, 7 aa, Homo sapiens
RNHKYRS

SEQ ID NO: 11670 - protein, 9 aa, Homo sapiens
RIRNHKYRS

SEQ ID NO: 11671 - protein, 7 aa, Homo sapiens
RNHKYRS

SEQ ID NO: 11672 - protein, 15 aa, Homo sapiens
RLTCEEEEEKMFGRG

SEQ ID NO: 11673 - protein, 15 aa, Homo sapiens
RLTCEEEEEKMFGRG

SEQ ID NO: 11674 - protein, 15 aa, Homo sapiens
RLTCEEEEEKMFGRG

SEQ ID NO: 11675 - protein, 15 aa, Homo sapiens
RLTCEEEEEKMFGRG

SEQ ID NO: 11676 - protein, 15 aa, Homo sapiens
RLTCEEEEEKMFGRG

SEQ ID NO: 11677 - protein, 7 aa, Homo sapiens
RLKGGRR

SEQ ID NO: 11678 - protein, 19 aa, Homo sapiens
KKKIPDPDSDDVSEVDARH

SEQ ID NO: 11679 - protein, 6 aa, Homo sapiens
KKDKRL

SEQ ID NO: 11680 - protein, 7 aa, Homo sapiens
RLKGGRR

SEQ ID NO: 11681 - protein, 7 aa, Homo sapiens
RLKGGRR

SEQ ID NO: 11682 - protein, 7 aa, Homo sapiens
KIKLGRK

SEQ ID NO: 11683 - protein, 13 aa, Homo sapiens
RKELPEYYELIRK

SEQ ID NO: 11684 - protein, 12 aa, Homo sapiens
KVSYKGSPAARR

SEQ ID NO: 11685 - protein, 12 aa, Homo sapiens
KVSYKGSPAARR

SEQ ID NO: 11686 - protein, 12 aa, Homo sapiens
KVSYKGSPAARR

SEQ ID NO: 11687 - protein, 9 aa, Homo sapiens
RKEKAQDRL

SEQ ID NO: 11688 - protein, 8 aa, Homo sapiens
RLKGGRRR

SEQ ID NO: 11689 - protein, 9 aa, Homo sapiens
RITEKLEKQ

SEQ ID NO: 11690 - protein, 9 aa, Homo sapiens
RITEKLEKQ

SEQ ID NO: 11691 - protein, 9 aa, Homo sapiens
RITEKLEKQ

SEQ ID NO: 11692 - protein, 10 aa, Homo sapiens
KQQKIEQERK

SEQ ID NO: 11693 - protein, 11 aa, Homo sapiens
RQHKAAQVAKE

SEQ ID NO: 11694 - protein, 19 aa, Homo sapiens
KKKIPDPDSDDVSEVDARH

SEQ ID NO: 11695 - protein, 19 aa, Homo sapiens
KKKIPDPDSDDVSEVDARH

SEQ ID NO: 11696 - protein, 24 aa, Homo sapiens
RHIIENAKQDVDDEYGVSQALARG

SEQ ID NO: 11697 - protein, 24 aa, Homo sapiens
RHIIENAKQDVDDEYGVSQALARG

SEQ ID NO: 11698 - protein, 24 aa, Homo sapiens
RHIIENAKQDVDDEYGVSQALARG

SEQ ID NO: 11699 - protein, 9 aa, Homo sapiens
RIRNHKYRS

SEQ ID NO: 11700 - protein, 9 aa, Homo sapiens
RIRNHKYRS

SEQ ID NO: 11701 - protein, 9 aa, Homo sapiens
RDKDDESKK

SEQ ID NO: 11702 - protein, 8 aa, Homo sapiens
KLIDQKKD

SEQ ID NO: 11703 - protein, 9 aa, Homo sapiens
RKLIDQKKD

SEQ ID NO: 11704 - protein, 8 aa, Homo sapiens
KLIDQKKD

SEQ ID NO: 11705 - protein, 9 aa, Homo sapiens
RKLIDQKKD

SEQ ID NO: 11706 - protein, 9 aa, Homo sapiens
RKLIDQKKD

SEQ ID NO: 11707 - protein, 8 aa, Homo sapiens
KLIDQKKD

SEQ ID NO: 11708 - protein, 9 aa, Homo sapiens
RKLIDQKKD

SEQ ID NO: 11709 - protein, 8 aa, Homo sapiens
KLIDQKKD

SEQ ID NO: 11710 - protein, 6 aa, Homo sapiens
KRKPRL

SEQ ID NO: 11711 - protein, 6 aa, Homo sapiens
KRKPRL

SEQ ID NO: 11712 - protein, 6 aa, Homo sapiens
KRKPRL

SEQ ID NO: 11713 - protein, 6 aa, Homo sapiens
KRKPRL

SEQ ID NO: 11714 - protein, 6 aa, Homo sapiens
KRKPRL

SEQ ID NO: 11715 - protein, 6 aa, Homo sapiens
KRKPRL

SEQ ID NO: 11716 - protein, 6 aa, Homo sapiens
KRKPRL

SEQ ID NO: 11717 - protein, 12 aa, Homo sapiens
RLDGTTKAEDRG

SEQ ID NO: 11718 - protein, 12 aa, Homo sapiens
RLDGTTKAEDRG

SEQ ID NO: 11719 - protein, 15 aa, Homo sapiens
RLTCEEEEEKMFGRG

SEQ ID NO: 11720 - protein, 12 aa, Homo sapiens
RLDGTTKAEDRG

SEQ ID NO: 11721 - protein, 12 aa, Homo sapiens
RLDGTTKAEDRG

SEQ ID NO: 11722 - protein, 12 aa, Homo sapiens
RLDGTTKAEDRG

SEQ ID NO: 11723 - protein, 12 aa, Homo sapiens
RLDGTTKAEDRG

SEQ ID NO: 11724 - protein, 12 aa, Homo sapiens
RLDGTTKAEDRG

SEQ ID NO: 11725 - protein, 15 aa, Homo sapiens
KYLRLDGTTKAEDRG

SEQ ID NO: 11726 - protein, 8 aa, Homo sapiens
RLKGGRRR

SEQ ID NO: 11727 - protein, 7 aa, Homo sapiens
RLKGGRR

SEQ ID NO: 11728 - protein, 7 aa, Homo sapiens
RLKGGRR

SEQ ID NO: 11729 - protein, 7 aa, Homo sapiens
RLKGGRR

SEQ ID NO: 11730 - protein, 12 aa, Homo sapiens
RLDGTTKAEDRG

SEQ ID NO: 11731 - protein, 16 aa, Homo sapiens
RHRKEVDYSDSLTEKQ

SEQ ID NO: 11732 - protein, 12 aa, Homo sapiens
RLDGTTKAEDRG

SEQ ID NO: 11733 - protein, 12 aa, Homo sapiens
RLDGTTKAEDRG

SEQ ID NO: 11734 - protein, 12 aa, Homo sapiens
RLDGTTKAEDRG

SEQ ID NO: 11735 - protein, 7 aa, Homo sapiens
KIKLGRK

SEQ ID NO: 11736 - protein, 12 aa, Homo sapiens
RLDGTTKAEDRG

SEQ ID NO: 11737 - protein, 6 aa, Homo sapiens
KKSSRK

SEQ ID NO: 11738 - protein, 12 aa, Homo sapiens
RLDGTTKAEDRG

SEQ ID NO: 11739 - protein, 12 aa, Homo sapiens
KVSYKGSPAARR

SEQ ID NO: 11740 - protein, 12 aa, Homo sapiens
KVSYKGSPAARR

SEQ ID NO: 11741 - protein, 12 aa, Homo sapiens
KVSYKGSPAARR

SEQ ID NO: 11742 - protein, 12 aa, Homo sapiens
KVSYKGSPAARR

SEQ ID NO: 11743 - protein, 12 aa, Homo sapiens
KVSYKGSPAARR

SEQ ID NO: 11744 - protein, 24 aa, Homo sapiens
RGMLLKTFNEPGSEYFIFLLSTRA

SEQ ID NO: 11745 - protein, 24 aa, Homo sapiens
RGMLLKTFNEPGSEYFIFLLSTRA

SEQ ID NO: 11746 - protein, 24 aa, Homo sapiens
RGMLLKTFNEPGSEYFIFLLSTRA

SEQ ID NO: 11747 - protein, 24 aa, Homo sapiens
RGMLLKTFNEPGSEYFIFLLSTRA

SEQ ID NO: 11748 - protein, 24 aa, Homo sapiens
RGMLLKTFNEPGSEYFIFLLSTRA

SEQ ID NO: 11749 - protein, 9 aa, Homo sapiens
RIRNHKYRS

SEQ ID NO: 11750 - protein, 6 aa, Homo sapiens
KKMKKI

SEQ ID NO: 11751 - protein, 9 aa, Homo sapiens
RKEKAQDRL

SEQ ID NO: 11752 - protein, 9 aa, Homo sapiens
RKEKAQDRL

SEQ ID NO: 11753 - protein, 9 aa, Homo sapiens
RKEKAQDRL

SEQ ID NO: 11754 - protein, 9 aa, Homo sapiens
RKEKAQDRL

SEQ ID NO: 11755 - protein, 7 aa, Homo sapiens
KIKLGRK

SEQ ID NO: 11756 - protein, 7 aa, Homo sapiens
KIKLGRK

SEQ ID NO: 11757 - protein, 7 aa, Homo sapiens
RNHKYRS

SEQ ID NO: 11758 - protein, 9 aa, Homo sapiens
RIRNHKYRS

SEQ ID NO: 11759 - protein, 9 aa, Homo sapiens
RIRNHKYRS

SEQ ID NO: 11760 - protein, 7 aa, Homo sapiens
RNHKYRS

SEQ ID NO: 11761 - protein, 7 aa, Homo sapiens
RNHKYRS

SEQ ID NO: 11762 - protein, 7 aa, Homo sapiens
RNHKYRS

SEQ ID NO: 11763 - protein, 7 aa, Homo sapiens
RNHKYRS

SEQ ID NO: 11764 - protein, 7 aa, Homo sapiens
RNHKYRS

SEQ ID NO: 11765 - protein, 9 aa, Homo sapiens
RIRNHKYRS

SEQ ID NO: 11766 - protein, 7 aa, Homo sapiens
RNHKYRS

SEQ ID NO: 11767 - protein, 9 aa, Homo sapiens
RIRNHKYRS

SEQ ID NO: 11768 - protein, 7 aa, Homo sapiens
RNHKYRS

SEQ ID NO: 11769 - protein, 7 aa, Homo sapiens
RNHKYRS

SEQ ID NO: 11770 - protein, 7 aa, Homo sapiens
RNHKYRS

SEQ ID NO: 11771 - protein, 7 aa, Homo sapiens
RNHKYRS

SEQ ID NO: 11772 - protein, 7 aa, Homo sapiens
RNHKYRS

SEQ ID NO: 11773 - protein, 7 aa, Homo sapiens
RNHKYRS

SEQ ID NO: 11774 - protein, 7 aa, Homo sapiens
RLKGGRR

SEQ ID NO: 11775 - protein, 19 aa, Homo sapiens
RGRPPAEKLSPNPPNLTKK

SEQ ID NO: 11776 - protein, 8 aa, Homo sapiens
RKPVDFKK

SEQ ID NO: 11777 - protein, 8 aa, Homo sapiens
RKPVDFKK

SEQ ID NO: 11778 - protein, 8 aa, Homo sapiens
RKPVDFKK

SEQ ID NO: 11779 - protein, 6 aa, Homo sapiens
KKMKKI

SEQ ID NO: 11780 - protein, 7 aa, Homo sapiens
KIKLGRK

SEQ ID NO: 11781 - protein, 7 aa, Homo sapiens
KIKLGRK

SEQ ID NO: 11782 - protein, 7 aa, Homo sapiens
KIKLGRK

SEQ ID NO: 11783 - protein, 16 aa, Homo sapiens
RHRKEVDYSDSLTEKQ

SEQ ID NO: 11784 - protein, 16 aa, Homo sapiens
RHRKEVDYSDSLTEKQ

SEQ ID NO: 11785 - protein, 7 aa, Homo sapiens
RLKGGRR

SEQ ID NO: 11786 - protein, 7 aa, Homo sapiens
RLKGGRR

SEQ ID NO: 11787 - protein, 18 aa, Homo sapiens
RKRDSDAGSSTPTTSTRS

SEQ ID NO: 11788 - protein, 18 aa, Homo sapiens
RKRDSDAGSSTPTTSTRS

SEQ ID NO: 11789 - protein, 18 aa, Homo sapiens
RKRDSDAGSSTPTTSTRS

SEQ ID NO: 11790 - protein, 14 aa, Homo sapiens
RKEVDYSDSLTEKQ

SEQ ID NO: 11791 - protein, 7 aa, Homo sapiens
RNHKYRS

SEQ ID NO: 11792 - protein, 9 aa, Homo sapiens
RIRNHKYRS

SEQ ID NO: 11793 - protein, 16 aa, Homo sapiens
RHRKEVDYSDSLTEKQ

SEQ ID NO: 11794 - protein, 12 aa, Homo sapiens
KVSYKGSPAARR

SEQ ID NO: 11795 - protein, 16 aa, Homo sapiens
RHRKEVDYSDSLTEKQ

SEQ ID NO: 11796 - protein, 16 aa, Homo sapiens
RHRKEVDYSDSLTEKQ

SEQ ID NO: 11797 - protein, 7 aa, Homo sapiens
RLKGGRR

SEQ ID NO: 11798 - protein, 7 aa, Homo sapiens
RLKGGRR

SEQ ID NO: 11799 - protein, 7 aa, Homo sapiens
RLKGGRR

SEQ ID NO: 11800 - protein, 7 aa, Homo sapiens
RLKGGRR

SEQ ID NO: 11801 - protein, 13 aa, Homo sapiens
RWKYMIVDEGHRM

SEQ ID NO: 11802 - protein, 13 aa, Homo sapiens
RWKYMIVDEGHRM

SEQ ID NO: 11803 - protein, 9 aa, Homo sapiens
KVKIKLGRK

SEQ ID NO: 11804 - protein, 9 aa, Homo sapiens
RKEKAQDRL

SEQ ID NO: 11805 - protein, 9 aa, Homo sapiens
RKEKAQDRL

SEQ ID NO: 11806 - protein, 7 aa, Homo sapiens
KIKLGRK

SEQ ID NO: 11807 - protein, 9 aa, Homo sapiens
RKEKAQDRL

SEQ ID NO: 11808 - protein, 9 aa, Homo sapiens
RKEKAQDRL

SEQ ID NO: 11809 - protein, 9 aa, Homo sapiens
RKEKAQDRL

SEQ ID NO: 11810 - protein, 9 aa, Homo sapiens
RKEKAQDRL

SEQ ID NO: 11811 - protein, 9 aa, Homo sapiens
RKEKAQDRL

SEQ ID NO: 11812 - protein, 7 aa, Homo sapiens
KIKLGRK

SEQ ID NO: 11813 - protein, 6 aa, Homo sapiens
KIKERI

SEQ ID NO: 11814 - protein, 6 aa, Homo sapiens
KIKERI

SEQ ID NO: 11815 - protein, 7 aa, Homo sapiens
KKIKERI

SEQ ID NO: 11816 - protein, 7 aa, Homo sapiens
RLKGGRR

SEQ ID NO: 11817 - protein, 13 aa, Homo sapiens
RLHKVLRPFLLRR

SEQ ID NO: 11818 - protein, 13 aa, Homo sapiens
RLHKVLRPFLLRR

SEQ ID NO: 11819 - protein, 13 aa, Homo sapiens
RLHKVLRPFLLRR

SEQ ID NO: 11820 - protein, 13 aa, Homo sapiens
RWKYMIVDEGHRM

SEQ ID NO: 11821 - protein, 13 aa, Homo sapiens
RWKYMIVDEGHRM

SEQ ID NO: 11822 - protein, 13 aa, Homo sapiens
RWKYMIVDEGHRM

SEQ ID NO: 11823 - protein, 24 aa, Homo sapiens
RHIIENAKQDVDDEYGVSQALARG

SEQ ID NO: 11824 - protein, 13 aa, Homo sapiens
RWKYMIVDEGHRM

SEQ ID NO: 11825 - protein, 24 aa, Homo sapiens
RHIIENAKQDVDDEYGVSQALARG

SEQ ID NO: 11826 - protein, 13 aa, Homo sapiens
RWKYMIVDEGHRM

SEQ ID NO: 11827 - protein, 18 aa, Homo sapiens
KTIQTIALITYLMEHKRI

SEQ ID NO: 11828 - protein, 10 aa, Homo sapiens
REQKKENERI

SEQ ID NO: 11829 - protein, 10 aa, Homo sapiens
REQKKENERI

SEQ ID NO: 11830 - protein, 7 aa, Homo sapiens
KKENERI

SEQ ID NO: 11831 - protein, 8 aa, Homo sapiens
KLIDQKKD

SEQ ID NO: 11832 - protein, 10 aa, Homo sapiens
KYKLNVDQKV

SEQ ID NO: 11833 - protein, 16 aa, Homo sapiens
KILAAAKYKLNVDQKV

SEQ ID NO: 11834 - protein, 10 aa, Homo sapiens
KYKLNVDQKV

SEQ ID NO: 11835 - protein, 10 aa, Homo sapiens
REEARNPKRK

SEQ ID NO: 11836 - protein, 10 aa, Homo sapiens
REEARNPKRK

SEQ ID NO: 11837 - protein, 10 aa, Homo sapiens
REEARNPKRK

SEQ ID NO: 11838 - protein, 8 aa, Homo sapiens
RKPVDFKK

SEQ ID NO: 11839 - protein, 8 aa, Homo sapiens
KIQKLTKA

SEQ ID NO: 11840 - protein, 18 aa, Homo sapiens
RKRDSDAGSSTPTTSTRS

SEQ ID NO: 11841 - protein, 18 aa, Homo sapiens
RKRDSDAGSSTPTTSTRS

SEQ ID NO: 11842 - protein, 18 aa, Homo sapiens
RKRDSDAGSSTPTTSTRS

SEQ ID NO: 11843 - protein, 8 aa, Homo sapiens
RQKKSSRK

SEQ ID NO: 11844 - protein, 9 aa, Homo sapiens
RAKDDIKKV

SEQ ID NO: 11845 - protein, 6 aa, Homo sapiens
RWEKRW

SEQ ID NO: 11846 - protein, 11 aa, Homo sapiens
KVMATIEKVRR

SEQ ID NO: 11847 - protein, 9 aa, Homo sapiens
RAKDDIKKV

SEQ ID NO: 11848 - protein, 11 aa, Homo sapiens
KVMATIEKVRR

SEQ ID NO: 11849 - protein, 11 aa, Homo sapiens
KVMATIEKVRR

SEQ ID NO: 11850 - protein, 9 aa, Homo sapiens
RAKDDIKKV

SEQ ID NO: 11851 - protein, 9 aa, Homo sapiens
RAKDDIKKV

SEQ ID NO: 11852 - protein, 9 aa, Homo sapiens
RAKDDIKKV

SEQ ID NO: 11853 - protein, 11 aa, Homo sapiens
KVMATIEKVRR

SEQ ID NO: 11854 - protein, 6 aa, Homo sapiens
RKWEKK

SEQ ID NO: 11855 - protein, 6 aa, Homo sapiens
RKWEKK

SEQ ID NO: 11856 - protein, 7 aa, Homo sapiens
RKWEKKW

SEQ ID NO: 11857 - protein, 9 aa, Homo sapiens
RAKDDIKRV

SEQ ID NO: 11858 - protein, 13 aa, Homo sapiens
RIYKWVPVTEPKV

SEQ ID NO: 11859 - protein, 9 aa, Homo sapiens
RAKDDIKRV

SEQ ID NO: 11860 - protein, 9 aa, Homo sapiens
RAKDDIKRV

SEQ ID NO: 11861 - protein, 9 aa, Homo sapiens
RAKDDIKRV

SEQ ID NO: 11862 - protein, 11 aa, Homo sapiens
RVMAAIEKVRK

SEQ ID NO: 11863 - protein, 11 aa, Homo sapiens
RVMAAIEKVRK

SEQ ID NO: 11864 - protein, 11 aa, Homo sapiens
RVMAAIEKVRK

SEQ ID NO: 11865 - protein, 9 aa, Homo sapiens
RAKDDIKRV

SEQ ID NO: 11866 - protein, 9 aa, Homo sapiens
RAKDDIKRV

SEQ ID NO: 11867 - protein, 11 aa, Homo sapiens
RVMAAIEKVRK

SEQ ID NO: 11868 - protein, 11 aa, Homo sapiens
RVMAAIEKVRK

SEQ ID NO: 11869 - protein, 9 aa, Homo sapiens
RAKDDIKRV

SEQ ID NO: 11870 - protein, 9 aa, Homo sapiens
RAKDDIKRV

SEQ ID NO: 11871 - protein, 9 aa, Homo sapiens
RAKDDIKRV

SEQ ID NO: 11872 - protein, 9 aa, Homo sapiens
RAKDDIKRV

SEQ ID NO: 11873 - protein, 9 aa, Homo sapiens
RAKDDIKRV

SEQ ID NO: 11874 - protein, 11 aa, Homo sapiens
RVMAAIEKVRK

SEQ ID NO: 11875 - protein, 9 aa, Homo sapiens
RAKDDIKRV

SEQ ID NO: 11876 - protein, 9 aa, Homo sapiens
RAKDDIKRV

SEQ ID NO: 11877 - protein, 7 aa, Homo sapiens
RKWEKKW

SEQ ID NO: 11878 - protein, 13 aa, Homo sapiens
KKWVTVGDTSLRI

SEQ ID NO: 11879 - protein, 13 aa, Homo sapiens
KKWVTVGDTSLRI

SEQ ID NO: 11880 - protein, 13 aa, Homo sapiens
KKWVTVGDTSLRI

SEQ ID NO: 11881 - protein, 13 aa, Homo sapiens
KKWVTVGDTSLRI

SEQ ID NO: 11882 - protein, 13 aa, Homo sapiens
KKWVTVGDTSLRI

SEQ ID NO: 11883 - protein, 10 aa, Homo sapiens
KVDDKNKNKK

SEQ ID NO: 11884 - protein, 8 aa, Homo sapiens
KVDDKNKN

SEQ ID NO: 11885 - protein, 13 aa, Homo sapiens
KKWVTVGDTSLRI

SEQ ID NO: 11886 - protein, 13 aa, Homo sapiens
KKWVTVGDTSLRI

SEQ ID NO: 11887 - protein, 9 aa, Homo sapiens
RAKDDIKRV

SEQ ID NO: 11888 - protein, 10 aa, Homo sapiens
KVDDKNKNKK

SEQ ID NO: 11889 - protein, 12 aa, Homo sapiens
RVMAAIEKVRKW

SEQ ID NO: 11890 - protein, 10 aa, Homo sapiens
KVDDKNKNKK

SEQ ID NO: 11891 - protein, 8 aa, Homo sapiens
KVDDKNKN

SEQ ID NO: 11892 - protein, 11 aa, Homo sapiens
RVMAAIEKVRK

SEQ ID NO: 11893 - protein, 11 aa, Homo sapiens
RVMAAIEKVRK

SEQ ID NO: 11894 - protein, 13 aa, Homo sapiens
KKWVTVGDTSLRI

SEQ ID NO: 11895 - protein, 7 aa, Homo sapiens
RKWEKKW

SEQ ID NO: 11896 - protein, 6 aa, Homo sapiens
KWEKKW

SEQ ID NO: 11897 - protein, 11 aa, Homo sapiens
RVMAAIEKVRK

SEQ ID NO: 11898 - protein, 13 aa, Homo sapiens
RIYKWVPVTEPKV

SEQ ID NO: 11899 - protein, 13 aa, Homo sapiens
RIYKWVPVTEPKV

SEQ ID NO: 11900 - protein, 11 aa, Homo sapiens
RVMAAIEKVRK

SEQ ID NO: 11901 - protein, 8 aa, Homo sapiens
KKGKDEKC

SEQ ID NO: 11902 - protein, 11 aa, Homo sapiens
RVMAAIEKVRK

SEQ ID NO: 11903 - protein, 7 aa, Homo sapiens
RKWEKKW

SEQ ID NO: 11904 - protein, 11 aa, Homo sapiens
RVMAAIEKVRK

SEQ ID NO: 11905 - protein, 6 aa, Homo sapiens
RKWEKK

SEQ ID NO: 11906 - protein, 6 aa, Homo sapiens
RKWEKK

SEQ ID NO: 11907 - protein, 6 aa, Homo sapiens
RKWEKK

SEQ ID NO: 11908 - protein, 11 aa, Homo sapiens
RVMAAIEKVRK

SEQ ID NO: 11909 - protein, 7 aa, Homo sapiens
RKWEKKW

SEQ ID NO: 11910 - protein, 24 aa, Homo sapiens
RKDLYANTVLSGGSTMYPGIADRM

SEQ ID NO: 11911 - protein, 15 aa, Homo sapiens
KSHRNIKLLEDEPRS

SEQ ID NO: 11912 - protein, 11 aa, Homo sapiens
KKNNLFVVDRS

SEQ ID NO: 11913 - protein, 11 aa, Homo sapiens
KKNNLFVVDRS

SEQ ID NO: 11914 - protein, 12 aa, Homo sapiens
KFDKLPIKIVKK

SEQ ID NO: 11915 - protein, 11 aa, Homo sapiens
KKNNLFVVDRS

SEQ ID NO: 11916 - protein, 11 aa, Homo sapiens
KKNNLFVVDRS

SEQ ID NO: 11917 - protein, 11 aa, Homo sapiens
KKNNLFVVDRS

SEQ ID NO: 11918 - protein, 11 aa, Homo sapiens
KKNNLFVVDRS

SEQ ID NO: 11919 - protein, 11 aa, Homo sapiens
KKNNLFVVDRS

SEQ ID NO: 11920 - protein, 8 aa, Homo sapiens
RKLWVDRY

SEQ ID NO: 11921 - protein, 15 aa, Homo sapiens
KITKVYELGNEPERK

SEQ ID NO: 11922 - protein, 8 aa, Homo sapiens
RKLWVDRY

SEQ ID NO: 11923 - protein, 8 aa, Homo sapiens
RKLWVDRY

SEQ ID NO: 11924 - protein, 21 aa, Homo sapiens
RGSPVSSLPAVGKKPLDLFRL

SEQ ID NO: 11925 - protein, 9 aa, Homo sapiens
KKPLDLFRL

SEQ ID NO: 11926 - protein, 9 aa, Homo sapiens
KKPLDLFRL

SEQ ID NO: 11927 - protein, 21 aa, Homo sapiens
RGSPVSSLPAVGKKPLDLFRL

SEQ ID NO: 11928 - protein, 23 aa, Homo sapiens
RSSTISVHDPFSDVSDSSFPKRN

SEQ ID NO: 11929 - protein, 23 aa, Homo sapiens
RSSTISVHDPFSDVSDSSFPKRN

SEQ ID NO: 11930 - protein, 14 aa, Homo sapiens
RHMDGMYGPPAKRH

SEQ ID NO: 11931 - protein, 14 aa, Homo sapiens
RHMDGMYGPPAKRH

SEQ ID NO: 11932 - protein, 14 aa, Homo sapiens
KIVKKNNLFVVDRS

SEQ ID NO: 11933 - protein, 12 aa, Homo sapiens
RQEKFYATLVRY

SEQ ID NO: 11934 - protein, 12 aa, Homo sapiens
RQEKFYATLVRY

SEQ ID NO: 11935 - protein, 12 aa, Homo sapiens
RNIKLLEDEPRS

SEQ ID NO: 11936 - protein, 12 aa, Homo sapiens
RNIKLLEDEPRS

SEQ ID NO: 11937 - protein, 12 aa, Homo sapiens
RNIKLLEDEPRS

SEQ ID NO: 11938 - protein, 12 aa, Homo sapiens
RNIKLLEDEPRS

SEQ ID NO: 11939 - protein, 12 aa, Homo sapiens
RNIKLLEDEPRS

SEQ ID NO: 11940 - protein, 8 aa, Homo sapiens
RKNPVCRE

SEQ ID NO: 11941 - protein, 8 aa, Homo sapiens
RKNPVCRE

SEQ ID NO: 11942 - protein, 8 aa, Homo sapiens
RKNPVCRE

SEQ ID NO: 11943 - protein, 8 aa, Homo sapiens
RKNPVCRE

SEQ ID NO: 11944 - protein, 8 aa, Homo sapiens
RKNPVCRE

SEQ ID NO: 11945 - protein, 8 aa, Homo sapiens
RKNPVCRE

SEQ ID NO: 11946 - protein, 39 aa, Homo sapiens; identical to SEQ ID NO: 956

SEQ ID NO: 11947 - protein, 14 aa, Homo sapiens
RHMDGMYGPPAKRH

SEQ ID NO: 11948 - protein, 14 aa, Homo sapiens
RHMDGMYGPPAKRH

SEQ ID NO: 11949 - protein, 14 aa, Homo sapiens
RHMDGMYGPPAKRH

SEQ ID NO: 11950 - protein, 14 aa, Homo sapiens
RHMDGMYGPPAKRH

SEQ ID NO: 11951 - protein, 14 aa, Homo sapiens
RHMDGMYGPPAKRH

SEQ ID NO: 11952 - protein, 39 aa, Homo sapiens; identical to SEQ ID NO: 956

SEQ ID NO: 11953 - protein, 39 aa, Homo sapiens; identical to SEQ ID NO: 956

SEQ ID NO: 11954 - protein, 39 aa, Homo sapiens; identical to SEQ ID NO: 956

SEQ ID NO: 11955 - protein, 39 aa, Homo sapiens; identical to SEQ ID NO: 956

SEQ ID NO: 11956 - protein, 39 aa, Homo sapiens; identical to SEQ ID NO: 956

SEQ ID NO: 11957 - protein, 14 aa, Homo sapiens
RHMDGMYGPPAKRH

SEQ ID NO: 11958 - protein, 38 aa, Homo sapiens; identical to SEQ ID NO: 957

SEQ ID NO: 11959 - protein, 39 aa, Homo sapiens; identical to SEQ ID NO: 956

SEQ ID NO: 11960 - protein, 39 aa, Homo sapiens; identical to SEQ ID NO: 956

SEQ ID NO: 11961 - protein, 14 aa, Homo sapiens
RHMDGMYGPPAKRH

SEQ ID NO: 11962 - protein, 39 aa, Homo sapiens; identical to SEQ ID NO: 956

SEQ ID NO: 11963 - protein, 14 aa, Homo sapiens
RHMDGMYGPPAKRH

SEQ ID NO: 11964 - protein, 38 aa, Homo sapiens; identical to SEQ ID NO: 957

SEQ ID NO: 11965 - protein, 14 aa, Homo sapiens
RHMDGMYGPPAKRH

SEQ ID NO: 11966 - protein, 8 aa, Homo sapiens
RKNPVCRE

SEQ ID NO: 11967 - protein, 8 aa, Homo sapiens
RKNPVCRE

SEQ ID NO: 11968 - protein, 8 aa, Homo sapiens
RKNPVCRE

SEQ ID NO: 11969 - protein, 14 aa, Homo sapiens
RHMDGMYGPPAKRH

SEQ ID NO: 11970 - protein, 14 aa, Homo sapiens
RHMDGMYGPPAKRH

SEQ ID NO: 11971 - protein, 14 aa, Homo sapiens
RHMDGMYGPPAKRH

SEQ ID NO: 11972 - protein, 14 aa, Homo sapiens
RHMDGMYGPPAKRH

SEQ ID NO: 11973 - protein, 14 aa, Homo sapiens
RHMDGMYGPPAKRH

SEQ ID NO: 11974 - protein, 29 aa, Homo sapiens
RLVLETLCKLSIQDNNVDLILATPPFSRQ

SEQ ID NO: 11975 - protein, 20 aa, Homo sapiens
KGVACSKDEWWWDCLEVLRD

SEQ ID NO: 11976 - protein, 15 aa, Homo sapiens
RAPQTYEKEEDEDKG

SEQ ID NO: 11977 - protein, 15 aa, Homo sapiens
RAPQTYEKEEDEDKG

SEQ ID NO: 11978 - protein, 20 aa, Homo sapiens
KGVACSKDEWWWDCLEVLRD

SEQ ID NO: 11979 - protein, 20 aa, Homo sapiens
KGVACSKDEWWWDCLEVLRD

SEQ ID NO: 11980 - protein, 20 aa, Homo sapiens
KGVACSKDEWWWDCLEVLRD

SEQ ID NO: 11981 - protein, 20 aa, Homo sapiens
KGVACSKDEWWWDCLEVLRD

SEQ ID NO: 11982 - protein, 20 aa, Homo sapiens
KGVACSKDEWWWDCLEVLRD

SEQ ID NO: 11983 - protein, 20 aa, Homo sapiens
KGVACSKDEWWWDCLEVLRD

SEQ ID NO: 11984 - protein, 15 aa, Homo sapiens
RAPQTYEKEEDEDKG

SEQ ID NO: 11985 - protein, 20 aa, Homo sapiens
KGVACSKDEWWWDCLEVLRD

SEQ ID NO: 11986 - protein, 20 aa, Homo sapiens
KGVACSKDEWWWDCLEVLRD

SEQ ID NO: 11987 - protein, 15 aa, Homo sapiens
RAPQTYEKEEDEDKG

SEQ ID NO: 11988 - protein, 15 aa, Homo sapiens
RAPQTYEKEEDEDKG

SEQ ID NO: 11989 - protein, 20 aa, Homo sapiens
KGVACSKDEWWWDCLEVLRD

SEQ ID NO: 11990 - protein, 11 aa, Homo sapiens
KKNNLFVVDRS

SEQ ID NO: 11991 - protein, 12 aa, Homo sapiens
RNIKLLEDEPRS

SEQ ID NO: 11992 - protein, 12 aa, Homo sapiens
RNIKLLEDEPRS

SEQ ID NO: 11993 - protein, 12 aa, Homo sapiens
RNIKLLEDEPRS

SEQ ID NO: 11994 - protein, 12 aa, Homo sapiens
RNIKLLEDEPRS

SEQ ID NO: 11995 - protein, 8 aa, Homo sapiens
RKLWVDRY

SEQ ID NO: 11996 - protein, 8 aa, Homo sapiens
RKLWVDRY

SEQ ID NO: 11997 - protein, 8 aa, Homo sapiens
RSDKLGRV

SEQ ID NO: 11998 - protein, 21 aa, Homo sapiens
REITFPPGSVEASQPVLKQRR

SEQ ID NO: 11999 - protein, 22 aa, Homo sapiens
RSRDETPLCTIAHWQDSLAKRC

SEQ ID NO: 12000 - protein, 22 aa, Homo sapiens
RSRDETPLCTIAHWQDSLAKRC

SEQ ID NO: 12001 - protein, 21 aa, Homo sapiens
REITFPPGSVEASQPVLKQRR

SEQ ID NO: 12002 - protein, 21 aa, Homo sapiens
REITFPPGSVEASQPVLKQRR

SEQ ID NO: 12003 - protein, 21 aa, Homo sapiens
REITFPPGSVEASQPVLKQRR

SEQ ID NO: 12004 - protein, 21 aa, Homo sapiens
REITFPPGSVEASQPVLKQRR

SEQ ID NO: 12005 - protein, 8 aa, Homo sapiens
RKNPVCRE

SEQ ID NO: 12006 - protein, 16 aa, Homo sapiens
RMPYEPNKDPFGGMRK

SEQ ID NO: 12007 - protein, 16 aa, Homo sapiens
RMPYEPNKDPFGGMRK

SEQ ID NO: 12008 - protein, 14 aa, Homo sapiens
RHMDGMYGPPAKRH

SEQ ID NO: 12009 - protein, 14 aa, Homo sapiens
RHMDGMYGPPAKRH

SEQ ID NO: 12010 - protein, 16 aa, Homo sapiens
RMPYEPNKDPFGGMRK

SEQ ID NO: 12011 - protein, 16 aa, Homo sapiens
RMPYEPNKDPFGGMRK

SEQ ID NO: 12012 - protein, 16 aa, Homo sapiens
RMPYEPNKDPFGGMRK

SEQ ID NO: 12013 - protein, 23 aa, Homo sapiens
RSGHPSCLQFTPVMMAAVKTYRW

SEQ ID NO: 12014 - protein, 18 aa, Homo sapiens
KKTGQPEELVSCSDCGRS

SEQ ID NO: 12015 - protein, 23 aa, Homo sapiens
RSGHPSCLQFTPVMMAAVKTYRW

SEQ ID NO: 12016 - protein, 23 aa, Homo sapiens
RSGHPSCLQFTPVMMAAVKTYRW

SEQ ID NO: 12017 - protein, 18 aa, Homo sapiens
KKTGQPEELVSCSDCGRS

SEQ ID NO: 12018 - protein, 18 aa, Homo sapiens
KKTGQPEELVSCSDCGRS

SEQ ID NO: 12019 - protein, 23 aa, Homo sapiens
RSGHPSCLQFTPVMMAAVKTYRW

SEQ ID NO: 12020 - protein, 23 aa, Homo sapiens
RSGHPSCLQFTPVMMAAVKTYRW

SEQ ID NO: 12021 - protein, 18 aa, Homo sapiens
KKTGQPEELVSCSDCGRS

SEQ ID NO: 12022 - protein, 18 aa, Homo sapiens
KKTGQPEELVSCSDCGRS

SEQ ID NO: 12023 - protein, 18 aa, Homo sapiens
KKTGQPEELVSCSDCGRS

SEQ ID NO: 12024 - protein, 18 aa, Homo sapiens
KKTGQPEELVSCSDCGRS

SEQ ID NO: 12025 - protein, 23 aa, Homo sapiens
RSGHPSCLQFTPVMMAAVKTYRW

SEQ ID NO: 12026 - protein, 18 aa, Homo sapiens
KKTGQPEELVSCSDCGRS

SEQ ID NO: 12027 - protein, 18 aa, Homo sapiens
KKTGQPEELVSCSDCGRS

SEQ ID NO: 12028 - protein, 18 aa, Homo sapiens
KKTGQPEELVSCSDCGRS

SEQ ID NO: 12029 - protein, 23 aa, Homo sapiens
RSGHPSCLQFTPVMMAAVKTYRW

SEQ ID NO: 12030 - protein, 23 aa, Homo sapiens
RSGHPSCLQFTPVMMAAVKTYRW

SEQ ID NO: 12031 - protein, 23 aa, Homo sapiens
RSGHPSCLQFTPVMMAAVKTYRW

SEQ ID NO: 12032 - protein, 23 aa, Homo sapiens
RSGHPSCLQFTPVMMAAVKTYRW

SEQ ID NO: 12033 - protein, 18 aa, Homo sapiens
KKTGQPEELVSCSDCGRS

SEQ ID NO: 12034 - protein, 23 aa, Homo sapiens
RSGHPSCLQFTPVMMAAVKTYRW

SEQ ID NO: 12035 - protein, 18 aa, Homo sapiens
KKTGQPEELVSCSDCGRS

SEQ ID NO: 12036 - protein, 18 aa, Homo sapiens
RLSFPSIKPDTDQTLKKE

SEQ ID NO: 12037 - protein, 9 aa, Homo sapiens
RTDPLEKRG

SEQ ID NO: 12038 - protein, 18 aa, Homo sapiens
RLSFPSIKPDTDQTLKKE

SEQ ID NO: 12039 - protein, 18 aa, Homo sapiens
RLSFPSIKPDTDQTLKKE

SEQ ID NO: 12040 - protein, 17 aa, Homo sapiens
RLSFPSIKPDTDQTLKK

SEQ ID NO: 12041 - protein, 18 aa, Homo sapiens
RLSFPSIKPDTDQTLKKE

SEQ ID NO: 12042 - protein, 9 aa, Homo sapiens
RTDPLEKRG

SEQ ID NO: 12043 - protein, 10 aa, Homo sapiens
KGKGVGSARK

SEQ ID NO: 12044 - protein, 10 aa, Homo sapiens
KGKGVGSARK

SEQ ID NO: 12045 - protein, 9 aa, Homo sapiens
RTDPLEKRG

SEQ ID NO: 12046 - protein, 9 aa, Homo sapiens
RTDPLEKRG

SEQ ID NO: 12047 - protein, 9 aa, Homo sapiens
RTDPLEKRG

SEQ ID NO: 12048 - protein, 9 aa, Homo sapiens
RTDPLEKRG

SEQ ID NO: 12049 - protein, 10 aa, Homo sapiens
KGKGVGSARK

SEQ ID NO: 12050 - protein, 10 aa, Homo sapiens
KGKGVGSARK

SEQ ID NO: 12051 - protein, 21 aa, Homo sapiens
KINKKTGQPEELVSCSDCGRS

SEQ ID NO: 12052 - protein, 12 aa, Homo sapiens
KSKGKGVGSARK

SEQ ID NO: 12053 - protein, 10 aa, Homo sapiens
KGKGVGSARK

SEQ ID NO: 12054 - protein, 10 aa, Homo sapiens
KGKGVGSARK

SEQ ID NO: 12055 - protein, 36 aa, Homo sapiens; identical to SEQ ID NO: 963

SEQ ID NO: 12056 - protein, 10 aa, Homo sapiens
KGKGVGSARK

SEQ ID NO: 12057 - protein, 23 aa, Homo sapiens
RSGHPSCLQFTPVMMAAVKTYRW

SEQ ID NO: 12058 - protein, 10 aa, Homo sapiens
KGKGVGSARK

SEQ ID NO: 12059 - protein, 13 aa, Homo sapiens
RKKLDASILEDRD

SEQ ID NO: 12060 - protein, 10 aa, Homo sapiens
KGKGVGSARK

SEQ ID NO: 12061 - protein, 10 aa, Homo sapiens
KGKGVGSARK

SEQ ID NO: 12062 - protein, 14 aa, Homo sapiens
RDKPYACDICGKRY

SEQ ID NO: 12063 - protein, 14 aa, Homo sapiens
RDKPYACDICGKRY

SEQ ID NO: 12064 - protein, 14 aa, Homo sapiens
RDKPYACDICGKRY

SEQ ID NO: 12065 - protein, 9 aa, Homo sapiens
RTDPLEKRG

SEQ ID NO: 12066 - protein, 9 aa, Homo sapiens
RTDPLEKRG

SEQ ID NO: 12067 - protein, 9 aa, Homo sapiens
RTDPLEKRG

SEQ ID NO: 12068 - protein, 19 aa, Homo sapiens
KKEGLISQDGSSLEALLRT

SEQ ID NO: 12069 - protein, 19 aa, Homo sapiens
KKEGLISQDGSSLEALLRT

SEQ ID NO: 12070 - protein, 27 aa, Homo sapiens
KPDTDQTLKKEGLISQDGSSLEALLRT

SEQ ID NO: 12071 - protein, 27 aa, Homo sapiens
KPDTDQTLKKEGLISQDGSSLEALLRT

SEQ ID NO: 12072 - protein, 27 aa, Homo sapiens
KPDTDQTLKKEGLISQDGSSLEALLRT

SEQ ID NO: 12073 - protein, 19 aa, Homo sapiens
KKEGLISQDGSSLEALLRT

SEQ ID NO: 12074 - protein, 27 aa, Homo sapiens
KPDTDQTLKKEGLISQDGSSLEALLRT

SEQ ID NO: 12075 - protein, 27 aa, Homo sapiens
KPDTDQTLKKEGLISQDGSSLEALLRT

SEQ ID NO: 12076 - protein, 18 aa, Homo sapiens
KKTGQPEELVSCSDCGRS

SEQ ID NO: 12077 - protein, 18 aa, Homo sapiens
KKTGQPEELVSCSDCGRS

SEQ ID NO: 12078 - protein, 18 aa, Homo sapiens
KKTGQPEELVSCSDCGRS

SEQ ID NO: 12079 - protein, 18 aa, Homo sapiens
KKTGQPEELVSCSDCGRS

SEQ ID NO: 12080 - protein, 18 aa, Homo sapiens
KKTGQPEELVSCSDCGRS

SEQ ID NO: 12081 - protein, 9 aa, Homo sapiens
RSEEQKSKK

SEQ ID NO: 12082 - protein, 9 aa, Homo sapiens
RSEEQKSKK

SEQ ID NO: 12083 - protein, 36 aa, Homo sapiens; identical to SEQ ID NO: 963

SEQ ID NO: 12084 - protein, 36 aa, Homo sapiens; identical to SEQ ID NO: 963

SEQ ID NO: 12085 - protein, 9 aa, Homo sapiens
RSEEQKSKK

SEQ ID NO: 12086 - protein, 26 aa, Homo sapiens
RLPFLDSQTGVAQSNCYIWMEKRHRG

SEQ ID NO: 12087 - protein, 26 aa, Homo sapiens
RLPFLDSQTGVAQSNCYIWMEKRHRG

SEQ ID NO: 12088 - protein, 23 aa, Homo sapiens
KKGPDGLALPNNYCDFCLGDSKI

SEQ ID NO: 12089 - protein, 18 aa, Homo sapiens
KKTGQPEELVSCSDCGRS

SEQ ID NO: 12090 - protein, 9 aa, Homo sapiens
RSEEQKSKK

SEQ ID NO: 12091 - protein, 9 aa, Homo sapiens
RSEEQKSKK

SEQ ID NO: 12092 - protein, 9 aa, Homo sapiens
RSEEQKSKK

SEQ ID NO: 12093 - protein, 9 aa, Homo sapiens
RSEEQKSKK

SEQ ID NO: 12094 - protein, 9 aa, Homo sapiens
RSEEQKSKK

SEQ ID NO: 12095 - protein, 9 aa, Homo sapiens
RSEEQKSKK

SEQ ID NO: 12096 - protein, 9 aa, Homo sapiens
RSEEQKSKK

SEQ ID NO: 12097 - protein, 9 aa, Homo sapiens
RSEEQKSKK

SEQ ID NO: 12098 - protein, 9 aa, Homo sapiens
RSEEQKSKK

SEQ ID NO: 12099 - protein, 23 aa, Homo sapiens
KKGPDGLALPNNYCDFCLGDSKI

SEQ ID NO: 12100 - protein, 9 aa, Homo sapiens
RSEEQKSKK

SEQ ID NO: 12101 - protein, 23 aa, Homo sapiens
KKGPDGLALPNNYCDFCLGDSKI

SEQ ID NO: 12102 - protein, 9 aa, Homo sapiens
RSEEQKSKK

SEQ ID NO: 12103 - protein, 23 aa, Homo sapiens
KKGPDGLALPNNYCDFCLGDSKI

SEQ ID NO: 12104 - protein, 9 aa, Homo sapiens
RSEEQKSKK

SEQ ID NO: 12105 - protein, 23 aa, Homo sapiens
RSGHPSCLQFTPVMMAAVKTYRW

SEQ ID NO: 12106 - protein, 23 aa, Homo sapiens
RSGHPSCLQFTPVMMAAVKTYRW

SEQ ID NO: 12107 - protein, 23 aa, Homo sapiens
RSGHPSCLQFTPVMMAAVKTYRW

SEQ ID NO: 12108 - protein, 10 aa, Homo sapiens
KGKGVGSARK

SEQ ID NO: 12109 - protein, 10 aa, Homo sapiens
KGKGVGSARK

SEQ ID NO: 12110 - protein, 12 aa, Homo sapiens
KSKGKGVGSARK

SEQ ID NO: 12111 - protein, 10 aa, Homo sapiens
KGKGVGSARK

SEQ ID NO: 12112 - protein, 10 aa, Homo sapiens
KGKGVGSARK

SEQ ID NO: 12113 - protein, 25 aa, Homo sapiens
RILEPDDFLDDLDDEDYEEDTPKRR

SEQ ID NO: 12114 - protein, 10 aa, Homo sapiens
KGKGVGSARK

SEQ ID NO: 12115 - protein, 6 aa, Homo sapiens
KSKGKG

SEQ ID NO: 12116 - protein, 26 aa, Homo sapiens
RILEPDDFLDDLDDEDYEEDTPKRRG

SEQ ID NO: 12117 - protein, 26 aa, Homo sapiens
RILEPDDFLDDLDDEDYEEDTPKRRG

SEQ ID NO: 12118 - protein, 13 aa, Homo sapiens
RKKLDASILEDRD

SEQ ID NO: 12119 - protein, 13 aa, Homo sapiens
RKKLDASILEDRD

SEQ ID NO: 12120 - protein, 26 aa, Homo sapiens
RILEPDDFLDDLDDEDYEEDTPKRRG

SEQ ID NO: 12121 - protein, 7 aa, Homo sapiens
RRGKGKS

SEQ ID NO: 12122 - protein, 7 aa, Homo sapiens
RRGKGKS

SEQ ID NO: 12123 - protein, 7 aa, Homo sapiens
RRGKGKS

SEQ ID NO: 12124 - protein, 7 aa, Homo sapiens
RRGKGKS

SEQ ID NO: 12125 - protein, 8 aa, Homo sapiens
RGKGKSKG

SEQ ID NO: 12126 - protein, 8 aa, Homo sapiens
RGKGKSKG

SEQ ID NO: 12127 - protein, 17 aa, Homo sapiens
RLSFPSIKPDTDQTLKK

SEQ ID NO: 12128 - protein, 17 aa, Homo sapiens
RLSFPSIKPDTDQTLKK

SEQ ID NO: 12129 - protein, 9 aa, Homo sapiens
RSEEQKSKK

SEQ ID NO: 12130 - protein, 17 aa, Homo sapiens
RLSFPSIKPDTDQTLKK

SEQ ID NO: 12131 - protein, 17 aa, Homo sapiens
RLSFPSIKPDTDQTLKK

SEQ ID NO: 12132 - protein, 17 aa, Homo sapiens
RLSFPSIKPDTDQTLKK

SEQ ID NO: 12133 - protein, 17 aa, Homo sapiens
RLSFPSIKPDTDQTLKK

SEQ ID NO: 12134 - protein, 17 aa, Homo sapiens
RLSFPSIKPDTDQTLKK

SEQ ID NO: 12135 - protein, 17 aa, Homo sapiens
RLSFPSIKPDTDQTLKK

SEQ ID NO: 12136 - protein, 17 aa, Homo sapiens
RLSFPSIKPDTDQTLKK

SEQ ID NO: 12137 - protein, 17 aa, Homo sapiens
RLSFPSIKPDTDQTLKK

SEQ ID NO: 12138 - protein, 17 aa, Homo sapiens
RLSFPSIKPDTDQTLKK

SEQ ID NO: 12139 - protein, 17 aa, Homo sapiens
RLSFPSIKPDTDQTLKK

SEQ ID NO: 12140 - protein, 19 aa, Homo sapiens
KKEGLISQDGSSLEALLRT

SEQ ID NO: 12141 - protein, 17 aa, Homo sapiens
RLSFPSIKPDTDQTLKK

SEQ ID NO: 12142 - protein, 17 aa, Homo sapiens
RLSFPSIKPDTDQTLKK

SEQ ID NO: 12143 - protein, 19 aa, Homo sapiens
KKEGLISQDGSSLEALLRT

SEQ ID NO: 12144 - protein, 19 aa, Homo sapiens
KKEGLISQDGSSLEALLRT

SEQ ID NO: 12145 - protein, 18 aa, Homo sapiens
RLSFPSIKPDTDQTLKKE

SEQ ID NO: 12146 - protein, 19 aa, Homo sapiens
KKEGLISQDGSSLEALLRT

SEQ ID NO: 12147 - protein, 17 aa, Homo sapiens
RLSFPSIKPDTDQTLKK

SEQ ID NO: 12148 - protein, 17 aa, Homo sapiens
RLSFPSIKPDTDQTLKK

SEQ ID NO: 12149 - protein, 19 aa, Homo sapiens
KKEGLISQDGSSLEALLRT

SEQ ID NO: 12150 - protein, 19 aa, Homo sapiens
KKEGLISQDGSSLEALLRT

SEQ ID NO: 12151 - protein, 19 aa, Homo sapiens
KKEGLISQDGSSLEALLRT

SEQ ID NO: 12152 - protein, 17 aa, Homo sapiens
RLSFPSIKPDTDQTLKK

SEQ ID NO: 12153 - protein, 19 aa, Homo sapiens
KKEGLISQDGSSLEALLRT

SEQ ID NO: 12154 - protein, 19 aa, Homo sapiens
KKEGLISQDGSSLEALLRT

SEQ ID NO: 12155 - protein, 19 aa, Homo sapiens
KKEGLISQDGSSLEALLRT

SEQ ID NO: 12156 - protein, 19 aa, Homo sapiens
KKEGLISQDGSSLEALLRT

SEQ ID NO: 12157 - protein, 17 aa, Homo sapiens
RLSFPSIKPDTDQTLKK

SEQ ID NO: 12158 - protein, 19 aa, Homo sapiens
KKEGLISQDGSSLEALLRT

SEQ ID NO: 12159 - protein, 19 aa, Homo sapiens
KKEGLISQDGSSLEALLRT

SEQ ID NO: 12160 - protein, 19 aa, Homo sapiens
KKEGLISQDGSSLEALLRT

SEQ ID NO: 12161 - protein, 19 aa, Homo sapiens
KKEGLISQDGSSLEALLRT

SEQ ID NO: 12162 - protein, 19 aa, Homo sapiens
KKEGLISQDGSSLEALLRT

SEQ ID NO: 12163 - protein, 9 aa, Homo sapiens
RTDPLEKRG

SEQ ID NO: 12164 - protein, 9 aa, Homo sapiens
RTDPLEKRG

SEQ ID NO: 12165 - protein, 9 aa, Homo sapiens
RTDPLEKRG

SEQ ID NO: 12166 - protein, 9 aa, Homo sapiens
RTDPLEKRG

SEQ ID NO: 12167 - protein, 9 aa, Homo sapiens
RTDPLEKRG

SEQ ID NO: 12168 - protein, 9 aa, Homo sapiens
RTDPLEKRG

SEQ ID NO: 12169 - protein, 9 aa, Homo sapiens
RTDPLEKRG

SEQ ID NO: 12170 - protein, 9 aa, Homo sapiens
RTDPLEKRG

SEQ ID NO: 12171 - protein, 19 aa, Homo sapiens
KKEGLISQDGSSLEALLRT

SEQ ID NO: 12172 - protein, 9 aa, Homo sapiens
RTDPLEKRG

SEQ ID NO: 12173 - protein, 10 aa, Homo sapiens
RKLDQTIMRK

SEQ ID NO: 12174 - protein, 13 aa, Homo sapiens
RVEGKLLDDPSKQ

SEQ ID NO: 12175 - protein, 23 aa, Homo sapiens
RTPTTQETDGFQVKRPGDLSVRC

SEQ ID NO: 12176 - protein, 22 aa, Homo sapiens
RYLAFTEEKAMGMTNLPAVGRK

SEQ ID NO: 12177 - protein, 9 aa, Homo sapiens
RKPLDLYRL

SEQ ID NO: 12178 - protein, 13 aa, Homo sapiens
KKSSSSTTTNEKI

SEQ ID NO: 12179 - protein, 9 aa, Homo sapiens
RKPLDLYRL

SEQ ID NO: 12180 - protein, 9 aa, Homo sapiens
RKPLDLYRL

SEQ ID NO: 12181 - protein, 9 aa, Homo sapiens
RKPLDLYRL

SEQ ID NO: 12182 - protein, 9 aa, Homo sapiens
RKPLDLYRL

SEQ ID NO: 12183 - protein, 9 aa, Homo sapiens
RKPLDLYRL

SEQ ID NO: 12184 - protein, 9 aa, Homo sapiens
RKPLDLYRL

SEQ ID NO: 12185 - protein, 9 aa, Homo sapiens
RKPLDLYRL

SEQ ID NO: 12186 - protein, 9 aa, Homo sapiens
RKPLDLYRL

SEQ ID NO: 12187 - protein, 9 aa, Homo sapiens
RKPLDLYRL

SEQ ID NO: 12188 - protein, 9 aa, Homo sapiens
RKPLDLYRL

SEQ ID NO: 12189 - protein, 9 aa, Homo sapiens
RKPLDLYRL

SEQ ID NO: 12190 - protein, 9 aa, Homo sapiens
RKPLDLYRL

SEQ ID NO: 12191 - protein, 9 aa, Homo sapiens
RKPLDLYRL

SEQ ID NO: 12192 - protein, 9 aa, Homo sapiens
RKPLDLYRL

SEQ ID NO: 12193 - protein, 9 aa, Homo sapiens
RKPLDLYRL

SEQ ID NO: 12194 - protein, 9 aa, Homo sapiens
RKPLDLYRL

SEQ ID NO: 12195 - protein, 9 aa, Homo sapiens
RKPLDLYRL

SEQ ID NO: 12196 - protein, 8 aa, Homo sapiens
RKMWVDRY

SEQ ID NO: 12197 - protein, 8 aa, Homo sapiens
RKMWVDRY

SEQ ID NO: 12198 - protein, 15 aa, Homo sapiens
KITKLYELGGEPERK

SEQ ID NO: 12199 - protein, 8 aa, Homo sapiens
RKMWVDRY

SEQ ID NO: 12200 - protein, 12 aa, Homo sapiens
RLEKLYSTMVRF

SEQ ID NO: 12201 - protein, 12 aa, Homo sapiens
RLEKLYSTMVRF

SEQ ID NO: 12202 - protein, 31 aa, Homo sapiens; identical to SEQ ID NO: 424

SEQ ID NO: 12203 - protein, 13 aa, Homo sapiens
KLILLHHKHPERK

SEQ ID NO: 12204 - protein, 14 aa, Homo sapiens
KLILLHHKHPERKQ

SEQ ID NO: 12205 - protein, 13 aa, Homo sapiens
KLILLHHKHPERK

SEQ ID NO: 12206 - protein, 29 aa, Homo sapiens
RKHVTTAEGTPGTTDQEGPPPDGPPEKRI

SEQ ID NO: 12207 - protein, 13 aa, Homo sapiens
KLILLHHKHPERK

SEQ ID NO: 12208 - protein, 29 aa, Homo sapiens
RKHVTTAEGTPGTTDQEGPPPDGPPEKRI

SEQ ID NO: 12209 - protein, 29 aa, Homo sapiens
RKHVTTAEGTPGTTDQEGPPPDGPPEKRI

SEQ ID NO: 12210 - protein, 12 aa, Homo sapiens
KSSEAIKESSKF

SEQ ID NO: 12211 - protein, 12 aa, Homo sapiens
KSSEAIKESSKF

SEQ ID NO: 12212 - protein, 24 aa, Homo sapiens
KSSEAIKESSKFPFGISPAQSHRN

SEQ ID NO: 12213 - protein, 12 aa, Homo sapiens
KSSEAIKESSKF

SEQ ID NO: 12214 - protein, 12 aa, Homo sapiens
KSSEAIKESSKF

SEQ ID NO: 12215 - protein, 36 aa, Homo sapiens; identical to SEQ ID NO: 555

SEQ ID NO: 12216 - protein, 36 aa, Homo sapiens; identical to SEQ ID NO: 555

SEQ ID NO: 12217 - protein, 22 aa, Homo sapiens
RCLIEIFGILKEYEVGDPGQRT

SEQ ID NO: 12218 - protein, 22 aa, Homo sapiens
RCLIEIFGILKEYEVGDPGQRT

SEQ ID NO: 12219 - protein, 22 aa, Homo sapiens
RCLIEIFGILKEYEVGDPGQRT

SEQ ID NO: 12220 - protein, 12 aa, Homo sapiens
RLEKLYSTMVRF

SEQ ID NO: 12221 - protein, 31 aa, Homo sapiens; identical to SEQ ID NO: 424

SEQ ID NO: 12222 - protein, 12 aa, Homo sapiens
RLEKLYSTMVRF

SEQ ID NO: 12223 - protein, 12 aa, Homo sapiens
RLEKLYSTMVRF

SEQ ID NO: 12224 - protein, 31 aa, Homo sapiens; identical to SEQ ID NO: 424

SEQ ID NO: 12225 - protein, 12 aa, Homo sapiens
RLEKLYSTMVRF

SEQ ID NO: 12226 - protein, 12 aa, Homo sapiens
RLEKLYSTMVRF

SEQ ID NO: 12227 - protein, 31 aa, Homo sapiens; identical to SEQ ID NO: 424

SEQ ID NO: 12228 - protein, 31 aa, Homo sapiens; identical to SEQ ID NO: 424

SEQ ID NO: 12229 - protein, 12 aa, Homo sapiens
RLEKLYSTMVRF

SEQ ID NO: 12230 - protein, 12 aa, Homo sapiens
RLEKLYSTMVRF

SEQ ID NO: 12231 - protein, 12 aa, Homo sapiens
RLEKLYSTMVRF

SEQ ID NO: 12232 - protein, 12 aa, Homo sapiens
RLEKLYSTMVRF

SEQ ID NO: 12233 - protein, 12 aa, Homo sapiens
RLEKLYSTMVRF

SEQ ID NO: 12234 - protein, 31 aa, Homo sapiens; identical to SEQ ID NO: 424

SEQ ID NO: 12235 - protein, 12 aa, Homo sapiens
RLEKLYSTMVRF

SEQ ID NO: 12236 - protein, 12 aa, Homo sapiens
RLEKLYSTMVRF

SEQ ID NO: 12237 - protein, 31 aa, Homo sapiens; identical to SEQ ID NO: 424

SEQ ID NO: 12238 - protein, 12 aa, Homo sapiens
RLEKLYSTMVRF

SEQ ID NO: 12239 - protein, 12 aa, Homo sapiens
RLEKLYSTMVRF

SEQ ID NO: 12240 - protein, 12 aa, Homo sapiens
RLEKLYSTMVRF

SEQ ID NO: 12241 - protein, 12 aa, Homo sapiens
RLEKLYSTMVRF

SEQ ID NO: 12242 - protein, 14 aa, Homo sapiens
KLILLHHKHPERKQ

SEQ ID NO: 12243 - protein, 14 aa, Homo sapiens
KLILLHHKHPERKQ

SEQ ID NO: 12244 - protein, 13 aa, Homo sapiens
KLILLHHKHPERK

SEQ ID NO: 12245 - protein, 14 aa, Homo sapiens
RNIKILEDEPHSKD

SEQ ID NO: 12246 - protein, 14 aa, Homo sapiens
RNIKILEDEPHSKD

SEQ ID NO: 12247 - protein, 14 aa, Homo sapiens
RNIKILEDEPHSKD

SEQ ID NO: 12248 - protein, 14 aa, Homo sapiens
KLILLHHKHPERKQ

SEQ ID NO: 12249 - protein, 13 aa, Homo sapiens
KLILLHHKHPERK

SEQ ID NO: 12250 - protein, 14 aa, Homo sapiens
RNIKILEDEPHSKD

SEQ ID NO: 12251 - protein, 13 aa, Homo sapiens
KLILLHHKHPERK

SEQ ID NO: 12252 - protein, 14 aa, Homo sapiens
KLILLHHKHPERKQ

SEQ ID NO: 12253 - protein, 9 aa, Homo sapiens
KFDKLPVKI

SEQ ID NO: 12254 - protein, 9 aa, Homo sapiens
KFDKLPVKI

SEQ ID NO: 12255 - protein, 9 aa, Homo sapiens
KFDKLPVKI

SEQ ID NO: 12256 - protein, 9 aa, Homo sapiens
RKPLDLYRL

SEQ ID NO: 12257 - protein, 9 aa, Homo sapiens
RKPLDLYRL

SEQ ID NO: 12258 - protein, 9 aa, Homo sapiens
RKPLDLYRL

SEQ ID NO: 12259 - protein, 9 aa, Homo sapiens
RKPLDLYRL

SEQ ID NO: 12260 - protein, 9 aa, Homo sapiens
RKPLDLYRL

SEQ ID NO: 12261 - protein, 16 aa, Homo sapiens
RMSYEPNKDPYGSMRK

SEQ ID NO: 12262 - protein, 9 aa, Homo sapiens
RKPLDLYRL

SEQ ID NO: 12263 - protein, 9 aa, Homo sapiens
RKPLDLYRL

SEQ ID NO: 12264 - protein, 9 aa, Homo sapiens
RKPLDLYRL

SEQ ID NO: 12265 - protein, 9 aa, Homo sapiens
RKPLDLYRL

SEQ ID NO: 12266 - protein, 24 aa, Homo sapiens
KSSEAIKESSKFPFGISPAQSHRN

SEQ ID NO: 12267 - protein, 29 aa, Homo sapiens
RKHVTTAEGTPGTTDQEGPPPDGPPEKRI

SEQ ID NO: 12268 - protein, 29 aa, Homo sapiens
RKHVTTAEGTPGTTDQEGPPPDGPPEKRI

SEQ ID NO: 12269 - protein, 13 aa, Homo sapiens
KLILLHHKHPERK

SEQ ID NO: 12270 - protein, 29 aa, Homo sapiens
RKHVTTAEGTPGTTDQEGPPPDGPPEKRI

SEQ ID NO: 12271 - protein, 13 aa, Homo sapiens
KLILLHHKHPERK

SEQ ID NO: 12272 - protein, 29 aa, Homo sapiens
RKHVTTAEGTPGTTDQEGPPPDGPPEKRI

SEQ ID NO: 12273 - protein, 13 aa, Homo sapiens
KLILLHHKHPERK

SEQ ID NO: 12274 - protein, 29 aa, Homo sapiens
RKHVTTAEGTPGTTDQEGPPPDGPPEKRI

SEQ ID NO: 12275 - protein, 29 aa, Homo sapiens
RKHVTTAEGTPGTTDQEGPPPDGPPEKRI

SEQ ID NO: 12276 - protein, 29 aa, Homo sapiens
RKHVTTAEGTPGTTDQEGPPPDGPPEKRI

SEQ ID NO: 12277 - protein, 29 aa, Homo sapiens
RKHVTTAEGTPGTTDQEGPPPDGPPEKRI

SEQ ID NO: 12278 - protein, 29 aa, Homo sapiens
RKHVTTAEGTPGTTDQEGPPPDGPPEKRI

SEQ ID NO: 12279 - protein, 13 aa, Homo sapiens
KLILLHHKHPERK

SEQ ID NO: 12280 - protein, 31 aa, Homo sapiens; identical to SEQ ID NO: 424

SEQ ID NO: 12281 - protein, 31 aa, Homo sapiens; identical to SEQ ID NO: 424

SEQ ID NO: 12282 - protein, 31 aa, Homo sapiens; identical to SEQ ID NO: 424

SEQ ID NO: 12283 - protein, 29 aa, Homo sapiens
RKHVTTAEGTPGTTDQEGPPPDGPPEKRI

SEQ ID NO: 12284 - protein, 18 aa, Homo sapiens
RSSTLTEDGAKSSEAIKE

SEQ ID NO: 12285 - protein, 18 aa, Homo sapiens
RSSTLTEDGAKSSEAIKE

SEQ ID NO: 12286 - protein, 22 aa, Homo sapiens
RSSTLTEDGAKSSEAIKESSKF

SEQ ID NO: 12287 - protein, 29 aa, Homo sapiens
RKHVTTAEGTPGTTDQEGPPPDGPPEKRI

SEQ ID NO: 12288 - protein, 16 aa, Homo sapiens
RMSYEPNKDPYGSMRK

SEQ ID NO: 12289 - protein, 27 aa, Homo sapiens
RKAPGSDPFMSSGQGPNGGMGDPYSRA

SEQ ID NO: 12290 - protein, 27 aa, Homo sapiens
RKAPGSDPFMSSGQGPNGGMGDPYSRA

SEQ ID NO: 12291 - protein, 16 aa, Homo sapiens
RMSYEPNKDPYGSMRK

SEQ ID NO: 12292 - protein, 16 aa, Homo sapiens
RMSYEPNKDPYGSMRK

SEQ ID NO: 12293 - protein, 27 aa, Homo sapiens
RKAPGSDPFMSSGQGPNGGMGDPYSRA

SEQ ID NO: 12294 - protein, 27 aa, Homo sapiens
RKAPGSDPFMSSGQGPNGGMGDPYSRA

SEQ ID NO: 12295 - protein, 27 aa, Homo sapiens
RKAPGSDPFMSSGQGPNGGMGDPYSRA

SEQ ID NO: 12296 - protein, 27 aa, Homo sapiens
RKAPGSDPFMSSGQGPNGGMGDPYSRA

SEQ ID NO: 12297 - protein, 27 aa, Homo sapiens
RKAPGSDPFMSSGQGPNGGMGDPYSRA

SEQ ID NO: 12298 - protein, 27 aa, Homo sapiens
RKAPGSDPFMSSGQGPNGGMGDPYSRA

SEQ ID NO: 12299 - protein, 27 aa, Homo sapiens
RKAPGSDPFMSSGQGPNGGMGDPYSRA

SEQ ID NO: 12300 - protein, 27 aa, Homo sapiens
RKAPGSDPFMSSGQGPNGGMGDPYSRA

SEQ ID NO: 12301 - protein, 27 aa, Homo sapiens
RKAPGSDPFMSSGQGPNGGMGDPYSRA

SEQ ID NO: 12302 - protein, 27 aa, Homo sapiens
RKAPGSDPFMSSGQGPNGGMGDPYSRA

SEQ ID NO: 12303 - protein, 16 aa, Homo sapiens
RMSYEPNKDPYGSMRK

SEQ ID NO: 12304 - protein, 16 aa, Homo sapiens
RMSYEPNKDPYGSMRK

SEQ ID NO: 12305 - protein, 15 aa, Homo sapiens
RLTMKDIGTPEAWRV

SEQ ID NO: 12306 - protein, 15 aa, Homo sapiens
RLTMKDIGTPEAWRV

SEQ ID NO: 12307 - protein, 20 aa, Homo sapiens
KIVQKNDPFVVDCSDKLGRV

SEQ ID NO: 12308 - protein, 36 aa, Homo sapiens; identical to SEQ ID NO: 555

SEQ ID NO: 12309 - protein, 31 aa, Homo sapiens; identical to SEQ ID NO: 424

SEQ ID NO: 12310 - protein, 13 aa, Homo sapiens
KLILLHHKHPERK

SEQ ID NO: 12311 - protein, 31 aa, Homo sapiens; identical to SEQ ID NO: 424

SEQ ID NO: 12312 - protein, 12 aa, Homo sapiens
RLEKLYSTMVRF

SEQ ID NO: 12313 - protein, 12 aa, Homo sapiens
RLEKLYSTMVRF

SEQ ID NO: 12314 - protein, 31 aa, Homo sapiens; identical to SEQ ID NO: 424

SEQ ID NO: 12315 - protein, 11 aa, Homo sapiens
RKQAPLTYEKE

SEQ ID NO: 12316 - protein, 16 aa, Homo sapiens
RRLTMKDIGTPEAWRV

SEQ ID NO: 12317 - protein, 18 aa, Homo sapiens
RSSTLTEDGAKSSEAIKE

SEQ ID NO: 12318 - protein, 18 aa, Homo sapiens
RSSTLTEDGAKSSEAIKE

SEQ ID NO: 12319 - protein, 18 aa, Homo sapiens
KESSKFPFGISPAQSHRN

SEQ ID NO: 12320 - protein, 18 aa, Homo sapiens
KESSKFPFGISPAQSHRN

SEQ ID NO: 12321 - protein, 18 aa, Homo sapiens
RSSTLTEDGAKSSEAIKE

SEQ ID NO: 12322 - protein, 18 aa, Homo sapiens
KESSKFPFGISPAQSHRN

SEQ ID NO: 12323 - protein, 18 aa, Homo sapiens
KESSKFPFGISPAQSHRN

SEQ ID NO: 12324 - protein, 18 aa, Homo sapiens
RSSTLTEDGAKSSEAIKE

SEQ ID NO: 12325 - protein, 18 aa, Homo sapiens
KESSKFPFGISPAQSHRN

SEQ ID NO: 12326 - protein, 18 aa, Homo sapiens
RSSTLTEDGAKSSEAIKE

SEQ ID NO: 12327 - protein, 18 aa, Homo sapiens
RSSTLTEDGAKSSEAIKE

SEQ ID NO: 12328 - protein, 18 aa, Homo sapiens
RSSTLTEDGAKSSEAIKE

SEQ ID NO: 12329 - protein, 16 aa, Homo sapiens
RMSYEPNKDPYGSMRK

SEQ ID NO: 12330 - protein, 16 aa, Homo sapiens
RMSYEPNKDPYGSMRK

SEQ ID NO: 12331 - protein, 16 aa, Homo sapiens
RMSYEPNKDPYGSMRK

SEQ ID NO: 12332 - protein, 16 aa, Homo sapiens
RMSYEPNKDPYGSMRK

SEQ ID NO: 12333 - protein, 23 aa, Homo sapiens
RSNSVGIQDAFNDGSDSTFQKRN

SEQ ID NO: 12334 - protein, 16 aa, Homo sapiens
RMSYEPNKDPYGSMRK

SEQ ID NO: 12335 - protein, 16 aa, Homo sapiens
RMSYEPNKDPYGSMRK

SEQ ID NO: 12336 - protein, 23 aa, Homo sapiens
RSNSVGIQDAFNDGSDSTFQKRN

SEQ ID NO: 12337 - protein, 16 aa, Homo sapiens
RMSYEPNKDPYGSMRK

SEQ ID NO: 12338 - protein, 16 aa, Homo sapiens
RMSYEPNKDPYGSMRK

SEQ ID NO: 12339 - protein, 27 aa, Homo sapiens
RKAPGSDPFMSSGQGPNGGMGDPYSRA

SEQ ID NO: 12340 - protein, 23 aa, Homo sapiens
RSNSVGIQDAFNDGSDSTFQKRN

SEQ ID NO: 12341 - protein, 8 aa, Homo sapiens
RKMWVDRY

SEQ ID NO: 12342 - protein, 8 aa, Homo sapiens
RKMWVDRY

SEQ ID NO: 12343 - protein, 26 aa, Homo sapiens
RSLSFVPGNDFEMSKHPGLLLILGKL

SEQ ID NO: 12344 - protein, 26 aa, Homo sapiens
RSLSFVPGNDFEMSKHPGLLLILGKL

SEQ ID NO: 12345 - protein, 13 aa, Homo sapiens
KLILLHHKHPERK

SEQ ID NO: 12346 - protein, 14 aa, Homo sapiens
KLILLHHKHPERKQ

SEQ ID NO: 12347 - protein, 26 aa, Homo sapiens
RSLSFVPGNDFEMSKHPGLLLILGKL

SEQ ID NO: 12348 - protein, 13 aa, Homo sapiens
KLILLHHKHPERK

SEQ ID NO: 12349 - protein, 13 aa, Homo sapiens
KLILLHHKHPERK

SEQ ID NO: 12350 - protein, 13 aa, Homo sapiens
KLILLHHKHPERK

SEQ ID NO: 12351 - protein, 13 aa, Homo sapiens
KLILLHHKHPERK

SEQ ID NO: 12352 - protein, 13 aa, Homo sapiens
KLILLHHKHPERK

SEQ ID NO: 12353 - protein, 26 aa, Homo sapiens
RSLSFVPGNDFEMSKHPGLLLILGKL

SEQ ID NO: 12354 - protein, 13 aa, Homo sapiens
KLILLHHKHPERK

SEQ ID NO: 12355 - protein, 13 aa, Homo sapiens
KLILLHHKHPERK

SEQ ID NO: 12356 - protein, 13 aa, Homo sapiens
KLILLHHKHPERK

SEQ ID NO: 12357 - protein, 13 aa, Homo sapiens
KLILLHHKHPERK

SEQ ID NO: 12358 - protein, 13 aa, Homo sapiens
KLILLHHKHPERK

SEQ ID NO: 12359 - protein, 12 aa, Homo sapiens
KADGTPKTESKS

SEQ ID NO: 12360 - protein, 16 aa, Homo sapiens
KKSSSSTTTNEKITKL

SEQ ID NO: 12361 - protein, 8 aa, Homo sapiens
RKMWVDRY

SEQ ID NO: 12362 - protein, 8 aa, Homo sapiens
RKMWVDRY

SEQ ID NO: 12363 - protein, 12 aa, Homo sapiens
RLEKLYSTMVRF

SEQ ID NO: 12364 - protein, 18 aa, Homo sapiens
KESSKFPFGISPAQSHRN

SEQ ID NO: 12365 - protein, 14 aa, Homo sapiens
KLILLHHKHPERKQ

SEQ ID NO: 12366 - protein, 13 aa, Homo sapiens
KLILLHHKHPERK

SEQ ID NO: 12367 - protein, 13 aa, Homo sapiens
KLILLHHKHPERK

SEQ ID NO: 12368 - protein, 13 aa, Homo sapiens
KLILLHHKHPERK

SEQ ID NO: 12369 - protein, 13 aa, Homo sapiens
KLILLHHKHPERK

SEQ ID NO: 12370 - protein, 13 aa, Homo sapiens
KLILLHHKHPERK

SEQ ID NO: 12371 - protein, 36 aa, Homo sapiens; identical to SEQ ID NO: 555

SEQ ID NO: 12372 - protein, 29 aa, Homo sapiens
RKHVTTAEGTPGTTDQEGPPPDGPPEKRI

SEQ ID NO: 12373 - protein, 29 aa, Homo sapiens
RKHVTTAEGTPGTTDQEGPPPDGPPEKRI

SEQ ID NO: 12374 - protein, 9 aa, Homo sapiens
KKAEQQQRE

SEQ ID NO: 12375 - protein, 24 aa, Homo sapiens
KKAEQQQREEAGGEAAAAAAAERG

SEQ ID NO: 12376 - protein, 26 aa, Homo sapiens
RGEMKAAAGQESEGPAVGPPQPLGKE

SEQ ID NO: 12377 - protein, 24 aa, Homo sapiens
KKAEQQQREEAGGEAAAAAAAERG

SEQ ID NO: 12378 - protein, 9 aa, Homo sapiens
KKAEQQQRE

SEQ ID NO: 12379 - protein, 26 aa, Homo sapiens
RGEMKAAAGQESEGPAVGPPQPLGKE

SEQ ID NO: 12380 - protein, 9 aa, Homo sapiens
KKAEQQQRE

SEQ ID NO: 12381 - protein, 9 aa, Homo sapiens
KKAEQQQRE

SEQ ID NO: 12382 - protein, 23 aa, Homo sapiens
RVAPEEHPVLLTEAPLNPKANRE

SEQ ID NO: 12383 - protein, 23 aa, Homo sapiens
RVAPEEHPVLLTEAPLNPKANRE

SEQ ID NO: 12384 - protein, 23 aa, Homo sapiens
RVAPEEHPVLLTEAPLNPKANRE

SEQ ID NO: 12385 - protein, 23 aa, Homo sapiens
RVAPEEHPVLLTEAPLNPKANRE

SEQ ID NO: 12386 - protein, 23 aa, Homo sapiens
RVAPEEHPVLLTEAPLNPKANRE

SEQ ID NO: 12387 - protein, 23 aa, Homo sapiens
RVAPEEHPVLLTEAPLNPKANRE

SEQ ID NO: 12388 - protein, 11 aa, Homo sapiens
REIVRDIKEKL

SEQ ID NO: 12389 - protein, 11 aa, Homo sapiens
REIVRDIKEKL

SEQ ID NO: 12390 - protein, 23 aa, Homo sapiens
RVAPEEHPVLLTEAPLNPKANRE

SEQ ID NO: 12391 - protein, 24 aa, Homo sapiens
RKDLYANTVLSGGTTMYPGIADRM

SEQ ID NO: 12392 - protein, 24 aa, Homo sapiens
RKDLYANTVLSGGTTMYPGIADRM

SEQ ID NO: 12393 - protein, 24 aa, Homo sapiens
RKDLYANTVLSGGTTMYPGIADRM

SEQ ID NO: 12394 - protein, 24 aa, Homo sapiens
RKDLYANTVLSGGTTMYPGIADRM

SEQ ID NO: 12395 - protein, 24 aa, Homo sapiens
RKDLYANTVLSGGTTMYPGIADRM

SEQ ID NO: 12396 - protein, 24 aa, Homo sapiens
RKDLYANTVLSGGTTMYPGIADRM

SEQ ID NO: 12397 - protein, 24 aa, Homo sapiens
RKDLYANTVLSGGTTMYPGIADRM

SEQ ID NO: 12398 - protein, 24 aa, Homo sapiens
RKDLYANTVLSGGTTMYPGIADRM

SEQ ID NO: 12399 - protein, 24 aa, Homo sapiens
RKDLYANTVLSGGTTMYPGIADRM

SEQ ID NO: 12400 - protein, 24 aa, Homo sapiens
RKDLYANTVLSGGTTMYPGIADRM

SEQ ID NO: 12401 - protein, 24 aa, Homo sapiens
RKDLYANTVLSGGTTMYPGIADRM

SEQ ID NO: 12402 - protein, 24 aa, Homo sapiens
RKDLYANTVLSGGTTMYPGIADRM

SEQ ID NO: 12403 - protein, 24 aa, Homo sapiens
RKDLYANTVLSGGTTMYPGIADRM

SEQ ID NO: 12404 - protein, 24 aa, Homo sapiens
RKDLYANTVLSGGTTMYPGIADRM

SEQ ID NO: 12405 - protein, 24 aa, Homo sapiens
RKDLYANTVLSGGTTMYPGIADRM

SEQ ID NO: 12406 - protein, 24 aa, Homo sapiens
RKDLYANTVLSGGTTMYPGIADRM

SEQ ID NO: 12407 - protein, 24 aa, Homo sapiens
RKDLYANTVLSGGTTMYPGIADRM

SEQ ID NO: 12408 - protein, 24 aa, Homo sapiens
RKDLYANTVLSGGTTMYPGIADRM

SEQ ID NO: 12409 - protein, 24 aa, Homo sapiens
RKDLYANTVLSGGTTMYPGIADRM

SEQ ID NO: 12410 - protein, 24 aa, Homo sapiens
RKDLYANTVLSGGTTMYPGIADRM

SEQ ID NO: 12411 - protein, 24 aa, Homo sapiens
RKDLYANTVLSGGTTMYPGIADRM

SEQ ID NO: 12412 - protein, 24 aa, Homo sapiens
RKDLYANTVLSGGTTMYPGIADRM

SEQ ID NO: 12413 - protein, 24 aa, Homo sapiens
RKDLYANTVLSGGTTMYPGIADRM

SEQ ID NO: 12414 - protein, 24 aa, Homo sapiens
RKDLYANTVLSGGTTMYPGIADRM

SEQ ID NO: 12415 - protein, 24 aa, Homo sapiens
RKDLYANTVLSGGTTMYPGIADRM

SEQ ID NO: 12416 - protein, 24 aa, Homo sapiens
RKDLYANTVLSGGTTMYPGIADRM

SEQ ID NO: 12417 - protein, 24 aa, Homo sapiens
RKDLYANTVLSGGTTMYPGIADRM

SEQ ID NO: 12418 - protein, 24 aa, Homo sapiens
RKDLYANTVLSGGTTMYPGIADRM

SEQ ID NO: 12419 - protein, 24 aa, Homo sapiens
RKDLYANTVLSGGTTMYPGIADRM

SEQ ID NO: 12420 - protein, 24 aa, Homo sapiens
RKDLYANTVLSGGTTMYPGIADRM

SEQ ID NO: 12421 - protein, 24 aa, Homo sapiens
RKDLYANTVLSGGTTMYPGIADRM

SEQ ID NO: 12422 - protein, 24 aa, Homo sapiens
RKDLYANTVLSGGTTMYPGIADRM

SEQ ID NO: 12423 - protein, 24 aa, Homo sapiens
RKDLYANTVLSGGTTMYPGIADRM

SEQ ID NO: 12424 - protein, 24 aa, Homo sapiens
RKDLYANTVLSGGTTMYPGIADRM

SEQ ID NO: 12425 - protein, 24 aa, Homo sapiens
RKDLYANTVLSGGTTMYPGIADRM

SEQ ID NO: 12426 - protein, 24 aa, Homo sapiens
RKDLYANTVLSGGTTMYPGIADRM

SEQ ID NO: 12427 - protein, 24 aa, Homo sapiens
RKDLYANTVLSGGTTMYPGIADRM

SEQ ID NO: 12428 - protein, 24 aa, Homo sapiens
RKDLYANTVLSGGTTMYPGIADRM

SEQ ID NO: 12429 - protein, 24 aa, Homo sapiens
RKDLYANTVLSGGTTMYPGIADRM

SEQ ID NO: 12430 - protein, 24 aa, Homo sapiens
RKDLYANTVLSGGTTMYPGIADRM

SEQ ID NO: 12431 - protein, 15 aa, Homo sapiens
KEITALAPSTMKIKI

SEQ ID NO: 12432 - protein, 24 aa, Homo sapiens
RKDLYANTVLSGGTTMYPGIADRM

SEQ ID NO: 12433 - protein, 24 aa, Homo sapiens
RKDLYANTVLSGGTTMYPGIADRM

SEQ ID NO: 12434 - protein, 24 aa, Homo sapiens
RKDLYANTVLSGGTTMYPGIADRM

SEQ ID NO: 12435 - protein, 24 aa, Homo sapiens
RKDLYANTVLSGGTTMYPGIADRM

SEQ ID NO: 12436 - protein, 24 aa, Homo sapiens
RKDLYANTVLSGGTTMYPGIADRM

SEQ ID NO: 12437 - protein, 24 aa, Homo sapiens
RKDLYANTVLSGGTTMYPGIADRM

SEQ ID NO: 12438 - protein, 24 aa, Homo sapiens
RKDLYANTVLSGGTTMYPGIADRM

SEQ ID NO: 12439 - protein, 24 aa, Homo sapiens
RKDLYANTVLSGGTTMYPGIADRM

SEQ ID NO: 12440 - protein, 15 aa, Homo sapiens
KEITALAPSTMKIKI

SEQ ID NO: 12441 - protein, 24 aa, Homo sapiens
RKDLYANTVLSGGTTMYPGIADRM

SEQ ID NO: 12442 - protein, 24 aa, Homo sapiens
RKDLYANTVLSGGTTMYPGIADRM

SEQ ID NO: 12443 - protein, 15 aa, Homo sapiens
KEITALAPSTMKIKI

SEQ ID NO: 12444 - protein, 24 aa, Homo sapiens
RKDLYANTVLSGGTTMYPGIADRM

SEQ ID NO: 12445 - protein, 15 aa, Homo sapiens
KEITALAPSTMKIKI

SEQ ID NO: 12446 - protein, 15 aa, Homo sapiens
KEITALAPSTMKIKI

SEQ ID NO: 12447 - protein, 24 aa, Homo sapiens
RKDLYANTVLSGGTTMYPGIADRM

SEQ ID NO: 12448 - protein, 24 aa, Homo sapiens
RKDLYANTVLSGGTTMYPGIADRM

SEQ ID NO: 12449 - protein, 24 aa, Homo sapiens
RKDLYANTVLSGGTTMYPGIADRM

SEQ ID NO: 12450 - protein, 24 aa, Homo sapiens
RKDLYANTVLSGGTTMYPGIADRM

SEQ ID NO: 12451 - protein, 24 aa, Homo sapiens
RKDLYANTVLSGGTTMYPGIADRM

SEQ ID NO: 12452 - protein, 15 aa, Homo sapiens
KEITALAPSTMKIKI

SEQ ID NO: 12453 - protein, 24 aa, Homo sapiens
RKDLYANTVLSGGTTMYPGIADRM

SEQ ID NO: 12454 - protein, 24 aa, Homo sapiens
RKDLYANTVLSGGTTMYPGIADRM

SEQ ID NO: 12455 - protein, 15 aa, Homo sapiens
KEITALAPSTMKIKI

SEQ ID NO: 12456 - protein, 15 aa, Homo sapiens
KEITALAPSTMKIKI

SEQ ID NO: 12457 - protein, 24 aa, Homo sapiens
RKDLYANTVLSGGTTMYPGIADRM

SEQ ID NO: 12458 - protein, 24 aa, Homo sapiens
RKDLYANTVLSGGTTMYPGIADRM

SEQ ID NO: 12459 - protein, 24 aa, Homo sapiens
RKDLYANTVLSGGTTMYPGIADRM

SEQ ID NO: 12460 - protein, 22 aa, Homo sapiens
KEITALAPSTMKIKIIAPPERK

SEQ ID NO: 12461 - protein, 24 aa, Homo sapiens
RKDLYANTVLSGGTTMYPGIADRM

SEQ ID NO: 12462 - protein, 24 aa, Homo sapiens
RKDLYANTVLSGGTTMYPGIADRM

SEQ ID NO: 12463 - protein, 24 aa, Homo sapiens
RKDLYANTVLSGGTTMYPGIADRM

SEQ ID NO: 12464 - protein, 24 aa, Homo sapiens
RKDLYANTVLSGGTTMYPGIADRM

SEQ ID NO: 12465 - protein, 24 aa, Homo sapiens
RKDLYANTVLSGGTTMYPGIADRM

SEQ ID NO: 12466 - protein, 24 aa, Homo sapiens
RKDLYANTVLSGGTTMYPGIADRM

SEQ ID NO: 12467 - protein, 24 aa, Homo sapiens
RKDLYANTVLSGGTTMYPGIADRM

SEQ ID NO: 12468 - protein, 22 aa, Homo sapiens
KEITALAPSTMKIKIIAPPERK

SEQ ID NO: 12469 - protein, 15 aa, Homo sapiens
KEITALAPSTMKIKI

SEQ ID NO: 12470 - protein, 24 aa, Homo sapiens
RKDLYANTVLSGGTTMYPGIADRM

SEQ ID NO: 12471 - protein, 24 aa, Homo sapiens
RKDLYANTVLSGGTTMYPGIADRM

SEQ ID NO: 12472 - protein, 24 aa, Homo sapiens
RKDLYANTVLSGGTTMYPGIADRM

SEQ ID NO: 12473 - protein, 24 aa, Homo sapiens
RKDLYANTVLSGGTTMYPGIADRM

SEQ ID NO: 12474 - protein, 24 aa, Homo sapiens
RKDLYANTVLSGGTTMYPGIADRM

SEQ ID NO: 12475 - protein, 24 aa, Homo sapiens
RKDLYANTVLSGGTTMYPGIADRM

SEQ ID NO: 12476 - protein, 24 aa, Homo sapiens
RKDLYANTVLSGGTTMYPGIADRM

SEQ ID NO: 12477 - protein, 24 aa, Homo sapiens
RKDLYANTVLSGGTTMYPGIADRM

SEQ ID NO: 12478 - protein, 24 aa, Homo sapiens
RGILTLKYPIEHGIVTNWDDMEKI

SEQ ID NO: 12479 - protein, 25 aa, Homo sapiens
RHQGVMVGMGQKDSYVGDEAQSKRG

SEQ ID NO: 12480 - protein, 25 aa, Homo sapiens
RHQGVMVGMGQKDSYVGDEAQSKRG

SEQ ID NO: 12481 - protein, 25 aa, Homo sapiens
RHQGVMVGMGQKDSYVGDEAQSKRG

SEQ ID NO: 12482 - protein, 35 aa, Homo sapiens; identical to SEQ ID NO: 728

SEQ ID NO: 12483 - protein, 35 aa, Homo sapiens; identical to SEQ ID NO: 728

SEQ ID NO: 12484 - protein, 35 aa, Homo sapiens; identical to SEQ ID NO: 728

SEQ ID NO: 12485 - protein, 35 aa, Homo sapiens; identical to SEQ ID NO: 728

SEQ ID NO: 12486 - protein, 35 aa, Homo sapiens; identical to SEQ ID NO: 728

SEQ ID NO: 12487 - protein, 35 aa, Homo sapiens; identical to SEQ ID NO: 728

SEQ ID NO: 12488 - protein, 35 aa, Homo sapiens; identical to SEQ ID NO: 728

SEQ ID NO: 12489 - protein, 35 aa, Homo sapiens; identical to SEQ ID NO: 728

SEQ ID NO: 12490 - protein, 35 aa, Homo sapiens; identical to SEQ ID NO: 728

SEQ ID NO: 12491 - protein, 25 aa, Homo sapiens
RHQGVMVGMGQKDSYVGDEAQSKRG

SEQ ID NO: 12492 - protein, 35 aa, Homo sapiens; identical to SEQ ID NO: 728

SEQ ID NO: 12493 - protein, 35 aa, Homo sapiens; identical to SEQ ID NO: 728

SEQ ID NO: 12494 - protein, 25 aa, Homo sapiens
RHQGVMVGMGQKDSYVGDEAQSKRG

SEQ ID NO: 12495 - protein, 35 aa, Homo sapiens; identical to SEQ ID NO: 728

SEQ ID NO: 12496 - protein, 35 aa, Homo sapiens; identical to SEQ ID NO: 728

SEQ ID NO: 12497 - protein, 35 aa, Homo sapiens; identical to SEQ ID NO: 728

SEQ ID NO: 12498 - protein, 35 aa, Homo sapiens; identical to SEQ ID NO: 728

SEQ ID NO: 12499 - protein, 35 aa, Homo sapiens; identical to SEQ ID NO: 728

SEQ ID NO: 12500 - protein, 25 aa, Homo sapiens
RHQGVMVGMGQKDSYVGDEAQSKRG

SEQ ID NO: 12501 - protein, 35 aa, Homo sapiens; identical to SEQ ID NO: 728

SEQ ID NO: 12502 - protein, 25 aa, Homo sapiens
RHQGVMVGMGQKDSYVGDEAQSKRG

SEQ ID NO: 12503 - protein, 25 aa, Homo sapiens
RHQGVMVGMGQKDSYVGDEAQSKRG

SEQ ID NO: 12504 - protein, 24 aa, Homo sapiens
RGILTLKYPIEHGIVTNWDDMEKI

SEQ ID NO: 12505 - protein, 24 aa, Homo sapiens
RGILTLKYPIEHGIVTNWDDMEKI

SEQ ID NO: 12506 - protein, 25 aa, Homo sapiens
RHQGVMVGMGQKDSYVGDEAQSKRG

SEQ ID NO: 12507 - protein, 25 aa, Homo sapiens
RHQGVMVGMGQKDSYVGDEAQSKRG

SEQ ID NO: 12508 - protein, 35 aa, Homo sapiens; identical to SEQ ID NO: 728

SEQ ID NO: 12509 - protein, 35 aa, Homo sapiens; identical to SEQ ID NO: 728

SEQ ID NO: 12510 - protein, 25 aa, Homo sapiens
RHQGVMVGMGQKDSYVGDEAQSKRG

SEQ ID NO: 12511 - protein, 35 aa, Homo sapiens; identical to SEQ ID NO: 728

SEQ ID NO: 12512 - protein, 24 aa, Homo sapiens
RGILTLKYPIEHGIVTNWDDMEKI

SEQ ID NO: 12513 - protein, 25 aa, Homo sapiens
RHQGVMVGMGQKDSYVGDEAQSKRG

SEQ ID NO: 12514 - protein, 35 aa, Homo sapiens; identical to SEQ ID NO: 728

SEQ ID NO: 12515 - protein, 35 aa, Homo sapiens; identical to SEQ ID NO: 728

SEQ ID NO: 12516 - protein, 25 aa, Homo sapiens
RHQGVMVGMGQKDSYVGDEAQSKRG

SEQ ID NO: 12517 - protein, 35 aa, Homo sapiens; identical to SEQ ID NO: 728

SEQ ID NO: 12518 - protein, 25 aa, Homo sapiens
RHQGVMVGMGQKDSYVGDEAQSKRG

SEQ ID NO: 12519 - protein, 25 aa, Homo sapiens
RHQGVMVGMGQKDSYVGDEAQSKRG

SEQ ID NO: 12520 - protein, 25 aa, Homo sapiens
RHQGVMVGMGQKDSYVGDEAQSKRG

SEQ ID NO: 12521 - protein, 24 aa, Homo sapiens
RGILTLKYPIEHGIVTNWDDMEKI

SEQ ID NO: 12522 - protein, 35 aa, Homo sapiens; identical to SEQ ID NO: 728

SEQ ID NO: 12523 - protein, 25 aa, Homo sapiens
RHQGVMVGMGQKDSYVGDEAQSKRG

SEQ ID NO: 12524 - protein, 25 aa, Homo sapiens
RHQGVMVGMGQKDSYVGDEAQSKRG

SEQ ID NO: 12525 - protein, 35 aa, Homo sapiens; identical to SEQ ID NO: 728

SEQ ID NO: 12526 - protein, 25 aa, Homo sapiens
RHQGVMVGMGQKDSYVGDEAQSKRG

SEQ ID NO: 12527 - protein, 25 aa, Homo sapiens
RHQGVMVGMGQKDSYVGDEAQSKRG

SEQ ID NO: 12528 - protein, 25 aa, Homo sapiens
RHQGVMVGMGQKDSYVGDEAQSKRG

SEQ ID NO: 12529 - protein, 25 aa, Homo sapiens
RHQGVMVGMGQKDSYVGDEAQSKRG

SEQ ID NO: 12530 - protein, 35 aa, Homo sapiens; identical to SEQ ID NO: 728

SEQ ID NO: 12531 - protein, 24 aa, Homo sapiens
RGILTLKYPIEHGIVTNWDDMEKI

SEQ ID NO: 12532 - protein, 25 aa, Homo sapiens
RHQGVMVGMGQKDSYVGDEAQSKRG

SEQ ID NO: 12533 - protein, 25 aa, Homo sapiens
RHQGVMVGMGQKDSYVGDEAQSKRG

SEQ ID NO: 12534 - protein, 25 aa, Homo sapiens
RHQGVMVGMGQKDSYVGDEAQSKRG

SEQ ID NO: 12535 - protein, 25 aa, Homo sapiens
RHQGVMVGMGQKDSYVGDEAQSKRG

SEQ ID NO: 12536 - protein, 25 aa, Homo sapiens
RHQGVMVGMGQKDSYVGDEAQSKRG

SEQ ID NO: 12537 - protein, 25 aa, Homo sapiens
RHQGVMVGMGQKDSYVGDEAQSKRG

SEQ ID NO: 12538 - protein, 24 aa, Homo sapiens
RGILTLKYPIEHGIVTNWDDMEKI

SEQ ID NO: 12539 - protein, 25 aa, Homo sapiens
RHQGVMVGMGQKDSYVGDEAQSKRG

SEQ ID NO: 12540 - protein, 25 aa, Homo sapiens
RHQGVMVGMGQKDSYVGDEAQSKRG

SEQ ID NO: 12541 - protein, 25 aa, Homo sapiens
RHQGVMVGMGQKDSYVGDEAQSKRG

SEQ ID NO: 12542 - protein, 25 aa, Homo sapiens
RHQGVMVGMGQKDSYVGDEAQSKRG

SEQ ID NO: 12543 - protein, 25 aa, Homo sapiens
RHQGVMVGMGQKDSYVGDEAQSKRG

SEQ ID NO: 12544 - protein, 24 aa, Homo sapiens
RGILTLKYPIEHGIVTNWDDMEKI

SEQ ID NO: 12545 - protein, 25 aa, Homo sapiens
RHQGVMVGMGQKDSYVGDEAQSKRG

SEQ ID NO: 12546 - protein, 25 aa, Homo sapiens
RHQGVMVGMGQKDSYVGDEAQSKRG

SEQ ID NO: 12547 - protein, 13 aa, Homo sapiens
KPPDKPLMPYMRY

SEQ ID NO: 12548 - protein, 13 aa, Homo sapiens
KPPDKPLMPYMRY

SEQ ID NO: 12549 - protein, 13 aa, Homo sapiens
KPPDKPLMPYMRY

SEQ ID NO: 12550 - protein, 13 aa, Homo sapiens
KPPDKPLMPYMRY

SEQ ID NO: 12551 - protein, 16 aa, Homo sapiens
RVTASSGITIPKPPKP

SEQ ID NO: 12552 - protein, 13 aa, Homo sapiens
KPPDKPLMPYMRY

SEQ ID NO: 12553 - protein, 16 aa, Homo sapiens
RVTASSGITIPKPPKP

SEQ ID NO: 12554 - protein, 8 aa, Homo sapiens
RHQEKKRK

SEQ ID NO: 12555 - protein, 14 aa, Homo sapiens
RKLEAELLQIEERH

SEQ ID NO: 12556 - protein, 7 aa, Homo sapiens
RHQEKKR

SEQ ID NO: 12557 - protein, 8 aa, Homo sapiens
RHQEKKRK

SEQ ID NO: 12558 - protein, 17 aa, Homo sapiens
RKFLESTDSFNNELKRL

SEQ ID NO: 12559 - protein, 8 aa, Homo sapiens
RMQVLKRQ

SEQ ID NO: 12560 - protein, 8 aa, Homo sapiens
RMQVLKRQ

SEQ ID NO: 12561 - protein, 8 aa, Homo sapiens
RHQEKKRK

SEQ ID NO: 12562 - protein, 14 aa, Homo sapiens
RLCGLKVEVDMEKI

SEQ ID NO: 12563 - protein, 8 aa, Homo sapiens
RKRQEERE

SEQ ID NO: 12564 - protein, 8 aa, Homo sapiens
RMQVLKRQ

SEQ ID NO: 12565 - protein, 8 aa, Homo sapiens
RMQVLKRQ

SEQ ID NO: 12566 - protein, 8 aa, Homo sapiens
RMQVLKRQ

SEQ ID NO: 12567 - protein, 8 aa, Homo sapiens
RMQVLKRQ

SEQ ID NO: 12568 - protein, 14 aa, Homo sapiens
RKLEAELLQIEERH

SEQ ID NO: 12569 - protein, 8 aa, Homo sapiens
RHQEKKRK

SEQ ID NO: 12570 - protein, 13 aa, Homo sapiens
KPPDKPLMPYMRY

SEQ ID NO: 12571 - protein, 34 aa, Homo sapiens
RMEKGEPYMSIQPAEDPDDYDDGFSMKHTATARF

SEQ ID NO: 12572 - protein, 8 aa, Homo sapiens
RKRQEERE

SEQ ID NO: 12573 - protein, 8 aa, Homo sapiens
RMQVLKRQ

SEQ ID NO: 12574 - protein, 8 aa, Homo sapiens
RMQVLKRQ

SEQ ID NO: 12575 - protein, 20 aa, Homo sapiens
RDLTDEEKQEYLNEYEAEKI

SEQ ID NO: 12576 - protein, 20 aa, Homo sapiens
RDLTDEEKQEYLNEYEAEKI

SEQ ID NO: 12577 - protein, 17 aa, Homo sapiens
RKFLESTDSFNNELKRL

SEQ ID NO: 12578 - protein, 14 aa, Homo sapiens
RLCGLKVEVDMEKI

SEQ ID NO: 12579 - protein, 16 aa, Homo sapiens
KFLESTDSFNNELKRL

SEQ ID NO: 12580 - protein, 16 aa, Homo sapiens
KFLESTDSFNNELKRL

SEQ ID NO: 12581 - protein, 17 aa, Homo sapiens
RKFLESTDSFNNELKRL

SEQ ID NO: 12582 - protein, 16 aa, Homo sapiens
KFLESTDSFNNELKRL

SEQ ID NO: 12583 - protein, 16 aa, Homo sapiens
KFLESTDSFNNELKRL

SEQ ID NO: 12584 - protein, 14 aa, Homo sapiens
RLCGLKVEVDMEKI

SEQ ID NO: 12585 - protein, 16 aa, Homo sapiens
KFLESTDSFNNELKRL

SEQ ID NO: 12586 - protein, 16 aa, Homo sapiens
KFLESTDSFNNELKRL

SEQ ID NO: 12587 - protein, 16 aa, Homo sapiens
KFLESTDSFNNELKRL

SEQ ID NO: 12588 - protein, 16 aa, Homo sapiens
KFLESTDSFNNELKRL

SEQ ID NO: 12589 - protein, 17 aa, Homo sapiens
RKFLESTDSFNNELKRL

SEQ ID NO: 12590 - protein, 17 aa, Homo sapiens
RKFLESTDSFNNELKRL

SEQ ID NO: 12591 - protein, 14 aa, Homo sapiens
RLCGLKVEVDMEKI

SEQ ID NO: 12592 - protein, 14 aa, Homo sapiens
RLCGLKVEVDMEKI

SEQ ID NO: 12593 - protein, 16 aa, Homo sapiens
KFLESTDSFNNELKRL

SEQ ID NO: 12594 - protein, 17 aa, Homo sapiens
RKFLESTDSFNNELKRL

SEQ ID NO: 12595 - protein, 16 aa, Homo sapiens
KFLESTDSFNNELKRL

SEQ ID NO: 12596 - protein, 27 aa, Homo sapiens
RLCGLKVEVDMEKIAAEIAQAEEQARK

SEQ ID NO: 12597 - protein, 14 aa, Homo sapiens
RLCGLKVEVDMEKI

SEQ ID NO: 12598 - protein, 14 aa, Homo sapiens
RLCGLKVEVDMEKI

SEQ ID NO: 12599 - protein, 14 aa, Homo sapiens
RLCGLKVEVDMEKI

SEQ ID NO: 12600 - protein, 17 aa, Homo sapiens
RKFLESTDSFNNELKRL

SEQ ID NO: 12601 - protein, 16 aa, Homo sapiens
KFLESTDSFNNELKRL

SEQ ID NO: 12602 - protein, 14 aa, Homo sapiens
RLCGLKVEVDMEKI

SEQ ID NO: 12603 - protein, 27 aa, Homo sapiens
RLCGLKVEVDMEKIAAEIAQAEEQARK

SEQ ID NO: 12604 - protein, 17 aa, Homo sapiens
RKFLESTDSFNNELKRL

SEQ ID NO: 12605 - protein, 16 aa, Homo sapiens
KFLESTDSFNNELKRL

SEQ ID NO: 12606 - protein, 17 aa, Homo sapiens
RKFLESTDSFNNELKRL

SEQ ID NO: 12607 - protein, 14 aa, Homo sapiens
RLCGLKVEVDMEKI

SEQ ID NO: 12608 - protein, 17 aa, Homo sapiens
RKFLESTDSFNNELKRL

SEQ ID NO: 12609 - protein, 16 aa, Homo sapiens
KFLESTDSFNNELKRL

SEQ ID NO: 12610 - protein, 17 aa, Homo sapiens
RKFLESTDSFNNELKRL

SEQ ID NO: 12611 - protein, 14 aa, Homo sapiens
RLCGLKVEVDMEKI

SEQ ID NO: 12612 - protein, 14 aa, Homo sapiens
RLCGLKVEVDMEKI

SEQ ID NO: 12613 - protein, 17 aa, Homo sapiens
RKFLESTDSFNNELKRL

SEQ ID NO: 12614 - protein, 17 aa, Homo sapiens
RKFLESTDSFNNELKRL

SEQ ID NO: 12615 - protein, 17 aa, Homo sapiens
RKFLESTDSFNNELKRL

SEQ ID NO: 12616 - protein, 14 aa, Homo sapiens
RLCGLKVEVDMEKI

SEQ ID NO: 12617 - protein, 14 aa, Homo sapiens
RLCGLKVEVDMEKI

SEQ ID NO: 12618 - protein, 16 aa, Homo sapiens
KFLESTDSFNNELKRL

SEQ ID NO: 12619 - protein, 17 aa, Homo sapiens
RKFLESTDSFNNELKRL

SEQ ID NO: 12620 - protein, 16 aa, Homo sapiens
KFLESTDSFNNELKRL

SEQ ID NO: 12621 - protein, 17 aa, Homo sapiens
RKFLESTDSFNNELKRL

SEQ ID NO: 12622 - protein, 17 aa, Homo sapiens
RKFLESTDSFNNELKRL

SEQ ID NO: 12623 - protein, 14 aa, Homo sapiens
RLCGLKVEVDMEKI

SEQ ID NO: 12624 - protein, 17 aa, Homo sapiens
RKFLESTDSFNNELKRL

SEQ ID NO: 12625 - protein, 14 aa, Homo sapiens
RLCGLKVEVDMEKI

SEQ ID NO: 12626 - protein, 17 aa, Homo sapiens
RKFLESTDSFNNELKRL

SEQ ID NO: 12627 - protein, 17 aa, Homo sapiens
RKFLESTDSFNNELKRL

SEQ ID NO: 12628 - protein, 16 aa, Homo sapiens
KFLESTDSFNNELKRL

SEQ ID NO: 12629 - protein, 16 aa, Homo sapiens
KFLESTDSFNNELKRL

SEQ ID NO: 12630 - protein, 16 aa, Homo sapiens
KFLESTDSFNNELKRL

SEQ ID NO: 12631 - protein, 16 aa, Homo sapiens
KFLESTDSFNNELKRL

SEQ ID NO: 12632 - protein, 16 aa, Homo sapiens
KFLESTDSFNNELKRL

SEQ ID NO: 12633 - protein, 14 aa, Homo sapiens
RLCGLKVEVDMEKI

SEQ ID NO: 12634 - protein, 8 aa, Homo sapiens
RKRQEERE

SEQ ID NO: 12635 - protein, 21 aa, Homo sapiens
KFLESTDSFNNELKRLCGLKV

SEQ ID NO: 12636 - protein, 21 aa, Homo sapiens
KFLESTDSFNNELKRLCGLKV

SEQ ID NO: 12637 - protein, 21 aa, Homo sapiens
KFLESTDSFNNELKRLCGLKV

SEQ ID NO: 12638 - protein, 27 aa, Homo sapiens
RLCGLKVEVDMEKIAAEIAQAEEQARK

SEQ ID NO: 12639 - protein, 27 aa, Homo sapiens
RLCGLKVEVDMEKIAAEIAQAEEQARK

SEQ ID NO: 12640 - protein, 34 aa, Homo sapiens; identical to SEQ ID NO: 12571

SEQ ID NO: 12641 - protein, 8 aa, Homo sapiens
RKRQEERE

SEQ ID NO: 12642 - protein, 8 aa, Homo sapiens
RKRQEERE

SEQ ID NO: 12643 - protein, 8 aa, Homo sapiens
RKRQEERE

SEQ ID NO: 12644 - protein, 7 aa, Homo sapiens
RHQEKKR

SEQ ID NO: 12645 - protein, 17 aa, Homo sapiens
RKFLESTDSFNNELKRL

SEQ ID NO: 12646 - protein, 17 aa, Homo sapiens
RKFLESTDSFNNELKRL

SEQ ID NO: 12647 - protein, 8 aa, Homo sapiens
RHQEKKRK

SEQ ID NO: 12648 - protein, 8 aa, Homo sapiens
RHQEKKRK

SEQ ID NO: 12649 - protein, 17 aa, Homo sapiens
RKFLESTDSFNNELKRL

SEQ ID NO: 12650 - protein, 17 aa, Homo sapiens
RKFLESTDSFNNELKRL

SEQ ID NO: 12651 - protein, 17 aa, Homo sapiens
RKFLESTDSFNNELKRL

SEQ ID NO: 12652 - protein, 17 aa, Homo sapiens
RKFLESTDSFNNELKRL

SEQ ID NO: 12653 - protein, 8 aa, Homo sapiens
RHQEKKRK

SEQ ID NO: 12654 - protein, 8 aa, Homo sapiens
RHQEKKRK

SEQ ID NO: 12655 - protein, 17 aa, Homo sapiens
RKFLESTDSFNNELKRL

SEQ ID NO: 12656 - protein, 8 aa, Homo sapiens
RHQEKKRK

SEQ ID NO: 12657 - protein, 7 aa, Homo sapiens
RHQEKKR

SEQ ID NO: 12658 - protein, 8 aa, Homo sapiens
RHQEKKRK

SEQ ID NO: 12659 - protein, 17 aa, Homo sapiens
RKFLESTDSFNNELKRL

SEQ ID NO: 12660 - protein, 8 aa, Homo sapiens
RHQEKKRK

SEQ ID NO: 12661 - protein, 8 aa, Homo sapiens
RHQEKKRK

SEQ ID NO: 12662 - protein, 7 aa, Homo sapiens
RHQEKKR

SEQ ID NO: 12663 - protein, 8 aa, Homo sapiens
RHQEKKRK

SEQ ID NO: 12664 - protein, 8 aa, Homo sapiens
RHQEKKRK

SEQ ID NO: 12665 - protein, 8 aa, Homo sapiens
RHQEKKRK

SEQ ID NO: 12666 - protein, 17 aa, Homo sapiens
RKFLESTDSFNNELKRL

SEQ ID NO: 12667 - protein, 27 aa, Homo sapiens
RLCGLKVEVDMEKIAAEIAQAEEQARK

SEQ ID NO: 12668 - protein, 27 aa, Homo sapiens
RLCGLKVEVDMEKIAAEIAQAEEQARK

SEQ ID NO: 12669 - protein, 16 aa, Homo sapiens
KFLESTDSFNNELKRL

SEQ ID NO: 12670 - protein, 27 aa, Homo sapiens
RLCGLKVEVDMEKIAAEIAQAEEQARK

SEQ ID NO: 12671 - protein, 27 aa, Homo sapiens
RLCGLKVEVDMEKIAAEIAQAEEQARK

SEQ ID NO: 12672 - protein, 7 aa, Homo sapiens
KKIKERI

SEQ ID NO: 12673 - protein, 7 aa, Homo sapiens
KKIKERI

SEQ ID NO: 12674 - protein, 18 aa, Homo sapiens
KELPEYYELIRKPVDFKK

SEQ ID NO: 12675 - protein, 9 aa, Homo sapiens
RKPVDFKKI

SEQ ID NO: 12676 - protein, 9 aa, Homo sapiens
RKPVDFKKI

SEQ ID NO: 12677 - protein, 8 aa, Homo sapiens
RKPVDFKK

SEQ ID NO: 12678 - protein, 9 aa, Homo sapiens
RKPVDFKKI

SEQ ID NO: 12679 - protein, 8 aa, Homo sapiens
RKPVDFKK

SEQ ID NO: 12680 - protein, 9 aa, Homo sapiens
RKPVDFKKI

SEQ ID NO: 12681 - protein, 8 aa, Homo sapiens
RKPVDFKK

SEQ ID NO: 12682 - protein, 8 aa, Homo sapiens
RKPVDFKK

SEQ ID NO: 12683 - protein, 9 aa, Homo sapiens
RIRNHKYRS

SEQ ID NO: 12684 - protein, 8 aa, Homo sapiens
RKPVDFKK

SEQ ID NO: 12685 - protein, 9 aa, Homo sapiens
RKPVDFKKI

SEQ ID NO: 12686 - protein, 8 aa, Homo sapiens
RKPVDFKK

SEQ ID NO: 12687 - protein, 9 aa, Homo sapiens
RIRNHKYRS

SEQ ID NO: 12688 - protein, 9 aa, Homo sapiens
RKLIDQKKD

SEQ ID NO: 12689 - protein, 9 aa, Homo sapiens
RKLIDQKKD

SEQ ID NO: 12690 - protein, 9 aa, Homo sapiens
RKLIDQKKD

SEQ ID NO: 12691 - protein, 9 aa, Homo sapiens
RKLIDQKKD

SEQ ID NO: 12692 - protein, 7 aa, Homo sapiens
RIEKERM

SEQ ID NO: 12693 - protein, 13 aa, Homo sapiens
RLHKVLRPFLLRR

SEQ ID NO: 12694 - protein, 6 aa, Homo sapiens
KRKPRL

SEQ ID NO: 12695 - protein, 6 aa, Homo sapiens
KRKPRL

SEQ ID NO: 12696 - protein, 6 aa, Homo sapiens
KRKPRL

SEQ ID NO: 12697 - protein, 17 aa, Homo sapiens
RDVDYSDALTEKQWLRA

SEQ ID NO: 12698 - protein, 17 aa, Homo sapiens
RDVDYSDALTEKQWLRA

SEQ ID NO: 12699 - protein, 22 aa, Homo sapiens
RLMEEDELPSWIIKDDAEVERL

SEQ ID NO: 12700 - protein, 13 aa, Homo sapiens
RKELPEYYELIRK

SEQ ID NO: 12701 - protein, 22 aa, Homo sapiens
RLMEEDELPSWIIKDDAEVERL

SEQ ID NO: 12702 - protein, 22 aa, Homo sapiens
RLMEEDELPSWIIKDDAEVERL

SEQ ID NO: 12703 - protein, 22 aa, Homo sapiens
RLMEEDELPSWIIKDDAEVERL

SEQ ID NO: 12704 - protein, 22 aa, Homo sapiens
RLMEEDELPSWIIKDDAEVERL

SEQ ID NO: 12705 - protein, 22 aa, Homo sapiens
RLMEEDELPSWIIKDDAEVERL

SEQ ID NO: 12706 - protein, 22 aa, Homo sapiens
RLMEEDELPSWIIKDDAEVERL

SEQ ID NO: 12707 - protein, 22 aa, Homo sapiens
RLMEEDELPSWIIKDDAEVERL

SEQ ID NO: 12708 - protein, 22 aa, Homo sapiens
RLMEEDELPSWIIKDDAEVERL

SEQ ID NO: 12709 - protein, 22 aa, Homo sapiens
RLMEEDELPSWIIKDDAEVERL

SEQ ID NO: 12710 - protein, 22 aa, Homo sapiens
RLMEEDELPSWIIKDDAEVERL

SEQ ID NO: 12711 - protein, 22 aa, Homo sapiens
RLMEEDELPSWIIKDDAEVERL

SEQ ID NO: 12712 - protein, 22 aa, Homo sapiens
RLMEEDELPSWIIKDDAEVERL

SEQ ID NO: 12713 - protein, 22 aa, Homo sapiens
RLMEEDELPSWIIKDDAEVERL

SEQ ID NO: 12714 - protein, 13 aa, Homo sapiens
RKELPEYYELIRK

SEQ ID NO: 12715 - protein, 19 aa, Homo sapiens
KVIQAGMFDQKSSSHERRA

SEQ ID NO: 12716 - protein, 9 aa, Homo sapiens
KDFKEYHRS

SEQ ID NO: 12717 - protein, 9 aa, Homo sapiens
KDFKEYHRS

SEQ ID NO: 12718 - protein, 17 aa, Homo sapiens
KAVATWHANTEREQKKE

SEQ ID NO: 12719 - protein, 10 aa, Homo sapiens
REQKKETERI

SEQ ID NO: 12720 - protein, 10 aa, Homo sapiens
KLIDQKKDRR

SEQ ID NO: 12721 - protein, 11 aa, Homo sapiens
KETERIEKERM

SEQ ID NO: 12722 - protein, 11 aa, Homo sapiens
KETERIEKERM

SEQ ID NO: 12723 - protein, 11 aa, Homo sapiens
KETERIEKERM

SEQ ID NO: 12724 - protein, 16 aa, Homo sapiens
KGGAKTLMNTIMQLRK

SEQ ID NO: 12725 - protein, 8 aa, Homo sapiens
RAALLKKF

SEQ ID NO: 12726 - protein, 8 aa, Homo sapiens
RAALLKKF

SEQ ID NO: 12727 - protein, 9 aa, Homo sapiens
KDKHILAKI

SEQ ID NO: 12728 - protein, 9 aa, Homo sapiens
KDKHILAKI

SEQ ID NO: 12729 - protein, 9 aa, Homo sapiens
KDKHILAKI

SEQ ID NO: 12730 - protein, 9 aa, Homo sapiens
KDKHILAKI

SEQ ID NO: 12731 - protein, 9 aa, Homo sapiens
KDKHILAKI

SEQ ID NO: 12732 - protein, 9 aa, Homo sapiens
KDKHILAKI

SEQ ID NO: 12733 - protein, 20 aa, Homo sapiens
KNHHCKLTQVLNTHYVAPRR

SEQ ID NO: 12734 - protein, 9 aa, Homo sapiens
KDKHILAKI

SEQ ID NO: 12735 - protein, 22 aa, Homo sapiens
RMKNHHCKLTQVLNTHYVAPRR

SEQ ID NO: 12736 - protein, 9 aa, Homo sapiens
KDKHILAKI

SEQ ID NO: 12737 - protein, 20 aa, Homo sapiens
KNHHCKLTQVLNTHYVAPRR

SEQ ID NO: 12738 - protein, 20 aa, Homo sapiens
KNHHCKLTQVLNTHYVAPRR

SEQ ID NO: 12739 - protein, 9 aa, Homo sapiens
KDKHILAKI

SEQ ID NO: 12740 - protein, 22 aa, Homo sapiens
RMKNHHCKLTQVLNTHYVAPRR

SEQ ID NO: 12741 - protein, 22 aa, Homo sapiens
RMKNHHCKLTQVLNTHYVAPRR

SEQ ID NO: 12742 - protein, 20 aa, Homo sapiens
KNHHCKLTQVLNTHYVAPRR

SEQ ID NO: 12743 - protein, 22 aa, Homo sapiens
RMKNHHCKLTQVLNTHYVAPRR

SEQ ID NO: 12744 - protein, 22 aa, Homo sapiens
RMKNHHCKLTQVLNTHYVAPRR

SEQ ID NO: 12745 - protein, 22 aa, Homo sapiens
RMKNHHCKLTQVLNTHYVAPRR

SEQ ID NO: 12746 - protein, 22 aa, Homo sapiens
RMKNHHCKLTQVLNTHYVAPRR

SEQ ID NO: 12747 - protein, 22 aa, Homo sapiens
RMKNHHCKLTQVLNTHYVAPRR

SEQ ID NO: 12748 - protein, 22 aa, Homo sapiens
RMKNHHCKLTQVLNTHYVAPRR

SEQ ID NO: 12749 - protein, 22 aa, Homo sapiens
RMKNHHCKLTQVLNTHYVAPRR

SEQ ID NO: 12750 - protein, 22 aa, Homo sapiens
RMKNHHCKLTQVLNTHYVAPRR

SEQ ID NO: 12751 - protein, 22 aa, Homo sapiens
RMKNHHCKLTQVLNTHYVAPRR

SEQ ID NO: 12752 - protein, 22 aa, Homo sapiens
RMKNHHCKLTQVLNTHYVAPRR

SEQ ID NO: 12753 - protein, 22 aa, Homo sapiens
RMKNHHCKLTQVLNTHYVAPRR

SEQ ID NO: 12754 - protein, 9 aa, Homo sapiens
KDKHILAKI

SEQ ID NO: 12755 - protein, 20 aa, Homo sapiens
KNHHCKLTQVLNTHYVAPRR

SEQ ID NO: 12756 - protein, 22 aa, Homo sapiens
RMKNHHCKLTQVLNTHYVAPRR

SEQ ID NO: 12757 - protein, 22 aa, Homo sapiens
RMKNHHCKLTQVLNTHYVAPRR

SEQ ID NO: 12758 - protein, 22 aa, Homo sapiens
RMKNHHCKLTQVLNTHYVAPRR

SEQ ID NO: 12759 - protein, 16 aa, Homo sapiens
KLSKAVATWHANTERE

SEQ ID NO: 12760 - protein, 10 aa, Homo sapiens
KYKLNVDQKV

SEQ ID NO: 12761 - protein, 10 aa, Homo sapiens
KYKLNVDQKV

SEQ ID NO: 12762 - protein, 18 aa, Homo sapiens
RLCTVNSVEEKILAAAKY

SEQ ID NO: 12763 - protein, 13 aa, Homo sapiens
RWKYMIVDEGHRM

SEQ ID NO: 12764 - protein, 13 aa, Homo sapiens
RWKYMIVDEGHRM

SEQ ID NO: 12765 - protein, 18 aa, Homo sapiens
RSGKFNVLLTTYEYIIKD

SEQ ID NO: 12766 - protein, 23 aa, Homo sapiens
KQIIETAKQDVDDEYSMQYSARG

SEQ ID NO: 12767 - protein, 23 aa, Homo sapiens
KQIIETAKQDVDDEYSMQYSARG

SEQ ID NO: 12768 - protein, 23 aa, Homo sapiens
KQIIETAKQDVDDEYSMQYSARG

SEQ ID NO: 12769 - protein, 23 aa, Homo sapiens
KQIIETAKQDVDDEYSMQYSARG

SEQ ID NO: 12770 - protein, 23 aa, Homo sapiens
KQIIETAKQDVDDEYSMQYSARG

SEQ ID NO: 12771 - protein, 23 aa, Homo sapiens
KQIIETAKQDVDDEYSMQYSARG

SEQ ID NO: 12772 - protein, 23 aa, Homo sapiens
KQIIETAKQDVDDEYSMQYSARG

SEQ ID NO: 12773 - protein, 23 aa, Homo sapiens
KQIIETAKQDVDDEYSMQYSARG

SEQ ID NO: 12774 - protein, 23 aa, Homo sapiens
KQIIETAKQDVDDEYSMQYSARG

SEQ ID NO: 12775 - protein, 18 aa, Homo sapiens
KILLDPNSEEVSEKDAKQ

SEQ ID NO: 12776 - protein, 23 aa, Homo sapiens
KQIIETAKQDVDDEYSMQYSARG

SEQ ID NO: 12777 - protein, 18 aa, Homo sapiens
KILLDPNSEEVSEKDAKQ

SEQ ID NO: 12778 - protein, 18 aa, Homo sapiens
KILLDPNSEEVSEKDAKQ

SEQ ID NO: 12779 - protein, 18 aa, Homo sapiens
KILLDPNSEEVSEKDAKQ

SEQ ID NO: 12780 - protein, 18 aa, Homo sapiens
KILLDPNSEEVSEKDAKQ

SEQ ID NO: 12781 - protein, 18 aa, Homo sapiens
KILLDPNSEEVSEKDAKQ

SEQ ID NO: 12782 - protein, 10 aa, Homo sapiens
REQKKETERI

SEQ ID NO: 12783 - protein, 7 aa, Homo sapiens
KKETERI

SEQ ID NO: 12784 - protein, 10 aa, Homo sapiens
REQKKETERI

SEQ ID NO: 12785 - protein, 13 aa, Homo sapiens
RLHKVLRPFLLRR

SEQ ID NO: 12786 - protein, 20 aa, Homo sapiens
KNHHCKLTQVLNTHYVAPRR

SEQ ID NO: 12787 - protein, 22 aa, Homo sapiens
RMKNHHCKLTQVLNTHYVAPRR

SEQ ID NO: 12788 - protein, 22 aa, Homo sapiens
RMKNHHCKLTQVLNTHYVAPRR

SEQ ID NO: 12789 - protein, 22 aa, Homo sapiens
RMKNHHCKLTQVLNTHYVAPRR

SEQ ID NO: 12790 - protein, 22 aa, Homo sapiens
RMKNHHCKLTQVLNTHYVAPRR

SEQ ID NO: 12791 - protein, 22 aa, Homo sapiens
RMKNHHCKLTQVLNTHYVAPRR

SEQ ID NO: 12792 - protein, 9 aa, Homo sapiens
RKPVDFKKI

SEQ ID NO: 12793 - protein, 9 aa, Homo sapiens
RKPVDFKKI

SEQ ID NO: 12794 - protein, 13 aa, Homo sapiens
RWKYMIVDEGHRM

SEQ ID NO: 12795 - protein, 13 aa, Homo sapiens
RWKYMIVDEGHRM

SEQ ID NO: 12796 - protein, 13 aa, Homo sapiens
RWKYMIVDEGHRM

SEQ ID NO: 12797 - protein, 9 aa, Homo sapiens
RKPVDFKKI

SEQ ID NO: 12798 - protein, 12 aa, Homo sapiens
KISYKGTPAMRR

SEQ ID NO: 12799 - protein, 12 aa, Homo sapiens
RLDGTTKSEDRA

SEQ ID NO: 12800 - protein, 12 aa, Homo sapiens
RLDGTTKSEDRA

SEQ ID NO: 12801 - protein, 12 aa, Homo sapiens
RLDGTTKSEDRA

SEQ ID NO: 12802 - protein, 12 aa, Homo sapiens
RASGKFELLDRI

SEQ ID NO: 12803 - protein, 6 aa, Homo sapiens
KRKPRL

SEQ ID NO: 12804 - protein, 10 aa, Homo sapiens
KYKLNVDQKV

SEQ ID NO: 12805 - protein, 10 aa, Homo sapiens
KYKLNVDQKV

SEQ ID NO: 12806 - protein, 18 aa, Homo sapiens
KVIQAGMFDQKSSSHERR

SEQ ID NO: 12807 - protein, 10 aa, Homo sapiens
KYKLNVDQKV

SEQ ID NO: 12808 - protein, 10 aa, Homo sapiens
KYKLNVDQKV

SEQ ID NO: 12809 - protein, 18 aa, Homo sapiens
KVIQAGMFDQKSSSHERR

SEQ ID NO: 12810 - protein, 10 aa, Homo sapiens
KYKLNVDQKV

SEQ ID NO: 12811 - protein, 10 aa, Homo sapiens
KYKLNVDQKV

SEQ ID NO: 12812 - protein, 18 aa, Homo sapiens
KVIQAGMFDQKSSSHERR

SEQ ID NO: 12813 - protein, 18 aa, Homo sapiens
KVIQAGMFDQKSSSHERR

SEQ ID NO: 12814 - protein, 10 aa, Homo sapiens
KYKLNVDQKV

SEQ ID NO: 12815 - protein, 18 aa, Homo sapiens
KVIQAGMFDQKSSSHERR

SEQ ID NO: 12816 - protein, 19 aa, Homo sapiens
KVIQAGMFDQKSSSHERRA

SEQ ID NO: 12817 - protein, 10 aa, Homo sapiens
KYKLNVDQKV

SEQ ID NO: 12818 - protein, 10 aa, Homo sapiens
KYKLNVDQKV

SEQ ID NO: 12819 - protein, 10 aa, Homo sapiens
KYKLNVDQKV

SEQ ID NO: 12820 - protein, 10 aa, Homo sapiens
KYKLNVDQKV

SEQ ID NO: 12821 - protein, 9 aa, Homo sapiens
RIRNHKYRS

SEQ ID NO: 12822 - protein, 9 aa, Homo sapiens
RIRNHKYRS

SEQ ID NO: 12823 - protein, 7 aa, Homo sapiens
KKIKERI

SEQ ID NO: 12824 - protein, 7 aa, Homo sapiens
KKIKERI

SEQ ID NO: 12825 - protein, 7 aa, Homo sapiens
KKIKERI

SEQ ID NO: 12826 - protein, 7 aa, Homo sapiens
KKIKERI

SEQ ID NO: 12827 - protein, 8 aa, Homo sapiens
RKLIDQKK

SEQ ID NO: 12828 - protein, 8 aa, Homo sapiens
RKLIDQKK

SEQ ID NO: 12829 - protein, 8 aa, Homo sapiens
KLIDQKKD

SEQ ID NO: 12830 - protein, 13 aa, Homo sapiens
RLHKVLRPFLLRR

SEQ ID NO: 12831 - protein, 8 aa, Homo sapiens
KLIDQKKD

SEQ ID NO: 12832 - protein, 13 aa, Homo sapiens
RWKYMIVDEGHRM

SEQ ID NO: 12833 - protein, 13 aa, Homo sapiens
RWKYMIVDEGHRM

SEQ ID NO: 12834 - protein, 13 aa, Homo sapiens
RWKYMIVDEGHRM

SEQ ID NO: 12835 - protein, 13 aa, Homo sapiens
RWKYMIVDEGHRM

SEQ ID NO: 12836 - protein, 18 aa, Homo sapiens
KTIQTIALITYLMEHKRI

SEQ ID NO: 12837 - protein, 18 aa, Homo sapiens
KTIQTIALITYLMEHKRI

SEQ ID NO: 12838 - protein, 18 aa, Homo sapiens
KTIQTIALITYLMEHKRI

SEQ ID NO: 12839 - protein, 18 aa, Homo sapiens
KTIQTIALITYLMEHKRI

SEQ ID NO: 12840 - protein, 18 aa, Homo sapiens
KTIQTIALITYLMEHKRI

SEQ ID NO: 12841 - protein, 18 aa, Homo sapiens
KTIQTIALITYLMEHKRI

SEQ ID NO: 12842 - protein, 14 aa, Homo sapiens
MPTTQETDGFQVKR

SEQ ID NO: 12843 - protein, 14 aa, Homo sapiens
MPTTQETDGFQVKR

SEQ ID NO: 12844 - protein, 14 aa, Homo sapiens
MPTTQETDGFQVKR

SEQ ID NO: 12845 - protein, 23 aa, Homo sapiens
RPGDLNVKCTLLLMLDHQPPQYK

SEQ ID NO: 12846 - protein, 23 aa, Homo sapiens
RPGDLNVKCTLLLMLDHQPPQYK

SEQ ID NO: 12847 - protein, 23 aa, Homo sapiens
RPGDLNVKCTLLLMLDHQPPQYK

SEQ ID NO: 12848 - protein, 14 aa, Homo sapiens
MPTTQETDGFQVKR

SEQ ID NO: 12849 - protein, 23 aa, Homo sapiens
RPGDLNVKCTLLLMLDHQPPQYK

SEQ ID NO: 12850 - protein, 23 aa, Homo sapiens
RPGDLNVKCTLLLMLDHQPPQYK

SEQ ID NO: 12851 - protein, 23 aa, Homo sapiens
RPGDLNVKCTLLLMLDHQPPQYK

SEQ ID NO: 12852 - protein, 23 aa, Homo sapiens
RPGDLNVKCTLLLMLDHQPPQYK

SEQ ID NO: 12853 - protein, 14 aa, Homo sapiens
MPTTQETDGFQVKR

SEQ ID NO: 12854 - protein, 23 aa, Homo sapiens
RPGDLNVKCTLLLMLDHQPPQYK

SEQ ID NO: 12855 - protein, 23 aa, Homo sapiens
RPGDLNVKCTLLLMLDHQPPQYK

SEQ ID NO: 12856 - protein, 14 aa, Homo sapiens
MPTTQETDGFQVKR

SEQ ID NO: 12857 - protein, 21 aa, Homo sapiens
MPTTQETDGFQVKRPGDLNVK

SEQ ID NO: 12858 - protein, 21 aa, Homo sapiens
MPTTQETDGFQVKRPGDLNVK

SEQ ID NO: 12859 - protein, 26 aa, Homo sapiens
LAGLLQHPDPIVINHVISVDPNDQKK

SEQ ID NO: 12860 - protein, 15 aa, Homo sapiens
IHETIESINQLKTQR

SEQ ID NO: 12861 - protein, 9 aa, Homo sapiens
HIFAKVQQR

SEQ ID NO: 12862 - protein, 6 aa, Homo sapiens
PLTQKR

SEQ ID NO: 12863 - protein, 7 aa, Homo sapiens
PLTQKRK

SEQ ID NO: 12864 - protein, 6 aa, Homo sapiens
PLTQKR

SEQ ID NO: 12865 - protein, 6 aa, Homo sapiens
PLTQKR

SEQ ID NO: 12866 - protein, 6 aa, Homo sapiens
PLTQKR

SEQ ID NO: 12867 - protein, 6 aa, Homo sapiens
PLTQKR

SEQ ID NO: 12868 - protein, 6 aa, Homo sapiens
PLTQKR

SEQ ID NO: 12869 - protein, 7 aa, Homo sapiens
PLTQKRK

SEQ ID NO: 12870 - protein, 7 aa, Homo sapiens
KPLTQKR

SEQ ID NO: 12871 - protein, 14 aa, Homo sapiens
MEIQEAIKKPLTQK

SEQ ID NO: 12872 - protein, 7 aa, Homo sapiens
KPLTQKR

SEQ ID NO: 12873 - protein, 7 aa, Homo sapiens
KPLTQKR

SEQ ID NO: 12874 - protein, 10 aa, Homo sapiens
RMEIQEAIKK

SEQ ID NO: 12875 - protein, 21 aa, Homo sapiens
MPTTQETDGFQVKRPGDLNVK

SEQ ID NO: 12876 - protein, 21 aa, Homo sapiens
MPTTQETDGFQVKRPGDLNVK

SEQ ID NO: 12877 - protein, 21 aa, Homo sapiens
MPTTQETDGFQVKRPGDLNVK

SEQ ID NO: 12878 - protein, 21 aa, Homo sapiens
MPTTQETDGFQVKRPGDLNVK

SEQ ID NO: 12879 - protein, 21 aa, Homo sapiens
MPTTQETDGFQVKRPGDLNVK

SEQ ID NO: 12880 - protein, 21 aa, Homo sapiens
MPTTQETDGFQVKRPGDLNVK

SEQ ID NO: 12881 - protein, 21 aa, Homo sapiens
MPTTQETDGFQVKRPGDLNVK

SEQ ID NO: 12882 - protein, 21 aa, Homo sapiens
MPTTQETDGFQVKRPGDLNVK

SEQ ID NO: 12883 - protein, 9 aa, Homo sapiens
HIFAKVQQR

SEQ ID NO: 12884 - protein, 21 aa, Homo sapiens
MPTTQETDGFQVKRPGDLNVK

SEQ ID NO: 12885 - protein, 21 aa, Homo sapiens
MPTTQETDGFQVKRPGDLNVK

SEQ ID NO: 12886 - protein, 21 aa, Homo sapiens
MPTTQETDGFQVKRPGDLNVK

SEQ ID NO: 12887 - protein, 11 aa, Homo sapiens
VEGKLLDDPSK

SEQ ID NO: 12888 - protein, 11 aa, Homo sapiens
VEGKLLDDPSK

SEQ ID NO: 12889 - protein, 33 aa, Homo sapiens
FSEIPMKLAGLLQHPDPIVINHVISVDPNDQKK

SEQ ID NO: 12890 - protein, 33 aa, Homo sapiens; identical to SEQ ID NO: 12889

SEQ ID NO: 12891 - protein, 8 aa, Homo sapiens
KLDQTIAR

SEQ ID NO: 12892 - protein, 8 aa, Homo sapiens
KLDQTIAR

SEQ ID NO: 12893 - protein, 15 aa, Homo sapiens
VASAAAKSALEEFSK

SEQ ID NO: 12894 - protein, 15 aa, Homo sapiens
VASAAAKSALEEFSK

SEQ ID NO: 12895 - protein, 15 aa, Homo sapiens
VASAAAKSALEEFSK

SEQ ID NO: 12896 - protein, 31 aa, Homo sapiens; identical to SEQ ID NO: 1672

SEQ ID NO: 12897 - protein, 31 aa, Homo sapiens; identical to SEQ ID NO: 1672

SEQ ID NO: 12898 - protein, 15 aa, Homo sapiens
VASAAAKSALEEFSK

SEQ ID NO: 12899 - protein, 15 aa, Homo sapiens
VASAAAKSALEEFSK

SEQ ID NO: 12900 - protein, 31 aa, Homo sapiens; identical to SEQ ID NO: 1672

SEQ ID NO: 12901 - protein, 15 aa, Homo sapiens
VASAAAKSALEEFSK

SEQ ID NO: 12902 - protein, 15 aa, Homo sapiens
VASAAAKSALEEFSK

SEQ ID NO: 12903 - protein, 9 aa, Homo sapiens
KDSESAPVK

SEQ ID NO: 12904 - protein, 11 aa, Homo sapiens
KYIQAEPPTNK

SEQ ID NO: 12905 - protein, 5 aa, Homo sapiens
TKVER

SEQ ID NO: 12906 - protein, 10 aa, Homo sapiens
AKHLAAVEER

SEQ ID NO: 12907 - protein, 10 aa, Homo sapiens
AKHLAAVEER

SEQ ID NO: 12908 - protein, 10 aa, Homo sapiens
AKHLAAVEER

SEQ ID NO: 12909 - protein, 6 aa, Homo sapiens
KTKVER

SEQ ID NO: 12910 - protein, 5 aa, Homo sapiens
TKVER

SEQ ID NO: 12911 - protein, 5 aa, Homo sapiens
TKVER

SEQ ID NO: 12912 - protein, 19 aa, Homo sapiens
TPQQTSASQQMLNFPDKGK

SEQ ID NO: 12913 - protein, 19 aa, Homo sapiens
TPQQTSASQQMLNFPDKGK

SEQ ID NO: 12914 - protein, 12 aa, Homo sapiens
EKPTDMQNFGLR

SEQ ID NO: 12915 - protein, 19 aa, Homo sapiens
TPQQTSASQQMLNFPDKGK

SEQ ID NO: 12916 - protein, 19 aa, Homo sapiens
TPQQTSASQQMLNFPDKGK

SEQ ID NO: 12917 - protein, 19 aa, Homo sapiens
TPQQTSASQQMLNFPDKGK

SEQ ID NO: 12918 - protein, 12 aa, Homo sapiens
EKPTDMQNFGLR

SEQ ID NO: 12919 - protein, 12 aa, Homo sapiens
TDMYTKKNVPSK

SEQ ID NO: 12920 - protein, 12 aa, Homo sapiens
TDMYTKKNVPSK

SEQ ID NO: 12921 - protein, 6 aa, Homo sapiens
KNVPSK

SEQ ID NO: 12922 - protein, 6 aa, Homo sapiens
KNVPSK

SEQ ID NO: 12923 - protein, 6 aa, Homo sapiens
KNVPSK

SEQ ID NO: 12924 - protein, 6 aa, Homo sapiens
KNVPSK

SEQ ID NO: 12925 - protein, 6 aa, Homo sapiens
KNVPSK

SEQ ID NO: 12926 - protein, 6 aa, Homo sapiens
KTKVER

SEQ ID NO: 12927 - protein, 15 aa, Homo sapiens
VASAAAKSALEEFSK

SEQ ID NO: 12928 - protein, 6 aa, Homo sapiens
KTKVER

SEQ ID NO: 12929 - protein, 6 aa, Homo sapiens
KTKVER

SEQ ID NO: 12930 - protein, 15 aa, Homo sapiens
VASAAAKSALEEFSK

SEQ ID NO: 12931 - protein, 15 aa, Homo sapiens
VASAAAKSALEEFSK

SEQ ID NO: 12932 - protein, 15 aa, Homo sapiens
MKEEVPTALVEAHVR

SEQ ID NO: 12933 - protein, 15 aa, Homo sapiens
VASAAAKSALEEFSK

SEQ ID NO: 12934 - protein, 15 aa, Homo sapiens
MKEEVPTALVEAHVR

SEQ ID NO: 12935 - protein, 15 aa, Homo sapiens
VASAAAKSALEEFSK

SEQ ID NO: 12936 - protein, 15 aa, Homo sapiens
VASAAAKSALEEFSK

SEQ ID NO: 12937 - protein, 15 aa, Homo sapiens
MKEEVPTALVEAHVR

SEQ ID NO: 12938 - protein, 15 aa, Homo sapiens
VASAAAKSALEEFSK

SEQ ID NO: 12939 - protein, 15 aa, Homo sapiens
MKEEVPTALVEAHVR

SEQ ID NO: 12940 - protein, 15 aa, Homo sapiens
MKEEVPTALVEAHVR

SEQ ID NO: 12941 - protein, 15 aa, Homo sapiens
MKEEVPTALVEAHVR

SEQ ID NO: 12942 - protein, 10 aa, Homo sapiens
AKHLAAVEER

SEQ ID NO: 12943 - protein, 10 aa, Homo sapiens
AKHLAAVEER

SEQ ID NO: 12944 - protein, 10 aa, Homo sapiens
AKHLAAVEER

SEQ ID NO: 12945 - protein, 10 aa, Homo sapiens
AKHLAAVEER

SEQ ID NO: 12946 - protein, 10 aa, Homo sapiens
AKHLAAVEER

SEQ ID NO: 12947 - protein, 10 aa, Homo sapiens
AKHLAAVEER

SEQ ID NO: 12948 - protein, 10 aa, Homo sapiens
AKHLAAVEER

SEQ ID NO: 12949 - protein, 10 aa, Homo sapiens
AKHLAAVEER

SEQ ID NO: 12950 - protein, 10 aa, Homo sapiens
AKHLAAVEER

SEQ ID NO: 12951 - protein, 15 aa, Homo sapiens
VASAAAKSALEEFSK

SEQ ID NO: 12952 - protein, 15 aa, Homo sapiens
VASAAAKSALEEFSK

SEQ ID NO: 12953 - protein, 15 aa, Homo sapiens
VASAAAKSALEEFSK

SEQ ID NO: 12954 - protein, 15 aa, Homo sapiens
VASAAAKSALEEFSK

SEQ ID NO: 12955 - protein, 15 aa, Homo sapiens
VASAAAKSALEEFSK

SEQ ID NO: 12956 - protein, 15 aa, Homo sapiens
VASAAAKSALEEFSK

SEQ ID NO: 12957 - protein, 15 aa, Homo sapiens
VASAAAKSALEEFSK

SEQ ID NO: 12958 - protein, 15 aa, Homo sapiens
VASAAAKSALEEFSK

SEQ ID NO: 12959 - protein, 15 aa, Homo sapiens
VASAAAKSALEEFSK

SEQ ID NO: 12960 - protein, 23 aa, Homo sapiens
SALEEFSKMKEEVPTALVEAHVR

SEQ ID NO: 12961 - protein, 23 aa, Homo sapiens
SALEEFSKMKEEVPTALVEAHVR

SEQ ID NO: 12962 - protein, 23 aa, Homo sapiens
SALEEFSKMKEEVPTALVEAHVR

SEQ ID NO: 12963 - protein, 23 aa, Homo sapiens
SALEEFSKMKEEVPTALVEAHVR

SEQ ID NO: 12964 - protein, 23 aa, Homo sapiens
SALEEFSKMKEEVPTALVEAHVR

SEQ ID NO: 12965 - protein, 15 aa, Homo sapiens
VASAAAKSALEEFSK

SEQ ID NO: 12966 - protein, 15 aa, Homo sapiens
VASAAAKSALEEFSK

SEQ ID NO: 12967 - protein, 15 aa, Homo sapiens
VASAAAKSALEEFSK

SEQ ID NO: 12968 - protein, 7 aa, Homo sapiens
KVEEAAK

SEQ ID NO: 12969 - protein, 7 aa, Homo sapiens
KVEEAAK

SEQ ID NO: 12970 - protein, 6 aa, Homo sapiens
KTKVER

SEQ ID NO: 12971 - protein, 6 aa, Homo sapiens
KTKVER

SEQ ID NO: 12972 - protein, 12 aa, Homo sapiens
TDMYTKKNVPSK

SEQ ID NO: 12973 - protein, 7 aa, Homo sapiens
KVEEAAK

SEQ ID NO: 12974 - protein, 6 aa, Homo sapiens
KTKVER

SEQ ID NO: 12975 - protein, 20 aa, Homo sapiens
EPKEGQEEVLKEVVESEGER

SEQ ID NO: 12976 - protein, 20 aa, Homo sapiens
EPKEGQEEVLKEVVESEGER

SEQ ID NO: 12977 - protein, 20 aa, Homo sapiens
EPKEGQEEVLKEVVESEGER

SEQ ID NO: 12978 - protein, 15 aa, Homo sapiens
KIKSLVALLVETQMK

SEQ ID NO: 12979 - protein, 15 aa, Homo sapiens
KIKSLVALLVETQMK

SEQ ID NO: 12980 - protein, 15 aa, Homo sapiens
KIKSLVALLVETQMK

SEQ ID NO: 12981 - protein, 15 aa, Homo sapiens
KIKSLVALLVETQMK

SEQ ID NO: 12982 - protein, 10 aa, Homo sapiens
AKHLAAVEER

SEQ ID NO: 12983 - protein, 15 aa, Homo sapiens
KIKSLVALLVETQMK

SEQ ID NO: 12984 - protein, 15 aa, Homo sapiens
KIKSLVALLVETQMK

SEQ ID NO: 12985 - protein, 15 aa, Homo sapiens
KIKSLVALLVETQMK

SEQ ID NO: 12986 - protein, 15 aa, Homo sapiens
KIKSLVALLVETQMK

SEQ ID NO: 12987 - protein, 10 aa, Homo sapiens
AKHLAAVEER

SEQ ID NO: 12988 - protein, 10 aa, Homo sapiens
AKHLAAVEER

SEQ ID NO: 12989 - protein, 15 aa, Homo sapiens
KIKSLVALLVETQMK

SEQ ID NO: 12990 - protein, 15 aa, Homo sapiens
KIKSLVALLVETQMK

SEQ ID NO: 12991 - protein, 10 aa, Homo sapiens
AKHLAAVEER

SEQ ID NO: 12992 - protein, 15 aa, Homo sapiens
KIKSLVALLVETQMK

SEQ ID NO: 12993 - protein, 15 aa, Homo sapiens
KIKSLVALLVETQMK

SEQ ID NO: 12994 - protein, 10 aa, Homo sapiens
AKHLAAVEER

SEQ ID NO: 12995 - protein, 15 aa, Homo sapiens
KIKSLVALLVETQMK

SEQ ID NO: 12996 - protein, 10 aa, Homo sapiens
AKHLAAVEER

SEQ ID NO: 12997 - protein, 15 aa, Homo sapiens
KIKSLVALLVETQMK

SEQ ID NO: 12998 - protein, 15 aa, Homo sapiens
KIKSLVALLVETQMK

SEQ ID NO: 12999 - protein, 15 aa, Homo sapiens
KIKSLVALLVETQMK

SEQ ID NO: 13000 - protein, 15 aa, Homo sapiens
KIKSLVALLVETQMK

SEQ ID NO: 13001 - protein, 15 aa, Homo sapiens
KIKSLVALLVETQMK

SEQ ID NO: 13002 - protein, 15 aa, Homo sapiens
KIKSLVALLVETQMK

SEQ ID NO: 13003 - protein, 10 aa, Homo sapiens
AKHLAAVEER

SEQ ID NO: 13004 - protein, 15 aa, Homo sapiens
KIKSLVALLVETQMK

SEQ ID NO: 13005 - protein, 9 aa, Homo sapiens
KDSESAPVK

SEQ ID NO: 13006 - protein, 9 aa, Homo sapiens
KKDGGPNVK

SEQ ID NO: 13007 - protein, 7 aa, Homo sapiens
NVPSKSK

SEQ ID NO: 13008 - protein, 11 aa, Homo sapiens
KVEEAAKVTGK

SEQ ID NO: 13009 - protein, 12 aa, Homo sapiens
TDMYTKKNVPSK

SEQ ID NO: 13010 - protein, 14 aa, Homo sapiens
NVPSKSKAAASATR

SEQ ID NO: 13011 - protein, 14 aa, Homo sapiens
NVPSKSKAAASATR

SEQ ID NO: 13012 - protein, 12 aa, Homo sapiens
TDMYTKKNVPSK

SEQ ID NO: 13013 - protein, 12 aa, Homo sapiens
TDMYTKKNVPSK

SEQ ID NO: 13014 - protein, 12 aa, Homo sapiens
TDMYTKKNVPSK

SEQ ID NO: 13015 - protein, 12 aa, Homo sapiens
TDMYTKKNVPSK

SEQ ID NO: 13016 - protein, 7 aa, Homo sapiens
TDMYTKK

SEQ ID NO: 13017 - protein, 12 aa, Homo sapiens
TDMYTKKNVPSK

SEQ ID NO: 13018 - protein, 12 aa, Homo sapiens
TDMYTKKNVPSK

SEQ ID NO: 13019 - protein, 7 aa, Homo sapiens
TDMYTKK

SEQ ID NO: 13020 - protein, 7 aa, Homo sapiens
TDMYTKK

SEQ ID NO: 13021 - protein, 12 aa, Homo sapiens
TDMYTKKNVPSK

SEQ ID NO: 13022 - protein, 6 aa, Homo sapiens
EPKEPR

SEQ ID NO: 13023 - protein, 6 aa, Homo sapiens
EPKEPR

SEQ ID NO: 13024 - protein, 6 aa, Homo sapiens
EPKEPR

SEQ ID NO: 13025 - protein, 6 aa, Homo sapiens
EPKEPR

SEQ ID NO: 13026 - protein, 10 aa, Homo sapiens
VEGQATDEKK

SEQ ID NO: 13027 - protein, 9 aa, Homo sapiens
SKAAASATR

SEQ ID NO: 13028 - protein, 9 aa, Homo sapiens
SKAAASATR

SEQ ID NO: 13029 - protein, 15 aa, Homo sapiens
MKEEVPTALVEAHVR

SEQ ID NO: 13030 - protein, 6 aa, Homo sapiens
KTKVER

SEQ ID NO: 13031 - protein, 6 aa, Homo sapiens
KTKVER

SEQ ID NO: 13032 - protein, 6 aa, Homo sapiens
KTKVER

SEQ ID NO: 13033 - protein, 7 aa, Homo sapiens
KVEEAAK

SEQ ID NO: 13034 - protein, 8 aa, Homo sapiens
KDGGPNVK

SEQ ID NO: 13035 - protein, 9 aa, Homo sapiens
KKDGGPNVK

SEQ ID NO: 13036 - protein, 8 aa, Homo sapiens
KDGGPNVK

SEQ ID NO: 13037 - protein, 9 aa, Homo sapiens
KKDGGPNVK

SEQ ID NO: 13038 - protein, 9 aa, Homo sapiens
KKDGGPNVK

SEQ ID NO: 13039 - protein, 14 aa, Homo sapiens
TVNTKKDSESAPVK

SEQ ID NO: 13040 - protein, 30 aa, Homo sapiens; identical to SEQ ID NO: 8343

SEQ ID NO: 13041 - protein, 14 aa, Homo sapiens
TVNTKKDSESAPVK

SEQ ID NO: 13042 - protein, 30 aa, Homo sapiens; identical to SEQ ID NO: 8343

SEQ ID NO: 13043 - protein, 14 aa, Homo sapiens
TVNTKKDSESAPVK

SEQ ID NO: 13044 - protein, 14 aa, Homo sapiens
TVNTKKDSESAPVK

SEQ ID NO: 13045 - protein, 30 aa, Homo sapiens; identical to SEQ ID NO: 8343

SEQ ID NO: 13046 - protein, 14 aa, Homo sapiens
TVNTKKDSESAPVK

SEQ ID NO: 13047 - protein, 14 aa, Homo sapiens
TVNTKKDSESAPVK

SEQ ID NO: 13048 - protein, 7 aa, Homo sapiens
KDEEKGK

SEQ ID NO: 13049 - protein, 7 aa, Homo sapiens
KDEEKGK

SEQ ID NO: 13050 - protein, 7 aa, Homo sapiens
KDEEKGK

SEQ ID NO: 13051 - protein, 19 aa, Homo sapiens
EGGGAIEEEAKEKTSEAPK

SEQ ID NO: 13052 - protein, 6 aa, Homo sapiens
KTKVER

SEQ ID NO: 13053 - protein, 7 aa, Homo sapiens
NVPSKSK

SEQ ID NO: 13054 - protein, 20 aa, Homo sapiens
EPKEGQEEVLKEVVESEGER

SEQ ID NO: 13055 - protein, 20 aa, Homo sapiens
EPKEGQEEVLKEVVESEGER

SEQ ID NO: 13056 - protein, 20 aa, Homo sapiens
EPKEGQEEVLKEVVESEGER

SEQ ID NO: 13057 - protein, 5 aa, Homo sapiens
KVHAK

SEQ ID NO: 13058 - protein, 5 aa, Homo sapiens
KVHAK

SEQ ID NO: 13059 - protein, 5 aa, Homo sapiens
KVHAK

SEQ ID NO: 13060 - protein, 5 aa, Homo sapiens
KVHAK

SEQ ID NO: 13061 - protein, 6 aa, Homo sapiens
KTKVER

SEQ ID NO: 13062 - protein, 17 aa, Homo sapiens
EGQEEVLKEVVESEGER

SEQ ID NO: 13063 - protein, 17 aa, Homo sapiens
EGQEEVLKEVVESEGER

SEQ ID NO: 13064 - protein, 17 aa, Homo sapiens
EGQEEVLKEVVESEGER

SEQ ID NO: 13065 - protein, 6 aa, Homo sapiens
KTKVER

SEQ ID NO: 13066 - protein, 17 aa, Homo sapiens
EGQEEVLKEVVESEGER

SEQ ID NO: 13067 - protein, 6 aa, Homo sapiens
KTKVER

SEQ ID NO: 13068 - protein, 6 aa, Homo sapiens
KTKVER

SEQ ID NO: 13069 - protein, 17 aa, Homo sapiens
EGQEEVLKEVVESEGER

SEQ ID NO: 13070 - protein, 6 aa, Homo sapiens
KTKVER

SEQ ID NO: 13071 - protein, 6 aa, Homo sapiens
KTKVER

SEQ ID NO: 13072 - protein, 6 aa, Homo sapiens
KTKVER

SEQ ID NO: 13073 - protein, 17 aa, Homo sapiens
EGQEEVLKEVVESEGER

SEQ ID NO: 13074 - protein, 17 aa, Homo sapiens
EGQEEVLKEVVESEGER

SEQ ID NO: 13075 - protein, 6 aa, Homo sapiens
KTKVER

SEQ ID NO: 13076 - protein, 6 aa, Homo sapiens
KTKVER

SEQ ID NO: 13077 - protein, 18 aa, Homo sapiens
EGQEEVLKEVVESEGERK

SEQ ID NO: 13078 - protein, 6 aa, Homo sapiens
KTKVER

SEQ ID NO: 13079 - protein, 6 aa, Homo sapiens
KTKVER

SEQ ID NO: 13080 - protein, 6 aa, Homo sapiens
KTKVER

SEQ ID NO: 13081 - protein, 17 aa, Homo sapiens
EGQEEVLKEVVESEGER

SEQ ID NO: 13082 - protein, 6 aa, Homo sapiens
KTKVER

SEQ ID NO: 13083 - protein, 6 aa, Homo sapiens
KTKVER

SEQ ID NO: 13084 - protein, 6 aa, Homo sapiens
KTKVER

SEQ ID NO: 13085 - protein, 6 aa, Homo sapiens
KTKVER

SEQ ID NO: 13086 - protein, 6 aa, Homo sapiens
KTKVER

SEQ ID NO: 13087 - protein, 17 aa, Homo sapiens
EGQEEVLKEVVESEGER

SEQ ID NO: 13088 - protein, 17 aa, Homo sapiens
EGQEEVLKEVVESEGER

SEQ ID NO: 13089 - protein, 17 aa, Homo sapiens
EGQEEVLKEVVESEGER

SEQ ID NO: 13090 - protein, 17 aa, Homo sapiens
EGQEEVLKEVVESEGER

SEQ ID NO: 13091 - protein, 6 aa, Homo sapiens
KTKVER

SEQ ID NO: 13092 - protein, 6 aa, Homo sapiens
KTKVER

SEQ ID NO: 13093 - protein, 11 aa, Homo sapiens
KVEEAAKVTGK

SEQ ID NO: 13094 - protein, 11 aa, Homo sapiens
KVEEAAKVTGK

SEQ ID NO: 13095 - protein, 6 aa, Homo sapiens
KTKVER

SEQ ID NO: 13096 - protein, 11 aa, Homo sapiens
KVEEAAKVTGK

SEQ ID NO: 13097 - protein, 11 aa, Homo sapiens
KVEEAAKVTGK

SEQ ID NO: 13098 - protein, 11 aa, Homo sapiens
KVEEAAKVTGK

SEQ ID NO: 13099 - protein, 6 aa, Homo sapiens
KTKVER

SEQ ID NO: 13100 - protein, 6 aa, Homo sapiens
KTKVER

SEQ ID NO: 13101 - protein, 6 aa, Homo sapiens
KTKVER

SEQ ID NO: 13102 - protein, 6 aa, Homo sapiens
KTKVER

SEQ ID NO: 13103 - protein, 6 aa, Homo sapiens
KTKVER

SEQ ID NO: 13104 - protein, 6 aa, Homo sapiens
KTKVER

SEQ ID NO: 13105 - protein, 11 aa, Homo sapiens
KVEEAAKVTGK

SEQ ID NO: 13106 - protein, 11 aa, Homo sapiens
KVEEAAKVTGK

SEQ ID NO: 13107 - protein, 11 aa, Homo sapiens
KVEEAAKVTGK

SEQ ID NO: 13108 - protein, 11 aa, Homo sapiens
KVEEAAKVTGK

SEQ ID NO: 13109 - protein, 11 aa, Homo sapiens
KVEEAAKVTGK

SEQ ID NO: 13110 - protein, 5 aa, Homo sapiens
TKVER

SEQ ID NO: 13111 - protein, 11 aa, Homo sapiens
KVEEAAKVTGK

SEQ ID NO: 13112 - protein, 6 aa, Homo sapiens
KTKVER

SEQ ID NO: 13113 - protein, 5 aa, Homo sapiens
TKVER

SEQ ID NO: 13114 - protein, 11 aa, Homo sapiens
KVEEAAKVTGK

SEQ ID NO: 13115 - protein, 5 aa, Homo sapiens
TKVER

SEQ ID NO: 13116 - protein, 5 aa, Homo sapiens
TKVER

SEQ ID NO: 13117 - protein, 6 aa, Homo sapiens
KTKVER

SEQ ID NO: 13118 - protein, 6 aa, Homo sapiens
KTKVER

SEQ ID NO: 13119 - protein, 6 aa, Homo sapiens
KTKVER

SEQ ID NO: 13120 - protein, 6 aa, Homo sapiens
KTKVER

SEQ ID NO: 13121 - protein, 6 aa, Homo sapiens
KTKVER

SEQ ID NO: 13122 - protein, 6 aa, Homo sapiens
KTKVER

SEQ ID NO: 13123 - protein, 6 aa, Homo sapiens
KTKVER

SEQ ID NO: 13124 - protein, 6 aa, Homo sapiens
KTKVER

SEQ ID NO: 13125 - protein, 18 aa, Homo sapiens
ISAKTLTDEVNSPDSDRR

SEQ ID NO: 13126 - protein, 6 aa, Homo sapiens
KGGNYK

SEQ ID NO: 13127 - protein, 6 aa, Homo sapiens
KGGNYK

SEQ ID NO: 13128 - protein, 8 aa, Homo sapiens
DKKGGNYK

SEQ ID NO: 13129 - protein, 18 aa, Homo sapiens
ISAKTLTDEVNSPDSDRR

SEQ ID NO: 13130 - protein, 18 aa, Homo sapiens
ISAKTLTDEVNSPDSDRR

SEQ ID NO: 13131 - protein, 9 aa, Homo sapiens
KKDGGPNVK

SEQ ID NO: 13132 - protein, 9 aa, Homo sapiens
KKDGGPNVK

SEQ ID NO: 13133 - protein, 9 aa, Homo sapiens
KKDGGPNVK

SEQ ID NO: 13134 - protein, 18 aa, Homo sapiens
ISAKTLTDEVNSPDSDRR

SEQ ID NO: 13135 - protein, 9 aa, Homo sapiens
KKDGGPNVK

SEQ ID NO: 13136 - protein, 9 aa, Homo sapiens
KKDGGPNVK

SEQ ID NO: 13137 - protein, 9 aa, Homo sapiens
KKDGGPNVK

SEQ ID NO: 13138 - protein, 9 aa, Homo sapiens
KKDGGPNVK

SEQ ID NO: 13139 - protein, 9 aa, Homo sapiens
KKDGGPNVK

SEQ ID NO: 13140 - protein, 34 aa, Homo sapiens; identical to SEQ ID NO: 8445

SEQ ID NO: 13141 - protein, 5 aa, Homo sapiens
KVHAK

SEQ ID NO: 13142 - protein, 5 aa, Homo sapiens
KVHAK

SEQ ID NO: 13143 - protein, 5 aa, Homo sapiens
KVHAK

SEQ ID NO: 13144 - protein, 5 aa, Homo sapiens
KVHAK

SEQ ID NO: 13145 - protein, 5 aa, Homo sapiens
KVHAK

SEQ ID NO: 13146 - protein, 17 aa, Homo sapiens
VASAAAKSALEEFSKMK

SEQ ID NO: 13147 - protein, 5 aa, Homo sapiens
TKVER

SEQ ID NO: 13148 - protein, 23 aa, Homo sapiens
SALEEFSKMKEEVPTALVEAHVR

SEQ ID NO: 13149 - protein, 10 aa, Homo sapiens
AKHLAAVEER

SEQ ID NO: 13150 - protein, 23 aa, Homo sapiens
SALEEFSKMKEEVPTALVEAHVR

SEQ ID NO: 13151 - protein, 6 aa, Homo sapiens
KTKVER

SEQ ID NO: 13152 - protein, 6 aa, Homo sapiens
KTKVER

SEQ ID NO: 13153 - protein, 7 aa, Homo sapiens
KVEEAAK

SEQ ID NO: 13154 - protein, 7 aa, Homo sapiens
KVEEAAK

SEQ ID NO: 13155 - protein, 7 aa, Homo sapiens
KVEEAAK

SEQ ID NO: 13156 - protein, 7 aa, Homo sapiens
LKDIIKR

SEQ ID NO: 13157 - protein, 7 aa, Homo sapiens
LKDIIKR

SEQ ID NO: 13158 - protein, 7 aa, Homo sapiens
LKDIIKR

SEQ ID NO: 13159 - protein, 26 aa, Homo sapiens
SLVQNNCLSRPNIFLCPEIEPKLLGK

SEQ ID NO: 13160 - protein, 7 aa, Homo sapiens
LKDIIKR

SEQ ID NO: 13161 - protein, 7 aa, Homo sapiens
LKDIIKR

SEQ ID NO: 13162 - protein, 6 aa, Homo sapiens
LKDIIK

SEQ ID NO: 13163 - protein, 7 aa, Homo sapiens
LKDIIKR

SEQ ID NO: 13164 - protein, 7 aa, Homo sapiens
LKDIIKR

SEQ ID NO: 13165 - protein, 9 aa, Homo sapiens
KKDGGPNVK

SEQ ID NO: 13166 - protein, 9 aa, Homo sapiens
KKDGGPNVK

SEQ ID NO: 13167 - protein, 9 aa, Homo sapiens
KKDGGPNVK

SEQ ID NO: 13168 - protein, 9 aa, Homo sapiens
KKDGGPNVK

SEQ ID NO: 13169 - protein, 9 aa, Homo sapiens
KKDGGPNVK

SEQ ID NO: 13170 - protein, 28 aa, Homo sapiens
SLSSLVVQLLQFQEEVFGKHVSNAPLTK

SEQ ID NO: 13171 - protein, 9 aa, Homo sapiens
KKDGGPNVK

SEQ ID NO: 13172 - protein, 7 aa, Homo sapiens
TSEAPKK

SEQ ID NO: 13173 - protein, 12 aa, Homo sapiens
DEEKGKEGDSEK

SEQ ID NO: 13174 - protein, 9 aa, Homo sapiens
LWLGKNYKK

SEQ ID NO: 13175 - protein, 5 aa, Homo sapiens
KVHAK

SEQ ID NO: 13176 - protein, 6 aa, Homo sapiens
KTKVER

SEQ ID NO: 13177 - protein, 6 aa, Homo sapiens
KTKVER

SEQ ID NO: 13178 - protein, 5 aa, Homo sapiens
TKVER

SEQ ID NO: 13179 - protein, 6 aa, Homo sapiens
KTKVER

SEQ ID NO: 13180 - protein, 5 aa, Homo sapiens
TKVER

SEQ ID NO: 13181 - protein, 5 aa, Homo sapiens
TKVER

SEQ ID NO: 13182 - protein, 5 aa, Homo sapiens
TKVER

SEQ ID NO: 13183 - protein, 6 aa, Homo sapiens
KTKVER

SEQ ID NO: 13184 - protein, 6 aa, Homo sapiens
KTKVER

SEQ ID NO: 13185 - protein, 36 aa, Homo sapiens; identical to SEQ ID NO: 8480

SEQ ID NO: 13186 - protein, 6 aa, Homo sapiens
KTKVER

SEQ ID NO: 13187 - protein, 5 aa, Homo sapiens
TKVER

SEQ ID NO: 13188 - protein, 5 aa, Homo sapiens
TKVER

SEQ ID NO: 13189 - protein, 5 aa, Homo sapiens
TKVER

SEQ ID NO: 13190 - protein, 11 aa, Homo sapiens
KYIQAEPPTNK

SEQ ID NO: 13191 - protein, 11 aa, Homo sapiens
KYIQAEPPTNK

SEQ ID NO: 13192 - protein, 5 aa, Homo sapiens
TKVER

SEQ ID NO: 13193 - protein, 5 aa, Homo sapiens
TKVER

SEQ ID NO: 13194 - protein, 5 aa, Homo sapiens
TKVER

SEQ ID NO: 13195 - protein, 6 aa, Homo sapiens
KTKVER

SEQ ID NO: 13196 - protein, 15 aa, Homo sapiens
MKEEVPTALVEAHVR

SEQ ID NO: 13197 - protein, 5 aa, Homo sapiens
TKVER

SEQ ID NO: 13198 - protein, 6 aa, Homo sapiens
KTKVER

SEQ ID NO: 13199 - protein, 6 aa, Homo sapiens
KTKVER

SEQ ID NO: 13200 - protein, 5 aa, Homo sapiens
TKVER

SEQ ID NO: 13201 - protein, 5 aa, Homo sapiens
TKVER

SEQ ID NO: 13202 - protein, 10 aa, Homo sapiens
AKHLAAVEER

SEQ ID NO: 13203 - protein, 15 aa, Homo sapiens
MKEEVPTALVEAHVR

SEQ ID NO: 13204 - protein, 10 aa, Homo sapiens
AKHLAAVEER

SEQ ID NO: 13205 - protein, 15 aa, Homo sapiens
MKEEVPTALVEAHVR

SEQ ID NO: 13206 - protein, 10 aa, Homo sapiens
AKHLAAVEER

SEQ ID NO: 13207 - protein, 10 aa, Homo sapiens
AKHLAAVEER

SEQ ID NO: 13208 - protein, 10 aa, Homo sapiens
AKHLAAVEER

SEQ ID NO: 13209 - protein, 15 aa, Homo sapiens
MKEEVPTALVEAHVR

SEQ ID NO: 13210 - protein, 10 aa, Homo sapiens
AKHLAAVEER

SEQ ID NO: 13211 - protein, 15 aa, Homo sapiens
MKEEVPTALVEAHVR

SEQ ID NO: 13212 - protein, 10 aa, Homo sapiens
AKHLAAVEER

SEQ ID NO: 13213 - protein, 10 aa, Homo sapiens
AKHLAAVEER

SEQ ID NO: 13214 - protein, 15 aa, Homo sapiens
MKEEVPTALVEAHVR

SEQ ID NO: 13215 - protein, 15 aa, Homo sapiens
MKEEVPTALVEAHVR

SEQ ID NO: 13216 - protein, 11 aa, Homo sapiens
AKHLAAVEERK

SEQ ID NO: 13217 - protein, 11 aa, Homo sapiens
KVEEAAKVTGK

SEQ ID NO: 13218 - protein, 6 aa, Homo sapiens
KTKVER

SEQ ID NO: 13219 - protein, 6 aa, Homo sapiens
KTKVER

SEQ ID NO: 13220 - protein, 15 aa, Homo sapiens
MKEEVPTALVEAHVR

SEQ ID NO: 13221 - protein, 6 aa, Homo sapiens
KTKVER

SEQ ID NO: 13222 - protein, 6 aa, Homo sapiens
KTKVER

SEQ ID NO: 13223 - protein, 6 aa, Homo sapiens
KTKVER

SEQ ID NO: 13224 - protein, 6 aa, Homo sapiens
KTKVER

SEQ ID NO: 13225 - protein, 6 aa, Homo sapiens
KTKVER

SEQ ID NO: 13226 - protein, 15 aa, Homo sapiens
KIKSLVALLVETQMK

SEQ ID NO: 13227 - protein, 15 aa, Homo sapiens
KIKSLVALLVETQMK

SEQ ID NO: 13228 - protein, 15 aa, Homo sapiens
KIKSLVALLVETQMK

SEQ ID NO: 13229 - protein, 15 aa, Homo sapiens
KIKSLVALLVETQMK

SEQ ID NO: 13230 - protein, 15 aa, Homo sapiens
MKEEVPTALVEAHVR

SEQ ID NO: 13231 - protein, 15 aa, Homo sapiens
MKEEVPTALVEAHVR

SEQ ID NO: 13232 - protein, 7 aa, Homo sapiens
KVEEAAK

SEQ ID NO: 13233 - protein, 7 aa, Homo sapiens
KVEEAAK

SEQ ID NO: 13234 - protein, 7 aa, Homo sapiens
KVEEAAK

SEQ ID NO: 13235 - protein, 7 aa, Homo sapiens
KVEEAAK

SEQ ID NO: 13236 - protein, 15 aa, Homo sapiens
MKEEVPTALVEAHVR

SEQ ID NO: 13237 - protein, 7 aa, Homo sapiens
KVEEAAK

SEQ ID NO: 13238 - protein, 7 aa, Homo sapiens
KVEEAAK

SEQ ID NO: 13239 - protein, 15 aa, Homo sapiens
MKEEVPTALVEAHVR

SEQ ID NO: 13240 - protein, 15 aa, Homo sapiens
MKEEVPTALVEAHVR

SEQ ID NO: 13241 - protein, 7 aa, Homo sapiens
KVEEAAK

SEQ ID NO: 13242 - protein, 7 aa, Homo sapiens
KVEEAAK

SEQ ID NO: 13243 - protein, 7 aa, Homo sapiens
KVEEAAK

SEQ ID NO: 13244 - protein, 15 aa, Homo sapiens
MKEEVPTALVEAHVR

SEQ ID NO: 13245 - protein, 7 aa, Homo sapiens
KVEEAAK

SEQ ID NO: 13246 - protein, 10 aa, Homo sapiens
LPIKCFLDFK

SEQ ID NO: 13247 - protein, 10 aa, Homo sapiens
LPIKCFLDFK

SEQ ID NO: 13248 - protein, 10 aa, Homo sapiens
LPIKCFLDFK

SEQ ID NO: 13249 - protein, 10 aa, Homo sapiens
LPIKCFLDFK

SEQ ID NO: 13250 - protein, 10 aa, Homo sapiens
LPIKCFLDFK

SEQ ID NO: 13251 - protein, 10 aa, Homo sapiens
LPIKCFLDFK

SEQ ID NO: 13252 - protein, 10 aa, Homo sapiens
LPIKCFLDFK

SEQ ID NO: 13253 - protein, 7 aa, Homo sapiens
KVEEAAK

SEQ ID NO: 13254 - protein, 6 aa, Homo sapiens
KTKVER

SEQ ID NO: 13255 - protein, 6 aa, Homo sapiens
KTKVER

SEQ ID NO: 13256 - protein, 6 aa, Homo sapiens
KTKVER

SEQ ID NO: 13257 - protein, 6 aa, Homo sapiens
KTKVER

SEQ ID NO: 13258 - protein, 6 aa, Homo sapiens
KTKVER

SEQ ID NO: 13259 - protein, 7 aa, Homo sapiens
KVEEAAK

SEQ ID NO: 13260 - protein, 7 aa, Homo sapiens
KVEEAAK

SEQ ID NO: 13261 - protein, 7 aa, Homo sapiens
KVEEAAK

SEQ ID NO: 13262 - protein, 7 aa, Homo sapiens
KVEEAAK

SEQ ID NO: 13263 - protein, 36 aa, Homo sapiens; identical to SEQ ID NO: 8480

SEQ ID NO: 13264 - protein, 7 aa, Homo sapiens
KVEEAAK

SEQ ID NO: 13265 - protein, 6 aa, Homo sapiens
KTKVER

SEQ ID NO: 13266 - protein, 6 aa, Homo sapiens
KTKVER

SEQ ID NO: 13267 - protein, 6 aa, Homo sapiens
KTKVER

SEQ ID NO: 13268 - protein, 6 aa, Homo sapiens
KTKVER

SEQ ID NO: 13269 - protein, 6 aa, Homo sapiens
KTKVER

SEQ ID NO: 13270 - protein, 16 aa, Homo sapiens
LLEDSALSKYDATKQK

SEQ ID NO: 13271 - protein, 16 aa, Homo sapiens
LLEDSALSKYDATKQK

SEQ ID NO: 13272 - protein, 16 aa, Homo sapiens
LLEDSALSKYDATKQK

SEQ ID NO: 13273 - protein, 16 aa, Homo sapiens
LLEDSALSKYDATKQK

SEQ ID NO: 13274 - protein, 8 aa, Homo sapiens
YDATKQKR

SEQ ID NO: 13275 - protein, 10 aa, Homo sapiens
THKLQDPHER

SEQ ID NO: 13276 - protein, 10 aa, Homo sapiens
THKLQDPHER

SEQ ID NO: 13277 - protein, 10 aa, Homo sapiens
THKLQDPHER

SEQ ID NO: 13278 - protein, 10 aa, Homo sapiens
THKLQDPHER

SEQ ID NO: 13279 - protein, 10 aa, Homo sapiens
THKLQDPHER

SEQ ID NO: 13280 - protein, 17 aa, Homo sapiens
EFVICDKYLQQIFESQR

SEQ ID NO: 13281 - protein, 10 aa, Homo sapiens
THKLQDPHER

SEQ ID NO: 13282 - protein, 10 aa, Homo sapiens
THKLQDPHER

SEQ ID NO: 13283 - protein, 10 aa, Homo sapiens
THKLQDPHER

SEQ ID NO: 13284 - protein, 9 aa, Homo sapiens
YFYSKVQQR

SEQ ID NO: 13285 - protein, 10 aa, Homo sapiens
KMADKILPQR

SEQ ID NO: 13286 - protein, 10 aa, Homo sapiens
KMADKILPQR

SEQ ID NO: 13287 - protein, 10 aa, Homo sapiens
KMADKILPQR

SEQ ID NO: 13288 - protein, 6 aa, Homo sapiens
NHNAKK

SEQ ID NO: 13289 - protein, 6 aa, Homo sapiens
NHNAKK

SEQ ID NO: 13290 - protein, 6 aa, Homo sapiens
NHNAKK

SEQ ID NO: 13291 - protein, 26 aa, Homo sapiens
LHALLMPPEPIIINHVISVDPNDQKK

SEQ ID NO: 13292 - protein, 26 aa, Homo sapiens
LHALLMPPEPIIINHVISVDPNDQKK

SEQ ID NO: 13293 - protein, 26 aa, Homo sapiens
LHALLMPPEPIIINHVISVDPNDQKK

SEQ ID NO: 13294 - protein, 21 aa, Homo sapiens
TATTQETDGFQVKRPGDVNVR

SEQ ID NO: 13295 - protein, 21 aa, Homo sapiens
TATTQETDGFQVKRPGDVNVR

SEQ ID NO: 13296 - protein, 21 aa, Homo sapiens
TATTQETDGFQVKRPGDVNVR

SEQ ID NO: 13297 - protein, 21 aa, Homo sapiens
TATTQETDGFQVKRPGDVNVR

SEQ ID NO: 13298 - protein, 21 aa, Homo sapiens
TATTQETDGFQVKRPGDVNVR

SEQ ID NO: 13299 - protein, 21 aa, Homo sapiens
TATTQETDGFQVKRPGDVNVR

SEQ ID NO: 13300 - protein, 21 aa, Homo sapiens
TATTQETDGFQVKRPGDVNVR

SEQ ID NO: 13301 - protein, 21 aa, Homo sapiens
TATTQETDGFQVKRPGDVNVR

SEQ ID NO: 13302 - protein, 27 aa, Homo sapiens
IFISNTFNPAKSDAEDGEGTVASWELR

SEQ ID NO: 13303 - protein, 21 aa, Homo sapiens
TATTQETDGFQVKRPGDVNVR

SEQ ID NO: 13304 - protein, 14 aa, Homo sapiens
TATTQETDGFQVKR

SEQ ID NO: 13305 - protein, 21 aa, Homo sapiens
TATTQETDGFQVKRPGDVNVR

SEQ ID NO: 13306 - protein, 27 aa, Homo sapiens
IFISNTFNPAKSDAEDGEGTVASWELR

SEQ ID NO: 13307 - protein, 27 aa, Homo sapiens
IFISNTFNPAKSDAEDGEGTVASWELR

SEQ ID NO: 13308 - protein, 21 aa, Homo sapiens
TATTQETDGFQVKRPGDVNVR

SEQ ID NO: 13309 - protein, 21 aa, Homo sapiens
TATTQETDGFQVKRPGDVNVR

SEQ ID NO: 13310 - protein, 21 aa, Homo sapiens
TATTQETDGFQVKRPGDVNVR

SEQ ID NO: 13311 - protein, 21 aa, Homo sapiens
TATTQETDGFQVKRPGDVNVR

SEQ ID NO: 13312 - protein, 21 aa, Homo sapiens
TATTQETDGFQVKRPGDVNVR

SEQ ID NO: 13313 - protein, 21 aa, Homo sapiens
TATTQETDGFQVKRPGDVNVR

SEQ ID NO: 13314 - protein, 31 aa, Homo sapiens; identical to SEQ ID NO: 8609

SEQ ID NO: 13315 - protein, 21 aa, Homo sapiens
TATTQETDGFQVKRPGDVNVR

SEQ ID NO: 13316 - protein, 21 aa, Homo sapiens
TATTQETDGFQVKRPGDVNVR

SEQ ID NO: 13317 - protein, 27 aa, Homo sapiens
IFISNTFNPAKSDAEDGEGTVASWELR

SEQ ID NO: 13318 - protein, 21 aa, Homo sapiens
TATTQETDGFQVKRPGDVNVR

SEQ ID NO: 13319 - protein, 31 aa, Homo sapiens; identical to SEQ ID NO: 8609

SEQ ID NO: 13320 - protein, 21 aa, Homo sapiens
TATTQETDGFQVKRPGDVNVR

SEQ ID NO: 13321 - protein, 21 aa, Homo sapiens
TATTQETDGFQVKRPGDVNVR

SEQ ID NO: 13322 - protein, 21 aa, Homo sapiens
TATTQETDGFQVKRPGDVNVR

SEQ ID NO: 13323 - protein, 31 aa, Homo sapiens; identical to SEQ ID NO: 8609

SEQ ID NO: 13324 - protein, 21 aa, Homo sapiens
TATTQETDGFQVKRPGDVNVR

SEQ ID NO: 13325 - protein, 31 aa, Homo sapiens; identical to SEQ ID NO: 8609

SEQ ID NO: 13326 - protein, 21 aa, Homo sapiens
TATTQETDGFQVKRPGDVNVR

SEQ ID NO: 13327 - protein, 21 aa, Homo sapiens
TATTQETDGFQVKRPGDVNVR

SEQ ID NO: 13328 - protein, 21 aa, Homo sapiens
TATTQETDGFQVKRPGDVNVR

SEQ ID NO: 13329 - protein, 21 aa, Homo sapiens
TATTQETDGFQVKRPGDVNVR

SEQ ID NO: 13330 - protein, 21 aa, Homo sapiens
TATTQETDGFQVKRPGDVNVR

SEQ ID NO: 13331 - protein, 21 aa, Homo sapiens
TATTQETDGFQVKRPGDVNVR

SEQ ID NO: 13332 - protein, 21 aa, Homo sapiens
TATTQETDGFQVKRPGDVNVR

SEQ ID NO: 13333 - protein, 21 aa, Homo sapiens
TATTQETDGFQVKRPGDVNVR

SEQ ID NO: 13334 - protein, 10 aa, Homo sapiens
KMADKILPQR

SEQ ID NO: 13335 - protein, 10 aa, Homo sapiens
KMADKILPQR

SEQ ID NO: 13336 - protein, 9 aa, Homo sapiens
MADKILPQR

SEQ ID NO: 13337 - protein, 10 aa, Homo sapiens
KMADKILPQR

SEQ ID NO: 13338 - protein, 10 aa, Homo sapiens
KMADKILPQR

SEQ ID NO: 13339 - protein, 7 aa, Homo sapiens
NHNAKKK

SEQ ID NO: 13340 - protein, 9 aa, Homo sapiens
MKFSEIPQR

SEQ ID NO: 13341 - protein, 12 aa, Homo sapiens
LDIQEALKRPIK

SEQ ID NO: 13342 - protein, 12 aa, Homo sapiens
LDIQEALKRPIK

SEQ ID NO: 13343 - protein, 9 aa, Homo sapiens
MADKILPQR

SEQ ID NO: 13344 - protein, 8 aa, Homo sapiens
KLDQTIMR

SEQ ID NO: 13345 - protein, 8 aa, Homo sapiens
KLDQTIMR

SEQ ID NO: 13346 - protein, 8 aa, Homo sapiens
KLDQTIMR

SEQ ID NO: 13347 - protein, 9 aa, Homo sapiens
YFYSKVQQR

SEQ ID NO: 13348 - protein, 19 aa, Homo sapiens
KRPAPQQIQQVQQQAVQNR

SEQ ID NO: 13349 - protein, 19 aa, Homo sapiens
KRPAPQQIQQVQQQAVQNR

SEQ ID NO: 13350 - protein, 10 aa, Homo sapiens
KMADKILPQR

SEQ ID NO: 13351 - protein, 10 aa, Homo sapiens
KMADKILPQR

SEQ ID NO: 13352 - protein, 9 aa, Homo sapiens
MKFSEIPQR

SEQ ID NO: 13353 - protein, 9 aa, Homo sapiens
MKFSEIPQR

SEQ ID NO: 13354 - protein, 31 aa, Homo sapiens; identical to SEQ ID NO: 1672

SEQ ID NO: 13355 - protein, 31 aa, Homo sapiens; identical to SEQ ID NO: 1672

SEQ ID NO: 13356 - protein, 31 aa, Homo sapiens; identical to SEQ ID NO: 1672

SEQ ID NO: 13357 - protein, 31 aa, Homo sapiens; identical to SEQ ID NO: 1672

SEQ ID NO: 13358 - protein, 31 aa, Homo sapiens; identical to SEQ ID NO: 1672

SEQ ID NO: 13359 - protein, 9 aa, Homo sapiens
KGQASLYGK

SEQ ID NO: 13360 - protein, 5 aa, Homo sapiens
KKSGK

SEQ ID NO: 13361 - protein, 8 aa, Homo sapiens
SKGASAGR

SEQ ID NO: 13362 - protein, 8 aa, Homo sapiens
SKGASAGR

SEQ ID NO: 13363 - protein, 8 aa, Homo sapiens
SKGASAGR

SEQ ID NO: 13364 - protein, 8 aa, Homo sapiens
SKGASAGR

SEQ ID NO: 13365 - protein, 11 aa, Homo sapiens
TDIYSKKTLAK

SEQ ID NO: 13366 - protein, 8 aa, Homo sapiens
SKGASAGR

SEQ ID NO: 13367 - protein, 7 aa, Homo sapiens
KVQEAAR

SEQ ID NO: 13368 - protein, 12 aa, Homo sapiens
TLAKSKGASAGR

SEQ ID NO: 13369 - protein, 12 aa, Homo sapiens
TLAKSKGASAGR

SEQ ID NO: 13370 - protein, 12 aa, Homo sapiens
TLAKSKGASAGR

SEQ ID NO: 13371 - protein, 12 aa, Homo sapiens
TLAKSKGASAGR

SEQ ID NO: 13372 - protein, 6 aa, Homo sapiens
TLAKSK

SEQ ID NO: 13373 - protein, 6 aa, Homo sapiens
TLAKSK

SEQ ID NO: 13374 - protein, 7 aa, Homo sapiens
TDIYSKK

SEQ ID NO: 13375 - protein, 7 aa, Homo sapiens
TDIYSKK

SEQ ID NO: 13376 - protein, 9 aa, Homo sapiens
KDSENTPVK

SEQ ID NO: 13377 - protein, 26 aa, Homo sapiens
TLVQNNCLTRPNIYLIPDIDLKLANK

SEQ ID NO: 13378 - protein, 16 aa, Homo sapiens
AGGALCHILGAAYKYK

SEQ ID NO: 13379 - protein, 16 aa, Homo sapiens
AGGALCHILGAAYKYK

SEQ ID NO: 13380 - protein, 32 aa, Homo sapiens; identical to SEQ ID NO: 8682

SEQ ID NO: 13381 - protein, 10 aa, Homo sapiens
LPAKCFMDFK

SEQ ID NO: 13382 - protein, 15 aa, Homo sapiens
KHSPSPPPPTPTESR

SEQ ID NO: 13383 - protein, 15 aa, Homo sapiens
KHSPSPPPPTPTESR

SEQ ID NO: 13384 - protein, 15 aa, Homo sapiens
KHSPSPPPPTPTESR

SEQ ID NO: 13385 - protein, 7 aa, Homo sapiens
KASANAR

SEQ ID NO: 13386 - protein, 7 aa, Homo sapiens
KASANAR

SEQ ID NO: 13387 - protein, 7 aa, Homo sapiens
KASANAR

SEQ ID NO: 13388 - protein, 6 aa, Homo sapiens
KPVSFR

SEQ ID NO: 13389 - protein, 14 aa, Homo sapiens
ISTKNEEPVRSPER

SEQ ID NO: 13390 - protein, 8 aa, Homo sapiens
SKGASAGR

SEQ ID NO: 13391 - protein, 9 aa, Homo sapiens
GQASLYGKR

SEQ ID NO: 13392 - protein, 6 aa, Homo sapiens
NVNLKK

SEQ ID NO: 13393 - protein, 11 aa, Homo sapiens
HQGTFTDEKSK

SEQ ID NO: 13394 - protein, 9 aa, Homo sapiens
KDSENTPVK

SEQ ID NO: 13395 - protein, 11 aa, Homo sapiens
HQGTFTDEKSK

SEQ ID NO: 13396 - protein, 37 aa, Homo sapiens; identical to SEQ ID NO: 8699

SEQ ID NO: 13397 - protein, 11 aa, Homo sapiens
HQGTFTDEKSK

SEQ ID NO: 13398 - protein, 9 aa, Homo sapiens
DRKASANAR

SEQ ID NO: 13399 - protein, 7 aa, Homo sapiens
KASANAR

SEQ ID NO: 13400 - protein, 7 aa, Homo sapiens
KASANAR

SEQ ID NO: 13401 - protein, 9 aa, Homo sapiens
DRKASANAR

SEQ ID NO: 13402 - protein, 7 aa, Homo sapiens
KASANAR

SEQ ID NO: 13403 - protein, 7 aa, Homo sapiens
KASANAR

SEQ ID NO: 13404 - protein, 7 aa, Homo sapiens
KASANAR

SEQ ID NO: 13405 - protein, 9 aa, Homo sapiens
DRKASANAR

SEQ ID NO: 13406 - protein, 9 aa, Homo sapiens
DRKASANAR

SEQ ID NO: 13407 - protein, 11 aa, Homo sapiens
HQGTFTDEKSK

SEQ ID NO: 13408 - protein, 11 aa, Homo sapiens
HQGTFTDEKSK

SEQ ID NO: 13409 - protein, 7 aa, Homo sapiens
KVQEAAR

SEQ ID NO: 13410 - protein, 7 aa, Homo sapiens
KVQEAAR

SEQ ID NO: 13411 - protein, 11 aa, Homo sapiens
HQGTFTDEKSK

SEQ ID NO: 13412 - protein, 11 aa, Homo sapiens
HQGTFTDEKSK

SEQ ID NO: 13413 - protein, 25 aa, Homo sapiens
SKASHHIYPYSSSQDDEEWLRPVMR

SEQ ID NO: 13414 - protein, 5 aa, Homo sapiens
KKSGK

SEQ ID NO: 13415 - protein, 5 aa, Homo sapiens
KKSGK

SEQ ID NO: 13416 - protein, 5 aa, Homo sapiens
KKSGK

SEQ ID NO: 13417 - protein, 5 aa, Homo sapiens
KKSGK

SEQ ID NO: 13418 - protein, 16 aa, Homo sapiens
VREEVPLELVEAHVKK

SEQ ID NO: 13419 - protein, 16 aa, Homo sapiens
VREEVPLELVEAHVKK

SEQ ID NO: 13420 - protein, 16 aa, Homo sapiens
VREEVPLELVEAHVKK

SEQ ID NO: 13421 - protein, 25 aa, Homo sapiens
KVEHEISEGNVATAAAAALASAATK

SEQ ID NO: 13422 - protein, 25 aa, Homo sapiens
KVEHEISEGNVATAAAAALASAATK

SEQ ID NO: 13423 - protein, 7 aa, Homo sapiens
KASANAR

SEQ ID NO: 13424 - protein, 7 aa, Homo sapiens
KASANAR

SEQ ID NO: 13425 - protein, 7 aa, Homo sapiens
KASANAR

SEQ ID NO: 13426 - protein, 7 aa, Homo sapiens
KASANAR

SEQ ID NO: 13427 - protein, 7 aa, Homo sapiens
KASANAR

SEQ ID NO: 13428 - protein, 9 aa, Homo sapiens
DRKASANAR

SEQ ID NO: 13429 - protein, 7 aa, Homo sapiens
KASANAR

SEQ ID NO: 13430 - protein, 10 aa, Homo sapiens
ISTKNEEPVR

SEQ ID NO: 13431 - protein, 7 aa, Homo sapiens
KASANAR

SEQ ID NO: 13432 - protein, 9 aa, Homo sapiens
DRKASANAR

SEQ ID NO: 13433 - protein, 14 aa, Homo sapiens
ISTKNEEPVRSPER

SEQ ID NO: 13434 - protein, 14 aa, Homo sapiens
ISTKNEEPVRSPER

SEQ ID NO: 13435 - protein, 9 aa, Homo sapiens
DRKASANAR

SEQ ID NO: 13436 - protein, 14 aa, Homo sapiens
ISTKNEEPVRSPER

SEQ ID NO: 13437 - protein, 7 aa, Homo sapiens
KASANAR

SEQ ID NO: 13438 - protein, 9 aa, Homo sapiens
DRKASANAR

SEQ ID NO: 13439 - protein, 7 aa, Homo sapiens
KASANAR

SEQ ID NO: 13440 - protein, 9 aa, Homo sapiens
DRKASANAR

SEQ ID NO: 13441 - protein, 9 aa, Homo sapiens
DRKASANAR

SEQ ID NO: 13442 - protein, 9 aa, Homo sapiens
DRKASANAR

SEQ ID NO: 13443 - protein, 9 aa, Homo sapiens
DRKASANAR

SEQ ID NO: 13444 - protein, 10 aa, Homo sapiens
ISTKNEEPVR

SEQ ID NO: 13445 - protein, 8 aa, Homo sapiens
KDGGPATK

SEQ ID NO: 13446 - protein, 8 aa, Homo sapiens
KDGGPATK

SEQ ID NO: 13447 - protein, 9 aa, Homo sapiens
RKDGGPATK

SEQ ID NO: 13448 - protein, 18 aa, Homo sapiens
SPQVPAAQQMLNFPEKNK

SEQ ID NO: 13449 - protein, 18 aa, Homo sapiens
SPQVPAAQQMLNFPEKNK

SEQ ID NO: 13450 - protein, 12 aa, Homo sapiens
EKPVDLQNFGLR

SEQ ID NO: 13451 - protein, 18 aa, Homo sapiens
SPQVPAAQQMLNFPEKNK

SEQ ID NO: 13452 - protein, 18 aa, Homo sapiens
SPQVPAAQQMLNFPEKNK

SEQ ID NO: 13453 - protein, 18 aa, Homo sapiens
SPQVPAAQQMLNFPEKNK

SEQ ID NO: 13454 - protein, 18 aa, Homo sapiens
SPQVPAAQQMLNFPEKNK

SEQ ID NO: 13455 - protein, 18 aa, Homo sapiens
SPQVPAAQQMLNFPEKNK

SEQ ID NO: 13456 - protein, 18 aa, Homo sapiens
SPQVPAAQQMLNFPEKNK

SEQ ID NO: 13457 - protein, 18 aa, Homo sapiens
SPQVPAAQQMLNFPEKNK

SEQ ID NO: 13458 - protein, 12 aa, Homo sapiens
EKPVDLQNFGLR

SEQ ID NO: 13459 - protein, 12 aa, Homo sapiens
EKPVDLQNFGLR

SEQ ID NO: 13460 - protein, 12 aa, Homo sapiens
EKPVDLQNFGLR

SEQ ID NO: 13461 - protein, 12 aa, Homo sapiens
EKPVDLQNFGLR

SEQ ID NO: 13462 - protein, 12 aa, Homo sapiens
EKPVDLQNFGLR

SEQ ID NO: 13463 - protein, 12 aa, Homo sapiens
EKPVDLQNFGLR

SEQ ID NO: 13464 - protein, 20 aa, Homo sapiens
SPQVPAAQQMLNFPEKNKEK

SEQ ID NO: 13465 - protein, 12 aa, Homo sapiens
EKPVDLQNFGLR

SEQ ID NO: 13466 - protein, 7 aa, Homo sapiens
KVQEAAR

SEQ ID NO: 13467 - protein, 15 aa, Homo sapiens
VASAAAKAALEEFSR

SEQ ID NO: 13468 - protein, 12 aa, Homo sapiens
EKPVDLQNFGLR

SEQ ID NO: 13469 - protein, 14 aa, Homo sapiens
NKEKPVDLQNFGLR

SEQ ID NO: 13470 - protein, 11 aa, Homo sapiens
TDIYSKKTLAK

SEQ ID NO: 13471 - protein, 11 aa, Homo sapiens
TDIYSKKTLAK

SEQ ID NO: 13472 - protein, 11 aa, Homo sapiens
TDIYSKKTLAK

SEQ ID NO: 13473 - protein, 11 aa, Homo sapiens
TDIYSKKTLAK

SEQ ID NO: 13474 - protein, 7 aa, Homo sapiens
ESDTGKK

SEQ ID NO: 13475 - protein, 9 aa, Homo sapiens
ERESDTGKK

SEQ ID NO: 13476 - protein, 9 aa, Homo sapiens
ERESDTGKK

SEQ ID NO: 13477 - protein, 9 aa, Homo sapiens
ERESDTGKK

SEQ ID NO: 13478 - protein, 7 aa, Homo sapiens
ESDTGKK

SEQ ID NO: 13479 - protein, 9 aa, Homo sapiens
ERESDTGKK

SEQ ID NO: 13480 - protein, 9 aa, Homo sapiens
ERESDTGKK

SEQ ID NO: 13481 - protein, 15 aa, Homo sapiens
VASAAAKAALEEFSR

SEQ ID NO: 13482 - protein, 15 aa, Homo sapiens
VASAAAKAALEEFSR

SEQ ID NO: 13483 - protein, 15 aa, Homo sapiens
VASAAAKAALEEFSR

SEQ ID NO: 13484 - protein, 20 aa, Homo sapiens
EEVPLELVEAHVKKVQEAAR

SEQ ID NO: 13485 - protein, 20 aa, Homo sapiens
EEVPLELVEAHVKKVQEAAR

SEQ ID NO: 13486 - protein, 20 aa, Homo sapiens
EEVPLELVEAHVKKVQEAAR

SEQ ID NO: 13487 - protein, 20 aa, Homo sapiens
EEVPLELVEAHVKKVQEAAR

SEQ ID NO: 13488 - protein, 20 aa, Homo sapiens
EEVPLELVEAHVKKVQEAAR

SEQ ID NO: 13489 - protein, 20 aa, Homo sapiens
EEVPLELVEAHVKKVQEAAR

SEQ ID NO: 13490 - protein, 20 aa, Homo sapiens
EEVPLELVEAHVKKVQEAAR

SEQ ID NO: 13491 - protein, 20 aa, Homo sapiens
EEVPLELVEAHVKKVQEAAR

SEQ ID NO: 13492 - protein, 20 aa, Homo sapiens
EEVPLELVEAHVKKVQEAAR

SEQ ID NO: 13493 - protein, 20 aa, Homo sapiens
EEVPLELVEAHVKKVQEAAR

SEQ ID NO: 13494 - protein, 20 aa, Homo sapiens
EEVPLELVEAHVKKVQEAAR

SEQ ID NO: 13495 - protein, 15 aa, Homo sapiens
VASAAAKAALEEFSR

SEQ ID NO: 13496 - protein, 15 aa, Homo sapiens
VASAAAKAALEEFSR

SEQ ID NO: 13497 - protein, 9 aa, Homo sapiens
ERESDTGKK

SEQ ID NO: 13498 - protein, 9 aa, Homo sapiens
ERESDTGKK

SEQ ID NO: 13499 - protein, 15 aa, Homo sapiens
VASAAAKAALEEFSR

SEQ ID NO: 13500 - protein, 15 aa, Homo sapiens
VASAAAKAALEEFSR

SEQ ID NO: 13501 - protein, 15 aa, Homo sapiens
VASAAAKAALEEFSR

SEQ ID NO: 13502 - protein, 15 aa, Homo sapiens
VASAAAKAALEEFSR

SEQ ID NO: 13503 - protein, 15 aa, Homo sapiens
VASAAAKAALEEFSR

SEQ ID NO: 13504 - protein, 15 aa, Homo sapiens
VASAAAKAALEEFSR

SEQ ID NO: 13505 - protein, 15 aa, Homo sapiens
VASAAAKAALEEFSR

SEQ ID NO: 13506 - protein, 15 aa, Homo sapiens
VASAAAKAALEEFSR

SEQ ID NO: 13507 - protein, 15 aa, Homo sapiens
VASAAAKAALEEFSR

SEQ ID NO: 13508 - protein, 15 aa, Homo sapiens
VASAAAKAALEEFSR

SEQ ID NO: 13509 - protein, 15 aa, Homo sapiens
VASAAAKAALEEFSR

SEQ ID NO: 13510 - protein, 15 aa, Homo sapiens
VASAAAKAALEEFSR

SEQ ID NO: 13511 - protein, 15 aa, Homo sapiens
VASAAAKAALEEFSR

SEQ ID NO: 13512 - protein, 15 aa, Homo sapiens
VASAAAKAALEEFSR

SEQ ID NO: 13513 - protein, 15 aa, Homo sapiens
VASAAAKAALEEFSR

SEQ ID NO: 13514 - protein, 15 aa, Homo sapiens
VASAAAKAALEEFSR

SEQ ID NO: 13515 - protein, 15 aa, Homo sapiens
VASAAAKAALEEFSR

SEQ ID NO: 13516 - protein, 15 aa, Homo sapiens
VASAAAKAALEEFSR

SEQ ID NO: 13517 - protein, 15 aa, Homo sapiens
VASAAAKAALEEFSR

SEQ ID NO: 13518 - protein, 15 aa, Homo sapiens
VASAAAKAALEEFSR

SEQ ID NO: 13519 - protein, 25 aa, Homo sapiens
KVEHEISEGNVATAAAAALASAATK

SEQ ID NO: 13520 - protein, 15 aa, Homo sapiens
VASAAAKAALEEFSR

SEQ ID NO: 13521 - protein, 15 aa, Homo sapiens
VASAAAKAALEEFSR

SEQ ID NO: 13522 - protein, 15 aa, Homo sapiens
VASAAAKAALEEFSR

SEQ ID NO: 13523 - protein, 15 aa, Homo sapiens
VASAAAKAALEEFSR

SEQ ID NO: 13524 - protein, 15 aa, Homo sapiens
VASAAAKAALEEFSR

SEQ ID NO: 13525 - protein, 15 aa, Homo sapiens
VASAAAKAALEEFSR

SEQ ID NO: 13526 - protein, 15 aa, Homo sapiens
VASAAAKAALEEFSR

SEQ ID NO: 13527 - protein, 25 aa, Homo sapiens
KVEHEISEGNVATAAAAALASAATK

SEQ ID NO: 13528 - protein, 15 aa, Homo sapiens
VASAAAKAALEEFSR

SEQ ID NO: 13529 - protein, 25 aa, Homo sapiens
KVEHEISEGNVATAAAAALASAATK

SEQ ID NO: 13530 - protein, 15 aa, Homo sapiens
VASAAAKAALEEFSR

SEQ ID NO: 13531 - protein, 15 aa, Homo sapiens
VASAAAKAALEEFSR

SEQ ID NO: 13532 - protein, 7 aa, Homo sapiens
KVQEAAR

SEQ ID NO: 13533 - protein, 7 aa, Homo sapiens
KVQEAAR

SEQ ID NO: 13534 - protein, 7 aa, Homo sapiens
KVQEAAR

SEQ ID NO: 13535 - protein, 7 aa, Homo sapiens
KVQEAAR

SEQ ID NO: 13536 - protein, 26 aa, Homo sapiens
KKVEHEISEGNVATAAAAALASAATK

SEQ ID NO: 13537 - protein, 26 aa, Homo sapiens
KKVEHEISEGNVATAAAAALASAATK

SEQ ID NO: 13538 - protein, 26 aa, Homo sapiens
KKVEHEISEGNVATAAAAALASAATK

SEQ ID NO: 13539 - protein, 15 aa, Homo sapiens
VASAAAKAALEEFSR

SEQ ID NO: 13540 - protein, 15 aa, Homo sapiens
VASAAAKAALEEFSR

SEQ ID NO: 13541 - protein, 26 aa, Homo sapiens
KKVEHEISEGNVATAAAAALASAATK

SEQ ID NO: 13542 - protein, 15 aa, Homo sapiens
VASAAAKAALEEFSR

SEQ ID NO: 13543 - protein, 26 aa, Homo sapiens
KKVEHEISEGNVATAAAAALASAATK

SEQ ID NO: 13544 - protein, 8 aa, Homo sapiens
ESDTGKKK

SEQ ID NO: 13545 - protein, 8 aa, Homo sapiens
ESDTGKKK

SEQ ID NO: 13546 - protein, 7 aa, Homo sapiens
KASANAR

SEQ ID NO: 13547 - protein, 16 aa, Homo sapiens
VREEVPLELVEAHVKK

SEQ ID NO: 13548 - protein, 39 aa, Homo sapiens; identical to SEQ ID NO: 8701

SEQ ID NO: 13549 - protein, 39 aa, Homo sapiens; identical to SEQ ID NO: 8701

SEQ ID NO: 13550 - protein, 7 aa, Homo sapiens
KASANAR

SEQ ID NO: 13551 - protein, 26 aa, Homo sapiens
KKVEHEISEGNVATAAAAALASAATK

SEQ ID NO: 13552 - protein, 9 aa, Homo sapiens
RKDGGPATK

SEQ ID NO: 13553 - protein, 7 aa, Homo sapiens
KVQEAAR

SEQ ID NO: 13554 - protein, 7 aa, Homo sapiens
KVQEAAR

SEQ ID NO: 13555 - protein, 7 aa, Homo sapiens
KVQEAAR

SEQ ID NO: 13556 - protein, 7 aa, Homo sapiens
KVQEAAR

SEQ ID NO: 13557 - protein, 7 aa, Homo sapiens
KVQEAAR

SEQ ID NO: 13558 - protein, 7 aa, Homo sapiens
KVQEAAR

SEQ ID NO: 13559 - protein, 7 aa, Homo sapiens
KVQEAAR

SEQ ID NO: 13560 - protein, 7 aa, Homo sapiens
KVQEAAR

SEQ ID NO: 13561 - protein, 7 aa, Homo sapiens
KVQEAAR

SEQ ID NO: 13562 - protein, 7 aa, Homo sapiens
KVQEAAR

SEQ ID NO: 13563 - protein, 7 aa, Homo sapiens
KVQEAAR

SEQ ID NO: 13564 - protein, 6 aa, Homo sapiens
LANKLK

SEQ ID NO: 13565 - protein, 9 aa, Homo sapiens
KDSENTPVK

SEQ ID NO: 13566 - protein, 10 aa, Homo sapiens
KGQASLYGKR

SEQ ID NO: 13567 - protein, 9 aa, Homo sapiens
KGQASLYGK

SEQ ID NO: 13568 - protein, 9 aa, Homo sapiens
KGQASLYGK

SEQ ID NO: 13569 - protein, 10 aa, Homo sapiens
KGQASLYGKR

SEQ ID NO: 13570 - protein, 7 aa, Homo sapiens
KASANAR

SEQ ID NO: 13571 - protein, 7 aa, Homo sapiens
KASANAR

SEQ ID NO: 13572 - protein, 9 aa, Homo sapiens
GQASLYGKR

SEQ ID NO: 13573 - protein, 23 aa, Homo sapiens
KDGGPATKFWESPETVSQLDSVR

SEQ ID NO: 13574 - protein, 23 aa, Homo sapiens
KDGGPATKFWESPETVSQLDSVR

SEQ ID NO: 13575 - protein, 23 aa, Homo sapiens
KDGGPATKFWESPETVSQLDSVR

SEQ ID NO: 13576 - protein, 7 aa, Homo sapiens
KASANAR

SEQ ID NO: 13577 - protein, 23 aa, Homo sapiens
KDGGPATKFWESPETVSQLDSVR

SEQ ID NO: 13578 - protein, 23 aa, Homo sapiens
KDGGPATKFWESPETVSQLDSVR

SEQ ID NO: 13579 - protein, 23 aa, Homo sapiens
KDGGPATKFWESPETVSQLDSVR

SEQ ID NO: 13580 - protein, 7 aa, Homo sapiens
KASANAR

SEQ ID NO: 13581 - protein, 7 aa, Homo sapiens
KASANAR

SEQ ID NO: 13582 - protein, 7 aa, Homo sapiens
KASANAR

SEQ ID NO: 13583 - protein, 7 aa, Homo sapiens
KASANAR

SEQ ID NO: 13584 - protein, 7 aa, Homo sapiens
KASANAR

SEQ ID NO: 13585 - protein, 7 aa, Homo sapiens
KASANAR

SEQ ID NO: 13586 - protein, 7 aa, Homo sapiens
KASANAR

SEQ ID NO: 13587 - protein, 32 aa, Homo sapiens; identical to SEQ ID NO: 8890

SEQ ID NO: 13588 - protein, 7 aa, Homo sapiens
KASANAR

SEQ ID NO: 13589 - protein, 7 aa, Homo sapiens
KASANAR

SEQ ID NO: 13590 - protein, 7 aa, Homo sapiens
KASANAR

SEQ ID NO: 13591 - protein, 9 aa, Homo sapiens
DRKASANAR

SEQ ID NO: 13592 - protein, 9 aa, Homo sapiens
DRKASANAR

SEQ ID NO: 13593 - protein, 23 aa, Homo sapiens
KDGGPATKFWESPETVSQLDSVR

SEQ ID NO: 13594 - protein, 9 aa, Homo sapiens
RKDGGPATK

SEQ ID NO: 13595 - protein, 7 aa, Homo sapiens
KASANAR

SEQ ID NO: 13596 - protein, 7 aa, Homo sapiens
KASANAR

SEQ ID NO: 13597 - protein, 7 aa, Homo sapiens
KASANAR

SEQ ID NO: 13598 - protein, 7 aa, Homo sapiens
KASANAR

SEQ ID NO: 13599 - protein, 7 aa, Homo sapiens
KASANAR

SEQ ID NO: 13600 - protein, 7 aa, Homo sapiens
KASANAR

SEQ ID NO: 13601 - protein, 7 aa, Homo sapiens
KASANAR

SEQ ID NO: 13602 - protein, 16 aa, Homo sapiens
GKQGGPTYYIDTNALR

SEQ ID NO: 13603 - protein, 20 aa, Homo sapiens
EKLTELMFEHYNIPAFFLCK

SEQ ID NO: 13604 - protein, 20 aa, Homo sapiens
EKLTELMFEHYNIPAFFLCK

SEQ ID NO: 13605 - protein, 16 aa, Homo sapiens
GKQGGPTYYIDTNALR

SEQ ID NO: 13606 - protein, 20 aa, Homo sapiens
EKLTELMFEHYNIPAFFLCK

SEQ ID NO: 13607 - protein, 20 aa, Homo sapiens
EKLTELMFEHYNIPAFFLCK

SEQ ID NO: 13608 - protein, 20 aa, Homo sapiens
EKLTELMFEHYNIPAFFLCK

SEQ ID NO: 13609 - protein, 20 aa, Homo sapiens
EKLTELMFEHYNIPAFFLCK

SEQ ID NO: 13610 - protein, 20 aa, Homo sapiens
EKLTELMFEHYNIPAFFLCK

SEQ ID NO: 13611 - protein, 13 aa, Homo sapiens
QEYEEGGKQCVER

SEQ ID NO: 13612 - protein, 20 aa, Homo sapiens
EKLTELMFEHYNIPAFFLCK

SEQ ID NO: 13613 - protein, 20 aa, Homo sapiens
EKLTELMFEHYNIPAFFLCK

SEQ ID NO: 13614 - protein, 20 aa, Homo sapiens
EKLTELMFEHYNIPAFFLCK

SEQ ID NO: 13615 - protein, 14 aa, Homo sapiens
QEYEEGGKQCVERK

SEQ ID NO: 13616 - protein, 20 aa, Homo sapiens
EKLTELMFEHYNIPAFFLCK

SEQ ID NO: 13617 - protein, 20 aa, Homo sapiens
EKLTELMFEHYNIPAFFLCK

SEQ ID NO: 13618 - protein, 13 aa, Homo sapiens
QEYEEGGKQCVER

SEQ ID NO: 13619 - protein, 20 aa, Homo sapiens
EKLTELMFEHYNIPAFFLCK

SEQ ID NO: 13620 - protein, 13 aa, Homo sapiens
QEYEEGGKQCVER

SEQ ID NO: 13621 - protein, 20 aa, Homo sapiens
EKLTELMFEHYNIPAFFLCK

SEQ ID NO: 13622 - protein, 13 aa, Homo sapiens
QEYEEGGKQCVER

SEQ ID NO: 13623 - protein, 20 aa, Homo sapiens
EKLTELMFEHYNIPAFFLCK

SEQ ID NO: 13624 - protein, 13 aa, Homo sapiens
QEYEEGGKQCVER

SEQ ID NO: 13625 - protein, 13 aa, Homo sapiens
QEYEEGGKQCVER

SEQ ID NO: 13626 - protein, 13 aa, Homo sapiens
QEYEEGGKQCVER

SEQ ID NO: 13627 - protein, 20 aa, Homo sapiens
EKLTELMFEHYNIPAFFLCK

SEQ ID NO: 13628 - protein, 21 aa, Homo sapiens
REKLTELMFEHYNIPAFFLCK

SEQ ID NO: 13629 - protein, 14 aa, Homo sapiens
QEYEEGGKQCVERK

SEQ ID NO: 13630 - protein, 20 aa, Homo sapiens
EKLTELMFEHYNIPAFFLCK

SEQ ID NO: 13631 - protein, 13 aa, Homo sapiens
QEYEEGGKQCVER

SEQ ID NO: 13632 - protein, 13 aa, Homo sapiens
QEYEEGGKQCVER

SEQ ID NO: 13633 - protein, 20 aa, Homo sapiens
EKLTELMFEHYNIPAFFLCK

SEQ ID NO: 13634 - protein, 20 aa, Homo sapiens
EKLTELMFEHYNIPAFFLCK

SEQ ID NO: 13635 - protein, 20 aa, Homo sapiens
EKLTELMFEHYNIPAFFLCK

SEQ ID NO: 13636 - protein, 20 aa, Homo sapiens
EKLTELMFEHYNIPAFFLCK

SEQ ID NO: 13637 - protein, 13 aa, Homo sapiens
QEYEEGGKQCVER

SEQ ID NO: 13638 - protein, 21 aa, Homo sapiens
REKLTELMFEHYNIPAFFLCK

SEQ ID NO: 13639 - protein, 20 aa, Homo sapiens
EKLTELMFEHYNIPAFFLCK

SEQ ID NO: 13640 - protein, 20 aa, Homo sapiens
EKLTELMFEHYNIPAFFLCK

SEQ ID NO: 13641 - protein, 13 aa, Homo sapiens
QEYEEGGKQCVER

SEQ ID NO: 13642 - protein, 20 aa, Homo sapiens
EKLTELMFEHYNIPAFFLCK

SEQ ID NO: 13643 - protein, 13 aa, Homo sapiens
QEYEEGGKQCVER

SEQ ID NO: 13644 - protein, 20 aa, Homo sapiens
EKLTELMFEHYNIPAFFLCK

SEQ ID NO: 13645 - protein, 20 aa, Homo sapiens
EKLTELMFEHYNIPAFFLCK

SEQ ID NO: 13646 - protein, 20 aa, Homo sapiens
EKLTELMFEHYNIPAFFLCK

SEQ ID NO: 13647 - protein, 20 aa, Homo sapiens
EKLTELMFEHYNIPAFFLCK

SEQ ID NO: 13648 - protein, 15 aa, Homo sapiens
DDGSTLMEIDGDKGK

SEQ ID NO: 13649 - protein, 29 aa, Homo sapiens
DDGSTLMEIDGDKGKQGGPTYYIDTNALR

SEQ ID NO: 13650 - protein, 15 aa, Homo sapiens
DDGSTLMEIDGDKGK

SEQ ID NO: 13651 - protein, 20 aa, Homo sapiens
EKLTELMFEHYNIPAFFLCK

SEQ ID NO: 13652 - protein, 15 aa, Homo sapiens
DDGSTLMEIDGDKGK

SEQ ID NO: 13653 - protein, 15 aa, Homo sapiens
DDGSTLMEIDGDKGK

SEQ ID NO: 13654 - protein, 15 aa, Homo sapiens
DDGSTLMEIDGDKGK

SEQ ID NO: 13655 - protein, 29 aa, Homo sapiens
DDGSTLMEIDGDKGKQGGPTYYIDTNALR

SEQ ID NO: 13656 - protein, 20 aa, Homo sapiens
EKLTELMFEHYNIPAFFLCK

SEQ ID NO: 13657 - protein, 20 aa, Homo sapiens
EKLTELMFEHYNIPAFFLCK

SEQ ID NO: 13658 - protein, 15 aa, Homo sapiens
DDGSTLMEIDGDKGK

SEQ ID NO: 13659 - protein, 21 aa, Homo sapiens
REKLTELMFEHYNIPAFFLCK

SEQ ID NO: 13660 - protein, 21 aa, Homo sapiens
REKLTELMFEHYNIPAFFLCK

SEQ ID NO: 13661 - protein, 21 aa, Homo sapiens
REKLTELMFEHYNIPAFFLCK

SEQ ID NO: 13662 - protein, 21 aa, Homo sapiens
REKLTELMFEHYNIPAFFLCK

SEQ ID NO: 13663 - protein, 21 aa, Homo sapiens
REKLTELMFEHYNIPAFFLCK

SEQ ID NO: 13664 - protein, 21 aa, Homo sapiens
REKLTELMFEHYNIPAFFLCK

SEQ ID NO: 13665 - protein, 21 aa, Homo sapiens
REKLTELMFEHYNIPAFFLCK

SEQ ID NO: 13666 - protein, 21 aa, Homo sapiens
REKLTELMFEHYNIPAFFLCK

SEQ ID NO: 13667 - protein, 21 aa, Homo sapiens
REKLTELMFEHYNIPAFFLCK

SEQ ID NO: 13668 - protein, 21 aa, Homo sapiens
REKLTELMFEHYNIPAFFLCK

SEQ ID NO: 13669 - protein, 11 aa, Homo sapiens
ELSQKTPPSMR

SEQ ID NO: 13670 - protein, 11 aa, Homo sapiens
ELSQKTPPSMR

SEQ ID NO: 13671 - protein, 43 aa, Homo sapiens; identical to SEQ ID NO: 2316

SEQ ID NO: 13672 - protein, 29 aa, Homo sapiens
ENMEAISPLKNGMVEDWDSFQAILDHTYK

SEQ ID NO: 13673 - protein, 29 aa, Homo sapiens
ENMEAISPLKNGMVEDWDSFQAILDHTYK

SEQ ID NO: 13674 - protein, 43 aa, Homo sapiens; identical to SEQ ID NO: 2316

SEQ ID NO: 13675 - protein, 29 aa, Homo sapiens
ENMEAISPLKNGMVEDWDSFQAILDHTYK

SEQ ID NO: 13676 - protein, 29 aa, Homo sapiens
ENMEAISPLKNGMVEDWDSFQAILDHTYK

SEQ ID NO: 13677 - protein, 29 aa, Homo sapiens
ENMEAISPLKNGMVEDWDSFQAILDHTYK

SEQ ID NO: 13678 - protein, 29 aa, Homo sapiens
ENMEAISPLKNGMVEDWDSFQAILDHTYK

SEQ ID NO: 13679 - protein, 43 aa, Homo sapiens; identical to SEQ ID NO: 2316

SEQ ID NO: 13680 - protein, 43 aa, Homo sapiens; identical to SEQ ID NO: 2316

SEQ ID NO: 13681 - protein, 43 aa, Homo sapiens; identical to SEQ ID NO: 2316

SEQ ID NO: 13682 - protein, 43 aa, Homo sapiens; identical to SEQ ID NO: 2316

SEQ ID NO: 13683 - protein, 29 aa, Homo sapiens
ENMEAISPLKNGMVEDWDSFQAILDHTYK

SEQ ID NO: 13684 - protein, 43 aa, Homo sapiens; identical to SEQ ID NO: 2316

SEQ ID NO: 13685 - protein, 43 aa, Homo sapiens; identical to SEQ ID NO: 2316

SEQ ID NO: 13686 - protein, 43 aa, Homo sapiens; identical to SEQ ID NO: 2316

SEQ ID NO: 13687 - protein, 43 aa, Homo sapiens; identical to SEQ ID NO: 2316

SEQ ID NO: 13688 - protein, 43 aa, Homo sapiens; identical to SEQ ID NO: 2316

SEQ ID NO: 13689 - protein, 43 aa, Homo sapiens; identical to SEQ ID NO: 2316

SEQ ID NO: 13690 - protein, 43 aa, Homo sapiens; identical to SEQ ID NO: 2316

SEQ ID NO: 13691 - protein, 29 aa, Homo sapiens
ENMEAISPLKNGMVEDWDSFQAILDHTYK

SEQ ID NO: 13692 - protein, 29 aa, Homo sapiens
ENMEAISPLKNGMVEDWDSFQAILDHTYK

SEQ ID NO: 13693 - protein, 22 aa, Homo sapiens
MHVKSEASLHPVLMSEAPWNTR

SEQ ID NO: 13694 - protein, 22 aa, Homo sapiens
MHVKSEASLHPVLMSEAPWNTR

SEQ ID NO: 13695 - protein, 22 aa, Homo sapiens
MHVKSEASLHPVLMSEAPWNTR

SEQ ID NO: 13696 - protein, 22 aa, Homo sapiens
MHVKSEASLHPVLMSEAPWNTR

SEQ ID NO: 13697 - protein, 9 aa, Homo sapiens
KEKLPQVTR

SEQ ID NO: 13698 - protein, 9 aa, Homo sapiens
EGSPANWKR

SEQ ID NO: 13699 - protein, 9 aa, Homo sapiens
KEKLPQVTR

SEQ ID NO: 13700 - protein, 9 aa, Homo sapiens
EGSPANWKR

SEQ ID NO: 13701 - protein, 9 aa, Homo sapiens
KEKLPQVTR

SEQ ID NO: 13702 - protein, 9 aa, Homo sapiens
EGSPANWKR

SEQ ID NO: 13703 - protein, 9 aa, Homo sapiens
KEKLPQVTR

SEQ ID NO: 13704 - protein, 9 aa, Homo sapiens
KEKLPQVTR

SEQ ID NO: 13705 - protein, 9 aa, Homo sapiens
EGSPANWKR

SEQ ID NO: 13706 - protein, 9 aa, Homo sapiens
EGSPANWKR

SEQ ID NO: 13707 - protein, 9 aa, Homo sapiens
EGSPANWKR

SEQ ID NO: 13708 - protein, 9 aa, Homo sapiens
KEKLPQVTR

SEQ ID NO: 13709 - protein, 9 aa, Homo sapiens
KEKLPQVTR

SEQ ID NO: 13710 - protein, 9 aa, Homo sapiens
EGSPANWKR

SEQ ID NO: 13711 - protein, 9 aa, Homo sapiens
EGSPANWKR

SEQ ID NO: 13712 - protein, 9 aa, Homo sapiens
KEKLPQVTR

SEQ ID NO: 13713 - protein, 9 aa, Homo sapiens
KEKLPQVTR

SEQ ID NO: 13714 - protein, 9 aa, Homo sapiens
KEKLPQVTR

SEQ ID NO: 13715 - protein, 9 aa, Homo sapiens
EGSPANWKR

SEQ ID NO: 13716 - protein, 9 aa, Homo sapiens
KEKLPQVTR

SEQ ID NO: 13717 - protein, 9 aa, Homo sapiens
KEKLPQVTR

SEQ ID NO: 13718 - protein, 9 aa, Homo sapiens
KEKLPQVTR

SEQ ID NO: 13719 - protein, 9 aa, Homo sapiens
EGSPANWKR

SEQ ID NO: 13720 - protein, 9 aa, Homo sapiens
KEKLPQVTR

SEQ ID NO: 13721 - protein, 9 aa, Homo sapiens
KEKLPQVTR

SEQ ID NO: 13722 - protein, 9 aa, Homo sapiens
KEKLPQVTR

SEQ ID NO: 13723 - protein, 9 aa, Homo sapiens
KEKLPQVTR

SEQ ID NO: 13724 - protein, 9 aa, Homo sapiens
KEKLPQVTR

SEQ ID NO: 13725 - protein, 9 aa, Homo sapiens
KEKLPQVTR

SEQ ID NO: 13726 - protein, 9 aa, Homo sapiens
EGSPANWKR

SEQ ID NO: 13727 - protein, 9 aa, Homo sapiens
KEKLPQVTR

SEQ ID NO: 13728 - protein, 9 aa, Homo sapiens
EGSPANWKR

SEQ ID NO: 13729 - protein, 9 aa, Homo sapiens
KEKLPQVTR

SEQ ID NO: 13730 - protein, 9 aa, Homo sapiens
EGSPANWKR

SEQ ID NO: 13731 - protein, 9 aa, Homo sapiens
KEKLPQVTR

SEQ ID NO: 13732 - protein, 9 aa, Homo sapiens
KEKLPQVTR

SEQ ID NO: 13733 - protein, 9 aa, Homo sapiens
EGSPANWKR

SEQ ID NO: 13734 - protein, 9 aa, Homo sapiens
KEKLPQVTR

SEQ ID NO: 13735 - protein, 9 aa, Homo sapiens
KEKLPQVTR

SEQ ID NO: 13736 - protein, 9 aa, Homo sapiens
KEKLPQVTR

SEQ ID NO: 13737 - protein, 9 aa, Homo sapiens
KEKLPQVTR

SEQ ID NO: 13738 - protein, 9 aa, Homo sapiens
KEKLPQVTR

SEQ ID NO: 13739 - protein, 9 aa, Homo sapiens
KEKLPQVTR

SEQ ID NO: 13740 - protein, 9 aa, Homo sapiens
KEKLPQVTR

SEQ ID NO: 13741 - protein, 9 aa, Homo sapiens
KEKLPQVTR

SEQ ID NO: 13742 - protein, 8 aa, Homo sapiens
EKLPQVTR

SEQ ID NO: 13743 - protein, 9 aa, Homo sapiens
KEKLPQVTR

SEQ ID NO: 13744 - protein, 13 aa, Homo sapiens
EAVREGSPANWKR

SEQ ID NO: 13745 - protein, 9 aa, Homo sapiens
KEKLPQVTR

SEQ ID NO: 13746 - protein, 9 aa, Homo sapiens
KEKLPQVTR

SEQ ID NO: 13747 - protein, 13 aa, Homo sapiens
EAVREGSPANWKR

SEQ ID NO: 13748 - protein, 9 aa, Homo sapiens
KEKLPQVTR

SEQ ID NO: 13749 - protein, 9 aa, Homo sapiens
KEKLPQVTR

SEQ ID NO: 13750 - protein, 9 aa, Homo sapiens
EGSPANWKR

SEQ ID NO: 13751 - protein, 9 aa, Homo sapiens
KEKLPQVTR

SEQ ID NO: 13752 - protein, 9 aa, Homo sapiens
KEKLPQVTR

SEQ ID NO: 13753 - protein, 9 aa, Homo sapiens
EGSPANWKR

SEQ ID NO: 13754 - protein, 9 aa, Homo sapiens
EGSPANWKR

SEQ ID NO: 13755 - protein, 9 aa, Homo sapiens
KEKLPQVTR

SEQ ID NO: 13756 - protein, 9 aa, Homo sapiens
EGSPANWKR

SEQ ID NO: 13757 - protein, 9 aa, Homo sapiens
KEKLPQVTR

SEQ ID NO: 13758 - protein, 9 aa, Homo sapiens
KEKLPQVTR

SEQ ID NO: 13759 - protein, 9 aa, Homo sapiens
KEKLPQVTR

SEQ ID NO: 13760 - protein, 9 aa, Homo sapiens
KEKLPQVTR

SEQ ID NO: 13761 - protein, 9 aa, Homo sapiens
KEKLPQVTR

SEQ ID NO: 13762 - protein, 8 aa, Homo sapiens
EKLPQVTR

SEQ ID NO: 13763 - protein, 9 aa, Homo sapiens
KEKLPQVTR

SEQ ID NO: 13764 - protein, 8 aa, Homo sapiens
EKLPQVTR

SEQ ID NO: 13765 - protein, 9 aa, Homo sapiens
KEKLPQVTR

SEQ ID NO: 13766 - protein, 23 aa, Homo sapiens
AGYAGEDCPKVDFPTAIGMVVER

SEQ ID NO: 13767 - protein, 23 aa, Homo sapiens
AGYAGEDCPKVDFPTAIGMVVER

SEQ ID NO: 13768 - protein, 23 aa, Homo sapiens
AGYAGEDCPKVDFPTAIGMVVER

SEQ ID NO: 13769 - protein, 23 aa, Homo sapiens
AGYAGEDCPKVDFPTAIGMVVER

SEQ ID NO: 13770 - protein, 22 aa, Homo sapiens
MHVKSEASLHPVLMSEAPWNTR

SEQ ID NO: 13771 - protein, 22 aa, Homo sapiens
MHVKSEASLHPVLMSEAPWNTR

SEQ ID NO: 13772 - protein, 22 aa, Homo sapiens
MHVKSEASLHPVLMSEAPWNTR

SEQ ID NO: 13773 - protein, 23 aa, Homo sapiens
AGYAGEDCPKVDFPTAIGMVVER

SEQ ID NO: 13774 - protein, 22 aa, Homo sapiens
MHVKSEASLHPVLMSEAPWNTR

SEQ ID NO: 13775 - protein, 23 aa, Homo sapiens
AGYAGEDCPKVDFPTAIGMVVER

SEQ ID NO: 13776 - protein, 22 aa, Homo sapiens
MHVKSEASLHPVLMSEAPWNTR

SEQ ID NO: 13777 - protein, 23 aa, Homo sapiens
AGYAGEDCPKVDFPTAIGMVVER

SEQ ID NO: 13778 - protein, 22 aa, Homo sapiens
MHVKSEASLHPVLMSEAPWNTR

SEQ ID NO: 13779 - protein, 22 aa, Homo sapiens
MHVKSEASLHPVLMSEAPWNTR

SEQ ID NO: 13780 - protein, 22 aa, Homo sapiens
MHVKSEASLHPVLMSEAPWNTR

SEQ ID NO: 13781 - protein, 9 aa, Homo sapiens
KEKLPQVTR

SEQ ID NO: 13782 - protein, 16 aa, Homo sapiens
GKQGGPTYYIDTNALR

SEQ ID NO: 13783 - protein, 16 aa, Homo sapiens
GKQGGPTYYIDTNALR

SEQ ID NO: 13784 - protein, 16 aa, Homo sapiens
GKQGGPTYYIDTNALR

SEQ ID NO: 13785 - protein, 16 aa, Homo sapiens
GKQGGPTYYIDTNALR

SEQ ID NO: 13786 - protein, 29 aa, Homo sapiens
DDGSTLMEIDGDKGKQGGPTYYIDTNALR

SEQ ID NO: 13787 - protein, 16 aa, Homo sapiens
GKQGGPTYYIDTNALR

SEQ ID NO: 13788 - protein, 16 aa, Homo sapiens
GKQGGPTYYIDTNALR

SEQ ID NO: 13789 - protein, 9 aa, Homo sapiens
KEKLPQVTR

SEQ ID NO: 13790 - protein, 9 aa, Homo sapiens
KEKLPQVTR

SEQ ID NO: 13791 - protein, 9 aa, Homo sapiens
KEKLPQVTR

SEQ ID NO: 13792 - protein, 9 aa, Homo sapiens
KEKLPQVTR

SEQ ID NO: 13793 - protein, 9 aa, Homo sapiens
KEKLPQVTR

SEQ ID NO: 13794 - protein, 9 aa, Homo sapiens
KEKLPQVTR

SEQ ID NO: 13795 - protein, 9 aa, Homo sapiens
KEKLPQVTR

SEQ ID NO: 13796 - protein, 23 aa, Homo sapiens
ELFQEMNIELVPPYMIASKEAVR

SEQ ID NO: 13797 - protein, 9 aa, Homo sapiens
KEKLPQVTR

SEQ ID NO: 13798 - protein, 9 aa, Homo sapiens
KEKLPQVTR

SEQ ID NO: 13799 - protein, 9 aa, Homo sapiens
KEKLPQVTR

SEQ ID NO: 13800 - protein, 9 aa, Homo sapiens
SKSNSSAAR

SEQ ID NO: 13801 - protein, 9 aa, Homo sapiens
SKSNSSAAR

SEQ ID NO: 13802 - protein, 9 aa, Homo sapiens
SKSNSSAAR

SEQ ID NO: 13803 - protein, 9 aa, Homo sapiens
SKSNSSAAR

SEQ ID NO: 13804 - protein, 29 aa, Homo sapiens
TFGQKPVKFQLEDDGEFYMIGSEVGNYLR

SEQ ID NO: 13805 - protein, 6 aa, Homo sapiens
GSLYKR

SEQ ID NO: 13806 - protein, 15 aa, Homo sapiens
YKAVSISTEPPTYLR

SEQ ID NO: 13807 - protein, 15 aa, Homo sapiens
YKAVSISTEPPTYLR

SEQ ID NO: 13808 - protein, 6 aa, Homo sapiens
EQKAKR

SEQ ID NO: 13809 - protein, 6 aa, Homo sapiens
EQKAKR

SEQ ID NO: 13810 - protein, 25 aa, Homo sapiens
GQLSWHQKTYAFSENPLPTVEIAIR

SEQ ID NO: 13811 - protein, 25 aa, Homo sapiens
GQLSWHQKTYAFSENPLPTVEIAIR

SEQ ID NO: 13812 - protein, 7 aa, Homo sapiens
KIRDQDR

SEQ ID NO: 13813 - protein, 7 aa, Homo sapiens
KIRDQDR

SEQ ID NO: 13814 - protein, 11 aa, Homo sapiens
LDMEIDGQKLR

SEQ ID NO: 13815 - protein, 7 aa, Homo sapiens
KIRDQDR

SEQ ID NO: 13816 - protein, 7 aa, Homo sapiens
KIRDQDR

SEQ ID NO: 13817 - protein, 7 aa, Homo sapiens
KIRDQDR

SEQ ID NO: 13818 - protein, 7 aa, Homo sapiens
KIRDQDR

SEQ ID NO: 13819 - protein, 7 aa, Homo sapiens
KIRDQDR

SEQ ID NO: 13820 - protein, 7 aa, Homo sapiens
KIRDQDR

SEQ ID NO: 13821 - protein, 11 aa, Homo sapiens
LDMEIDGQKLR

SEQ ID NO: 13822 - protein, 7 aa, Homo sapiens
KIRDQDR

SEQ ID NO: 13823 - protein, 7 aa, Homo sapiens
KIRDQDR

SEQ ID NO: 13824 - protein, 7 aa, Homo sapiens
KIRDQDR

SEQ ID NO: 13825 - protein, 7 aa, Homo sapiens
KIRDQDR

SEQ ID NO: 13826 - protein, 8 aa, Homo sapiens
SVTGKIQK

SEQ ID NO: 13827 - protein, 8 aa, Homo sapiens
SVTGKIQK

SEQ ID NO: 13828 - protein, 17 aa, Homo sapiens
LTKAVATYHANTEREQK

SEQ ID NO: 13829 - protein, 8 aa, Homo sapiens
SVTGKIQK

SEQ ID NO: 13830 - protein, 4 aa, Homo sapiens
KDKR

SEQ ID NO: 13831 - protein, 9 aa, Homo sapiens
QHKAAQVAK

SEQ ID NO: 13832 - protein, 17 aa, Homo sapiens
VIHVESGKILTGTDAPK

SEQ ID NO: 13833 - protein, 11 aa, Homo sapiens
WKYMIVDEGHR

SEQ ID NO: 13834 - protein, 11 aa, Homo sapiens
WKYMIVDEGHR

SEQ ID NO: 13835 - protein, 11 aa, Homo sapiens
WKYMIVDEGHR

SEQ ID NO: 13836 - protein, 17 aa, Homo sapiens
VIHVESGKILTGTDAPK

SEQ ID NO: 13837 - protein, 17 aa, Homo sapiens
VIHVESGKILTGTDAPK

SEQ ID NO: 13838 - protein, 6 aa, Homo sapiens
KPVDFK

SEQ ID NO: 13839 - protein, 5 aa, Homo sapiens
IKLGR

SEQ ID NO: 13840 - protein, 5 aa, Homo sapiens
IKLGR

SEQ ID NO: 13841 - protein, 5 aa, Homo sapiens
NHKYR

SEQ ID NO: 13842 - protein, 8 aa, Homo sapiens
YKDSSSGR

SEQ ID NO: 13843 - protein, 8 aa, Homo sapiens
YKDSSSGR

SEQ ID NO: 13844 - protein, 7 aa, Homo sapiens
IRNHKYR

SEQ ID NO: 13845 - protein, 7 aa, Homo sapiens
KEKAQDR

SEQ ID NO: 13846 - protein, 7 aa, Homo sapiens
KEKAQDR

SEQ ID NO: 13847 - protein, 7 aa, Homo sapiens
KEKAQDR

SEQ ID NO: 13848 - protein, 7 aa, Homo sapiens
IRNHKYR

SEQ ID NO: 13849 - protein, 4 aa, Homo sapiens
KSSR

SEQ ID NO: 13850 - protein, 4 aa, Homo sapiens
KSSR

SEQ ID NO: 13851 - protein, 4 aa, Homo sapiens
KSSR

SEQ ID NO: 13852 - protein, 4 aa, Homo sapiens
KSSR

SEQ ID NO: 13853 - protein, 16 aa, Homo sapiens
KRDSDAGSSTPTTSTR

SEQ ID NO: 13854 - protein, 4 aa, Homo sapiens
KSSR

SEQ ID NO: 13855 - protein, 14 aa, Homo sapiens
GGTKTLMNTIMQLR

SEQ ID NO: 13856 - protein, 14 aa, Homo sapiens
GGTKTLMNTIMQLR

SEQ ID NO: 13857 - protein, 6 aa, Homo sapiens
LIDQKK

SEQ ID NO: 13858 - protein, 6 aa, Homo sapiens
LIDQKK

SEQ ID NO: 13859 - protein, 7 aa, Homo sapiens
KLIDQKK

SEQ ID NO: 13860 - protein, 6 aa, Homo sapiens
LIDQKK

SEQ ID NO: 13861 - protein, 6 aa, Homo sapiens
LIDQKK

SEQ ID NO: 13862 - protein, 4 aa, Homo sapiens
KDKR

SEQ ID NO: 13863 - protein, 15 aa, Homo sapiens
AVATYHANTEREQKK

SEQ ID NO: 13864 - protein, 5 aa, Homo sapiens
IEKER

SEQ ID NO: 13865 - protein, 9 aa, Homo sapiens
ENERIEKER

SEQ ID NO: 13866 - protein, 9 aa, Homo sapiens
ENERIEKER

SEQ ID NO: 13867 - protein, 5 aa, Homo sapiens
IEKER

SEQ ID NO: 13868 - protein, 5 aa, Homo sapiens
IEKER

SEQ ID NO: 13869 - protein, 9 aa, Homo sapiens
ENERIEKER

SEQ ID NO: 13870 - protein, 5 aa, Homo sapiens
IEKER

SEQ ID NO: 13871 - protein, 9 aa, Homo sapiens
ENERIEKER

SEQ ID NO: 13872 - protein, 9 aa, Homo sapiens
ENERIEKER

SEQ ID NO: 13873 - protein, 9 aa, Homo sapiens
ENERIEKER

SEQ ID NO: 13874 - protein, 9 aa, Homo sapiens
ENERIEKER

SEQ ID NO: 13875 - protein, 9 aa, Homo sapiens
ENERIEKER

SEQ ID NO: 13876 - protein, 15 aa, Homo sapiens
AVATYHANTEREQKK

SEQ ID NO: 13877 - protein, 9 aa, Homo sapiens
ENERIEKER

SEQ ID NO: 13878 - protein, 9 aa, Homo sapiens
ENERIEKER

SEQ ID NO: 13879 - protein, 9 aa, Homo sapiens
ENERIEKER

SEQ ID NO: 13880 - protein, 10 aa, Homo sapiens
YNQMKGMGMR

SEQ ID NO: 13881 - protein, 10 aa, Homo sapiens
YNQMKGMGMR

SEQ ID NO: 13882 - protein, 16 aa, Homo sapiens
GQPLPDHLQMAVQGKR

SEQ ID NO: 13883 - protein, 16 aa, Homo sapiens
GQPLPDHLQMAVQGKR

SEQ ID NO: 13884 - protein, 16 aa, Homo sapiens
GQPLPDHLQMAVQGKR

SEQ ID NO: 13885 - protein, 10 aa, Homo sapiens
YNQMKGMGMR

SEQ ID NO: 13886 - protein, 16 aa, Homo sapiens
GQPLPDHLQMAVQGKR

SEQ ID NO: 13887 - protein, 17 aa, Homo sapiens
KKIPDPDSDDVSEVDAR

SEQ ID NO: 13888 - protein, 6 aa, Homo sapiens
LIDQKK

SEQ ID NO: 13889 - protein, 7 aa, Homo sapiens
KLIDQKK

SEQ ID NO: 13890 - protein, 7 aa, Homo sapiens
KLIDQKK

SEQ ID NO: 13891 - protein, 7 aa, Homo sapiens
KLIDQKK

SEQ ID NO: 13892 - protein, 7 aa, Homo sapiens
KLIDQKK

SEQ ID NO: 13893 - protein, 7 aa, Homo sapiens
KLIDQKK

SEQ ID NO: 13894 - protein, 7 aa, Homo sapiens
KLIDQKK

SEQ ID NO: 13895 - protein, 6 aa, Homo sapiens
LIDQKK

SEQ ID NO: 13896 - protein, 16 aa, Homo sapiens
LCTVNSVEEKILAAAK

SEQ ID NO: 13897 - protein, 10 aa, Homo sapiens
VSYKGSPAAR

SEQ ID NO: 13898 - protein, 10 aa, Homo sapiens
VSYKGSPAAR

SEQ ID NO: 13899 - protein, 16 aa, Homo sapiens
LCTVNSVEEKILAAAK

SEQ ID NO: 13900 - protein, 11 aa, Homo sapiens
KELPEYYELIR

SEQ ID NO: 13901 - protein, 11 aa, Homo sapiens
KELPEYYELIR

SEQ ID NO: 13902 - protein, 22 aa, Homo sapiens
GMLLKTFNEPGSEYFIFLLSTR

SEQ ID NO: 13903 - protein, 10 aa, Homo sapiens
VSYKGSPAAR

SEQ ID NO: 13904 - protein, 22 aa, Homo sapiens
GMLLKTFNEPGSEYFIFLLSTR

SEQ ID NO: 13905 - protein, 22 aa, Homo sapiens
GMLLKTFNEPGSEYFIFLLSTR

SEQ ID NO: 13906 - protein, 22 aa, Homo sapiens
GMLLKTFNEPGSEYFIFLLSTR

SEQ ID NO: 13907 - protein, 22 aa, Homo sapiens
GMLLKTFNEPGSEYFIFLLSTR

SEQ ID NO: 13908 - protein, 26 aa, Homo sapiens
AEDRGMLLKTFNEPGSEYFIFLLSTR

SEQ ID NO: 13909 - protein, 7 aa, Homo sapiens
VKIKLGR

SEQ ID NO: 13910 - protein, 7 aa, Homo sapiens
VKIKLGR

SEQ ID NO: 13911 - protein, 7 aa, Homo sapiens
VKIKLGR

SEQ ID NO: 13912 - protein, 7 aa, Homo sapiens
KEKAQDR

SEQ ID NO: 13913 - protein, 7 aa, Homo sapiens
KEKAQDR

SEQ ID NO: 13914 - protein, 11 aa, Homo sapiens
AQIMAYKMLAR

SEQ ID NO: 13915 - protein, 11 aa, Homo sapiens
AQIMAYKMLAR

SEQ ID NO: 13916 - protein, 10 aa, Homo sapiens
YNQMKGMGMR

SEQ ID NO: 13917 - protein, 11 aa, Homo sapiens
AQIMAYKMLAR

SEQ ID NO: 13918 - protein, 13 aa, Homo sapiens
LTCEEEEEKMFGR

SEQ ID NO: 13919 - protein, 13 aa, Homo sapiens
LTCEEEEEKMFGR

SEQ ID NO: 13920 - protein, 13 aa, Homo sapiens
LTCEEEEEKMFGR

SEQ ID NO: 13921 - protein, 20 aa, Homo sapiens
LMEEDELPSWIIKDDAEVER

SEQ ID NO: 13922 - protein, 13 aa, Homo sapiens
LTCEEEEEKMFGR

SEQ ID NO: 13923 - protein, 13 aa, Homo sapiens
LTCEEEEEKMFGR

SEQ ID NO: 13924 - protein, 20 aa, Homo sapiens
LMEEDELPSWIIKDDAEVER

SEQ ID NO: 13925 - protein, 13 aa, Homo sapiens
LTCEEEEEKMFGR

SEQ ID NO: 13926 - protein, 20 aa, Homo sapiens
LMEEDELPSWIIKDDAEVER

SEQ ID NO: 13927 - protein, 13 aa, Homo sapiens
LTCEEEEEKMFGR

SEQ ID NO: 13928 - protein, 20 aa, Homo sapiens
LMEEDELPSWIIKDDAEVER

SEQ ID NO: 13929 - protein, 20 aa, Homo sapiens
LMEEDELPSWIIKDDAEVER

SEQ ID NO: 13930 - protein, 13 aa, Homo sapiens
LTCEEEEEKMFGR

SEQ ID NO: 13931 - protein, 13 aa, Homo sapiens
LTCEEEEEKMFGR

SEQ ID NO: 13932 - protein, 20 aa, Homo sapiens
LMEEDELPSWIIKDDAEVER

SEQ ID NO: 13933 - protein, 20 aa, Homo sapiens
LMEEDELPSWIIKDDAEVER

SEQ ID NO: 13934 - protein, 13 aa, Homo sapiens
LTCEEEEEKMFGR

SEQ ID NO: 13935 - protein, 20 aa, Homo sapiens
LMEEDELPSWIIKDDAEVER

SEQ ID NO: 13936 - protein, 20 aa, Homo sapiens
LMEEDELPSWIIKDDAEVER

SEQ ID NO: 13937 - protein, 13 aa, Homo sapiens
LTCEEEEEKMFGR

SEQ ID NO: 13938 - protein, 13 aa, Homo sapiens
LTCEEEEEKMFGR

SEQ ID NO: 13939 - protein, 20 aa, Homo sapiens
LMEEDELPSWIIKDDAEVER

SEQ ID NO: 13940 - protein, 20 aa, Homo sapiens
LMEEDELPSWIIKDDAEVER

SEQ ID NO: 13941 - protein, 20 aa, Homo sapiens
LMEEDELPSWIIKDDAEVER

SEQ ID NO: 13942 - protein, 13 aa, Homo sapiens
LTCEEEEEKMFGR

SEQ ID NO: 13943 - protein, 20 aa, Homo sapiens
LMEEDELPSWIIKDDAEVER

SEQ ID NO: 13944 - protein, 20 aa, Homo sapiens
LMEEDELPSWIIKDDAEVER

SEQ ID NO: 13945 - protein, 20 aa, Homo sapiens
LMEEDELPSWIIKDDAEVER

SEQ ID NO: 13946 - protein, 13 aa, Homo sapiens
LTCEEEEEKMFGR

SEQ ID NO: 13947 - protein, 20 aa, Homo sapiens
LMEEDELPSWIIKDDAEVER

SEQ ID NO: 13948 - protein, 13 aa, Homo sapiens
LTCEEEEEKMFGR

SEQ ID NO: 13949 - protein, 20 aa, Homo sapiens
LMEEDELPSWIIKDDAEVER

SEQ ID NO: 13950 - protein, 20 aa, Homo sapiens
LMEEDELPSWIIKDDAEVER

SEQ ID NO: 13951 - protein, 20 aa, Homo sapiens
LMEEDELPSWIIKDDAEVER

SEQ ID NO: 13952 - protein, 20 aa, Homo sapiens
LMEEDELPSWIIKDDAEVER

SEQ ID NO: 13953 - protein, 13 aa, Homo sapiens
LTCEEEEEKMFGR

SEQ ID NO: 13954 - protein, 20 aa, Homo sapiens
LMEEDELPSWIIKDDAEVER

SEQ ID NO: 13955 - protein, 20 aa, Homo sapiens
LMEEDELPSWIIKDDAEVER

SEQ ID NO: 13956 - protein, 20 aa, Homo sapiens
LMEEDELPSWIIKDDAEVER

SEQ ID NO: 13957 - protein, 20 aa, Homo sapiens
LMEEDELPSWIIKDDAEVER

SEQ ID NO: 13958 - protein, 13 aa, Homo sapiens
LTCEEEEEKMFGR

SEQ ID NO: 13959 - protein, 20 aa, Homo sapiens
LMEEDELPSWIIKDDAEVER

SEQ ID NO: 13960 - protein, 20 aa, Homo sapiens
LMEEDELPSWIIKDDAEVER

SEQ ID NO: 13961 - protein, 13 aa, Homo sapiens
LTCEEEEEKMFGR

SEQ ID NO: 13962 - protein, 20 aa, Homo sapiens
LMEEDELPSWIIKDDAEVER

SEQ ID NO: 13963 - protein, 13 aa, Homo sapiens
LTCEEEEEKMFGR

SEQ ID NO: 13964 - protein, 14 aa, Homo sapiens
HRKEVDYSDSLTEK

SEQ ID NO: 13965 - protein, 16 aa, Homo sapiens
KRDSDAGSSTPTTSTR

SEQ ID NO: 13966 - protein, 16 aa, Homo sapiens
VIQAGMFDQKSSSHER

SEQ ID NO: 13967 - protein, 5 aa, Homo sapiens
LKGGR

SEQ ID NO: 13968 - protein, 10 aa, Homo sapiens
VSYKGSPAAR

SEQ ID NO: 13969 - protein, 10 aa, Homo sapiens
VSYKGSPAAR

SEQ ID NO: 13970 - protein, 10 aa, Homo sapiens
VSYKGSPAAR

SEQ ID NO: 13971 - protein, 10 aa, Homo sapiens
VSYKGSPAAR

SEQ ID NO: 13972 - protein, 16 aa, Homo sapiens
VIQAGMFDQKSSSHER

SEQ ID NO: 13973 - protein, 7 aa, Homo sapiens
SVKVKIK

SEQ ID NO: 13974 - protein, 7 aa, Homo sapiens
KEKAQDR

SEQ ID NO: 13975 - protein, 6 aa, Homo sapiens
GFKYLR

SEQ ID NO: 13976 - protein, 6 aa, Homo sapiens
GFKYLR

SEQ ID NO: 13977 - protein, 6 aa, Homo sapiens
GFKYLR

SEQ ID NO: 13978 - protein, 6 aa, Homo sapiens
GFKYLR

SEQ ID NO: 13979 - protein, 7 aa, Homo sapiens
KEKAQDR

SEQ ID NO: 13980 - protein, 6 aa, Homo sapiens
GFKYLR

SEQ ID NO: 13981 - protein, 6 aa, Homo sapiens
GFKYLR

SEQ ID NO: 13982 - protein, 6 aa, Homo sapiens
GFKYLR

SEQ ID NO: 13983 - protein, 6 aa, Homo sapiens
GFKYLR

SEQ ID NO: 13984 - protein, 6 aa, Homo sapiens
GFKYLR

SEQ ID NO: 13985 - protein, 6 aa, Homo sapiens
GFKYLR

SEQ ID NO: 13986 - protein, 11 aa, Homo sapiens
WKYMIVDEGHR

SEQ ID NO: 13987 - protein, 11 aa, Homo sapiens
WKYMIVDEGHR

SEQ ID NO: 13988 - protein, 11 aa, Homo sapiens
WKYMIVDEGHR

SEQ ID NO: 13989 - protein, 17 aa, Homo sapiens
KKIPDPDSDDVSEVDAR

SEQ ID NO: 13990 - protein, 16 aa, Homo sapiens
KIPDPDSDDVSEVDAR

SEQ ID NO: 13991 - protein, 17 aa, Homo sapiens
KKIPDPDSDDVSEVDAR

SEQ ID NO: 13992 - protein, 14 aa, Homo sapiens
VDKQSALMVNGVLK

SEQ ID NO: 13993 - protein, 5 aa, Homo sapiens
KIKER

SEQ ID NO: 13994 - protein, 5 aa, Homo sapiens
KIKER

SEQ ID NO: 13995 - protein, 5 aa, Homo sapiens
KIKER

SEQ ID NO: 13996 - protein, 5 aa, Homo sapiens
SVKVK

SEQ ID NO: 13997 - protein, 16 aa, Homo sapiens
KRDSDAGSSTPTTSTR

SEQ ID NO: 13998 - protein, 10 aa, Homo sapiens
VSYKGSPAAR

SEQ ID NO: 13999 - protein, 16 aa, Homo sapiens
KRDSDAGSSTPTTSTR

SEQ ID NO: 14000 - protein, 8 aa, Homo sapiens
YKDSSSGR

SEQ ID NO: 14001 - protein, 5 aa, Homo sapiens
NHKYR

SEQ ID NO: 14002 - protein, 5 aa, Homo sapiens
NHKYR

SEQ ID NO: 14003 - protein, 7 aa, Homo sapiens
IRNHKYR

SEQ ID NO: 14004 - protein, 16 aa, Homo sapiens
KRDSDAGSSTPTTSTR

SEQ ID NO: 14005 - protein, 6 aa, Homo sapiens
KPVDFK

SEQ ID NO: 14006 - protein, 6 aa, Homo sapiens
KPVDFK

SEQ ID NO: 14007 - protein, 5 aa, Homo sapiens
LKGGR

SEQ ID NO: 14008 - protein, 5 aa, Homo sapiens
LKGGR

SEQ ID NO: 14009 - protein, 5 aa, Homo sapiens
LKGGR

SEQ ID NO: 14010 - protein, 6 aa, Homo sapiens
LKGGRR

SEQ ID NO: 14011 - protein, 5 aa, Homo sapiens
IKLGR

SEQ ID NO: 14012 - protein, 11 aa, Homo sapiens
KELPEYYELIR

SEQ ID NO: 14013 - protein, 11 aa, Homo sapiens
KELPEYYELIR

SEQ ID NO: 14014 - protein, 11 aa, Homo sapiens
KELPEYYELIR

SEQ ID NO: 14015 - protein, 10 aa, Homo sapiens
VSYKGSPAAR

SEQ ID NO: 14016 - protein, 10 aa, Homo sapiens
VSYKGSPAAR

SEQ ID NO: 14017 - protein, 5 aa, Homo sapiens
NHKYR

(The sequence listing continues in the following parts.)

What is claimed is:

1. A process for preparing an isolated modified protein complex selected from the group consisting of 1) non-canonical BAF (ncBAF) core, 2) BRD9/ncBAF core, and 3) ncBAF protein complexes, wherein the isolated modified protein complex comprises at least one GLTSCR1 or GLTSCR1L subunit that comprises a heterologous amino acid as an affinity tag or a label, comprising:

a) expressing the GLTSCR1 or GLTSCR1L subunit that comprises the heterologous amino acid as an affinity tag or a label, in a host cell or organism; and b) isolating the modified protein complex comprising the GLTSCR1 or GLTSCR1L subunit that comprises the heterologous amino acid as an affinity tag or a label.

2. The process of claim 1, wherein the affinity tag is selected from the group consisting of Glutathione-S-Transferase (GST), calmodulin binding protein (CBP), protein C tag, Myc tag, HaloTag, HA tag, Flag tag, His tag, biotin tag, and V5 tag.

3. The process of claim 2, wherein the affinity tag is an HA tag.

4. The process of claim 1, wherein the label is a fluorescent protein.

5. The process of claim 1, wherein the affinity tag comprises two different tags which allow two separate affinity purification steps.

6. The process of claim 5, wherein the two tags are separated by a cleavage site for a protease.

7. The process of claim 5, wherein the two tags are selected from the group consisting of Glutathione-S-Transferase (GST), calmodulin binding protein (CBP), protein C tag, Myc tag, HaloTag, HA tag, Flag tag, His tag, biotin tag, and V5 tag.

8. The process of claim 7, wherein one of the two tags is an HA tag.

9. The process of claim 1, wherein at least one subunit of the isolated modified protein complex is linked to at least another subunit through covalent cross-links.

10. The process of claim 1, wherein at least one subunit of the isolated modified protein complex is linked to at least another subunit through a peptide linker.

11. The process of claim 1, wherein the isolating step comprises density sedimentation analysis.

12. The process of claim 1, wherein the host cell is a mammalian cell.

13. The process of claim 2, wherein the host cell is a human cell.

14. The process of claim 1, wherein the host cell is a *D. melanogaster* S2 cell.

15. The process of claim 1, wherein the host cell is a yeast cell.

* * * * *